United States Patent 7,368,527 (HADDE71 POLYPEPTIDES) - sequence listing, part 3

SEQ ID NO: 6326 - DNA, 3544 bp, Homo sapiens
tcatccctagccctcagtgtactcatggtggccaggtgaggagggcagatatagagtccctttgaggagaagagggcctgccagcccaggtacagatgcttccctcagggtccaatctccctgatgtcccctgccatggccacacactgagccttgcttctgatccttggaggctagatagttccagaatggccacacgttggcgagggcttagtcaaccagctctgactgcatctgcaaggatgcagtggggaattcctgactgacgggtctaccactggacattctgaggtttcttcctccgtgccacatcctgggtcaaccctggattgtctgatgatatagttcttgatgctgataactggggtgctagggtatctcctctgcacaccttagtcatgactcaggtggggcttgagcactttctctacgcaccttctctacaaccctggtgggctgggacactccctcttaatgccttagtcagtgcctggtgggaccatagatgttgcagggtgtttggaatttggacagagatcctggtggaaaagggacaagatgaaccataaagaggagccagtgcttgctggggacagaagatggagggttagaaattcagtctgtggagcagtcttggagagaaattggcaggcacccagtacctcccttggtcgaaggctgctccagggtagtacagttctctggccagccggtcttgccaggcaagtgcctgagccctgaggaagcaagaaggctctctacctgcagtcagagtctgctctgggagaaagtacacagtgcgttgtgatcccctttaatctctctattttctgtttgtagaaagtccatgagatgctgaagaaggggtgggatgctgaaggttctcccttccgaggccagcgattcgaccctgccatgttcaacatctccccgggggctgtgcagttttaatgaccagaaggaaaggaaaccctcgccggtggggaggcagagccttatcctcggctgcccttcttggctccctgcattccagggacttgctcgtcttgtttacccctagccatcctttctttcaagggtgaaccaggccttccaccctgaccttgcatctccagactgttccagagaaggtgcggggccagctgctatgtggtggccgctgtggctgacactgagtgaaggtgtttgaaatgcaggagaggatatcccagcaaattgggatcacatgcttttgtctccacagcaaccagccactgcaggcagcatgtctttcctcccctgctctctgcttgctgttgttttgacgctattctgcttgcatgtcttctggttgggatgtggagttgttgctggactctcaggcgaagctgaagtcattgaagtgtgtgaagctctgtgcttgcatgagggcaagcaaggaatggctgtgcctgaggctgctctgggaaactccttgccccttgacctcttttgagagcattcacgtggtcttcttgctcatccccttataaatgtgctttgcctgcctcagcctcatggtcagagcagtggagactggagccctgtttgcacgttctagttgttcggagaaagcctaggttctgggctcaggtccagatgcagcggggattctgttctctgactgtggcgaccttgctttggttcttgttgaagtgaaccaagcccggccaccacgcatggcatgctgtgcttggctccccataagacgtcctctttgggtgcacggtgtcaaagtgtgggcaggagtggagagctggtgccctcaggaggagaccacagcatgtccatcagctcagcagagctcgacagccacaagtcctgagaagctttgaccttgaagggcttctgggagaggaggaatttctgcatggggcgtgaaggcacactgtcccaccacaactgaaccagaagagagtgaagactcccctcttcccatcctctgtgccaggtgccagactgtgctccttggaacttatggcccaatcttacctgttctccagggactggtcactgcctcaggacccccaagcctatgccctgagccatggctgctgactgactccagccaaggtgcaaagacgagattatgagacaggtcctcaggcctgtgttccaagtactcacaggggctctgggtgcccatcgccgggagtatggttcagctgccaccggcactgtccatttgcctgtctgtcaagctcagagcatggataagccacacagcagggcagtgcaccctggcaccatgcacggccagcaagaatcaaggcccgcagatgctaagagggcctattgtcaggggaaggtccccgctcctgcacactctctatggatacttgggttgtgggggctctcttggagagtaagtttgtggtttgtttctggtttacagtggtggctgacaccccttgtaagaaagcattcctgggaagtcttctgtgggtccaaacatgttgctccgatcatcacaggagagcaaaaggccctagataccccctttggaatgtgagagtcttgttgtctgatatttgccactgagctggtgaagcccctctaaagagatctcgaccctggggagcagaattcttgtcatctatgaggggtcctgagaaagacttgtcattttttttcctggagttcttcccattgaggtcctaggatttgcacaccactgtcccacaagagctttcctgcctaatgaaaggaggtcttgtggtgtgtgtctcctctcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgttttgcctgattttatattctgtgttgcatttctccccactccctgccctgctttaataaacagcaaaccaatatctaggaagaatgactgagggatagtattgggtattggccccatggcaggaacagccacttgcatctggtcccggtgccacactgcggtgcttggtgtggttgtggagcctgtccctgcgcgccttgctcccgttgagccacgctgtctggtgggtgattctctgccctgagccaccaccctggactggcccagtctccagagctggcacaccctgcctgttttctctttttagacacaacagccgcagtttggccagccactaagtcccaccagctgaggtccgaggaaagcggggtgactcatttcccttgtccagggcccgaggagagtgaggtgtccagcctgcaaagctattccagctccttggtgttggtttgcaataaattggtatttaagcagttctgggtctgcgtgtgacatttgctgctgagacagttctgtctgtgcatggtcattattgttgcattctagccttgaggtcccaggccaacgtacacagcaaacaccagcatggggaattcttaggggttgtttcccatctggtctgaatgcactgggcaagatctcaata

SEQ ID NO: 6327 - DNA, 309 bp, Homo sapiens
ccacaggtgtcatttgccctacagctggctggggttctgttgaaaggttcagaggcttcatgcagctgcctgctgaagtcatccattcttgtgttttgttgaggctgtgcagaggggcttcatgtagtcttctctgcacccacagccactccatgtgagctgcagcacttgttctcaaaatggtctttccaaagtctctgatgtgagttgcctgtaagaaattgatagtaatgtcaattaatccctagtatatagtatctgtctttgatatgcttgttgttgcatcacttaggtcttaaaaaaagaaaa

SEQ ID NO: 6328 - DNA, 468 bp, Homo sapiens
cactgcccagaacactgcgcttggggaacagacctcacccccacctcaaatctgctctccactgggcctgttggcagccagctcagctggggaagggacagcatgactcgctttgtcgatgaaaagcacgaagttgtcagcacagaacctggccagtccttgagaaactccctccttggtggtcagaggtcaagcagcccatgtggcccacggtcctgaagaactgggctatgtccctgaggctcctctctaccgtctgactgtggggtctggggaacaggcatttaaaccaggctgctgccctggggagtgcccactggacgccagggtgccccatagggacagggtcacaaagccctggggcttcccctgccagtcctggtgaggacagtgtggtcactatctcagagagacgaaaaatgaatattctgtcatttcagactaaactactcacccagctcacactaa

SEQ ID NO: 6329 - DNA, 5877 bp, Homo sapiens
gatcccgcccccctcggagcgcccctgtggtctgacttcagcagcactttccggcaggagactgggcactcgctgtcacccgcgagctgcctccctcagcgagatctgagcatctttccggaggctaacagacctgggcttcggggtgaccactgtgcttgcctcagtttccttttctggagcaggggaaggcccggctccctgcccaaaggcggctgtgcgctaagtggcagacgctcggggagagccggcgcggggcggaccccagcgccagtagtgacaggggcgaacgccgccgggagactccagccggcgggcgagcagggtaagccaggccgtgggcgggagggcggggcagctcaccggtaaaaggcagagtccccgagtgggttccagttcgccgtgtagcagtccatggctggtgcagacggcagctgggaagcaccgaggggacacccacctagagcgggctccaggccggcacttccgcttccgcccgtccgggtcacgtggcgaggccgccgccgcggccatcaccactgtgggcagcctcacttggctgccgccccgagaccccagcccgtacctgggcttcgcgcccgccaagtgggcccagccctggctcctgcgccctgtggcggccacctccatcgccttgctttcccttcgggcactgggggtcgctcagggcgggacatgggtgaacggaagtggaagctgtgagcgtcgcagcccgaggcgccgaggcctgaggcgccgtcggggccacagcgacgctcgcatggagagcgctgggcgctgggctgtgcaccgacggctaacctggacccacggtctctgcggggcgggagctttgcagaaccgactggccgactggggcgcgggaacatgaggcttggctaggagcccgctgcgggccaggcgcgcggtgcgcaggcatacccgggtcgcgggtgaacaccgcggagccccgggacttggtaattggcgcgagcgggtgcgcgcatgcgcgggacggcggcgggcacgtggcgaggcgcagggcggcgccgcgcgggaagctccccagtgccctggaggcctgctggctggacgaccccctgcctctggtaccaagtgtgaccaaggctggcgccaccatggctctgctgccgtcacctcctccctttagcattgagcagccccggaggggctagccctgaggctgacctgcccagagtccccaccatcgcgctgcttagtggcctctccctgcagcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccagtgagtgcctcttctagggtgacgcttccagtcccacaccttgcagcccgttcagtgtgtctggaccatttgtttccatctcacatctcttgtctgtcttctggtctgttccgtccagtaggttttctctttttatgtcccacacatcttccacaggagtcctgacaggtgtaataacctgtgcactttttagcccatccttgctcagcatttctcgccctgacagctccccataatttccatcacgaaagcgttgcattgtgtagtgtgtctcctgggtgacttggccgacttaatttctgccaggtgatcttgggtcactgtatactgctggccaggaggcacacagaacagaggcaatgccaggactttttaacctcatcttttctcctgcgtctaagtcaaccacagagctggtgtcgggcacctcagccctgggaaaatggggtcctggacttggaaggagctggggcaggctgaggtctgcctcagccttgggatctctgtctcctcccagttcagagggctgtgtacaaggacctggtgctcttgctccagaaagactcactgctcacagctgcccagctgaaagccaaggtgagggaagcttggtggccatgtcagtggtgggtgggcacagaccctggcctggcagggttctcctccctggcatgggtctgaccagtagggtggggggggtgggtagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccaggttggggcgagggaaaggggaatactggttggggctggaagtacggctgaggcagtccacccttgtgctcttgcccaccctgtgtgttatccaacagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagaggcaagtgactgaggcccatcaggacaagagatgggatagcagactggtagataggacaccctgctttcagaccctgctgcgttctgtggctcttagaggctgcactttctcacttagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctggtgagccctaccataagtgggggggtagtgatgcactggggccctcagaggacagggctcagaaacagaatgggacacagccactcaagggaagtagaggtcccttgaaggactcctgtggcttctgcatgcaccttcctcaacccctgaggagggttagatcatcggagcaatattcttgtccaagttccagttttctacagtctggctgtgtagtcatttctgtgtgcttgaaggagcttgtacaagtattgaccacataaggcagcatgttgcaagggtcctacccaacagattaacaggaaagaaatggggcatgggtgtgaggagtggaaagacagggaggaagggccatccaggcagtgtggcagaagcaaagaagcccacagctggggggtgggggtacagtcaactggcagggtgtggaacagggatgttgcatcgggaaggccagccttatggacttgggctcaatggacagtgttccataggcttcttagttcagcctcagagtcccactgtgactggtgcagcttggtgtagctctcctcgggccccatctctgggcctttggtggaggcttctgagggccccactcccccttgttttgaggcactgctccccatcacatctcaactgtaacactctgctgcagaacctctgtttccatgtcaacaccctagtccctgcatgcacacaaagagggcaccatggctgattgtctccatggctgcttctcccctgcatcgtgtccttaaagggcaagtttcctgctgcacttgttgacgactcacccctttcagccccagtgtctagcacaatttccctgtacacagtatcaacagaattgtatttgttgaatgggaggcacgagtcatgttagaaggccgattatggcagcacaagaggatgtgggggcacagagagtccaggaatatcatagagacagacctgtaacacttggtagccaggagttggagcatcagggaggtgaatacagattttggttaaacatccccattttcttgtttagatgtaataattgatccccagcaaatgatgggatgccctgaaggttgtaaggctagttttgatggcttaggcctttgaaatccaatttggagctacagaagttagggccatgaaaagggagagttgatttggggtggaaggatgagttggtgagtttggtcacagcagattgatttgaggttctttggaaatacagagtagatttgcagtcattggtacccagcagagagattaaaactgagggcacagtggcagctgtgagggagacagaacgatgctcatgctttggattggcaggaaagaggggctatggcggaaacaaaaggagatgagggcaggggcacttttaggaaggactgaggctgctggcagtgtcacatgactgttgagaagaagggaatttgttagcaagtggttacatttagtaggaaaagtgttgagggcatgggtttggattaaaggagggagtgagcaattgaggaggaagtggaaattgggcaaaacattccttttggaagtttggatggtaaaaggaagttgttggggaagggaataacaggatctttatgtttggcttatttactggtctatggggaggaggtgggcgaggaaaaagctagatacaagacctgggcaaacaaagaaggctctggagggaagtgtaggttagaacaaaggtaagtctgagaggtaagagagaaggaacacactttgggcttggcctgaaatgagagggaatgaggaaaactgggtagagggcaaggatgctccagcctggtggctctgctctccaagaggaaggaatagagctttagaagtgtggatggccagagttcagggcagcctggctcccaagcctacctaaaacaaccatcccattcctagacccgtggattgaggactgggcagagatgaatcatccattccagggaagccataggcagaccccagacttcggggagcacctggccttgctcccacccccaccttcttctttgcctcctcccatgccttttccctacccgcttcctcagccctcgccacctcccctcttcccacccctgccccaggataccccttttttcccaggccagcccttcccaccccatgaattcttcaactataatccagtggaggacttctcgatgccaccccacttaggtaggtgcttctgcagctcccccaccctcttgtacctccccttacccagcctcctatgcctaggtgagctgagaggagttgggtagctccttgtgcccctagcactgggtttggtcacagcagtccctgagtctgaaacatcatctgtaggttcattaatcagctcactggttgtcactgtttcaccgtctgaaggtaggggaaggactatcccttttttgtagatagggaaacagagaagctcacctggaggacaagagttgcttcaaggcagagctgcactcactctggccagaagcctgctcttataatgactggttcttttgtaggatgtggccctggagtgaactttgtgcctggccctctgccacctccaatccctggccctaatccccatggtcagcactggggcccagtggtccaccgggggatgccacgctatgttcctaacagcccctaccatgtgcggagaatgggggggccctgcaggcagcggctcagacactcagagagactgatccacacatacaaactggacagacggcctcctgcccattcggggacatggcctgggtagactggatcttgggctgggactggatgtgccaatggcccttcagggcctgcctggcacctcaggtactgggctagggtgtctgctatgcctggtattgttcttgtccattgctgtcaccaataaaggcatggaagaacagagtgacaaa

SEQ ID NO: 6330 - DNA, 636 bp, Homo sapiens
gatcctcctaactcagcctctccagtacctgggactataggaacatgccacaaagctcggcccagtaaaatatttttaaaaaactttaatgggcaattattacatagcaagcactgttctaaatatgcactggtgataaagagaagcaagaaacatgcttttggccgggctcagtggttcacgcctgtaatcccagtactttgggaggccaaggtggatagattgcttaaggtcagaagttcaagaccagcctggccaccatggtgaaacctcacctctagcaaaaaatacaaaaattagccgggcgtggtgacaggggcctgcagtctcagccactcgggaggctgaggcaggagaatcccttgaacccgggaggcggaggttgcagtgagccgagtgcccctgcactccagcctgggcaacagaggaagactctgtcaaaaaaaaaaaaaatgctttcagccctgaaggagcctggtttagcagaagaaacctatacaaatgtcgcctaaatatacaaatagaccatacctaaaagaccctagcactgggcccagtgaggcccacaggattctattgggggagaatcaggcacagttccagaaagaacccttgaactactaagtcctgaaggat

SEQ ID NO: 6331 - DNA, 102 bp, Homo sapiens
gaggttgcagtgagctgagatcacgccactgcactccagcctgggtgacagagcaagactccatctcaaaaaaaaaaaaaaaaaaaaaaaaaactaataatc

SEQ ID NO: 6332 - DNA, 3072 bp, Homo sapiens
ctccagtgaaatcttacaaggagcctttgccaattactaggaaacaattacgcaccaagtagttggattagctgtcctcagttccctttataaaactgaaaaagtctccattgtcctaagtagaccagattctgataacattcttatgctttaaaaaataaaaaaatttttaaaggcactatcattctgagaatgcaagttgaagttgaccatagttttaaagtcagttgagtatactatgtcatggtccaacaatgtgcttttaattgtaattgacacacaaaaattacacagctaatctgtgtgaatgcaaagttgccaagaaacttaacatttcagctcttccagactggcgtctgcatagatgcaatcacacaagtaaaatatattaagtccccactgctcaatgcaataggtctctggggtccgtcaggtaagtcaacttagtaaatctcattttcctctgaattaagtgattgtcagaaagtgaatcacccttccttttcccctctttaagcatgctgcagtacaaaaattctataaaaataccttttttgagtcattaacataaaatgaagaaaacagcagcagccaagaagagagatgttgaaatttaagagaggaagacagagaagaaaaatccactggataccttatgtgtgtgagtacagtacttttgtttgttcaaataactgttttatgacaaaggcactgaaagattctaacaccacttcttgggagtgcagtccacaaagttctaaacagcagacagcgcaccacagaagatgtttatgttacatcagccaaactataaaactcttgtaacacttttctgaacccagcgtttccagtgtttatagattgctttgctatctgaaagacccagttagtatttaaaatggtaaagggttaaaaaagttaatatttctccctgctagttaccaactcacagctcaaatcccaccctgcaggggaaaacagtatcgccctggacttcctggaatctaggcaggacctccacgctccaagctgcaacctgctaaagtgatcaacgttttgatttttcacagctttgaaagcctctaactggcttttccattttggatcattccaaagtctgcagcaaaatcattggttttttgatgctggggtcggggtgggaggcagtgggttgacgggggtcacttaattgttgctagtttgttcaaactgagattcactgcataaaacttttagtagaatttcctccaaaatgctggcattccccccttcaaaatgaagaaagcatggaggctgactagccttataccacagtctcactgccttttccaggcttcacccaaccatttcctctcttctctctctttacctttccagaattcaccaatctgttggaacacttctgccacgtgtgaagagttttggcagaccaaatccacatgcctgaagtgatgcccaccaacaaagacataaaaattttcaacatttcaacagccatgttggaatcatctgcagaataccgaaaaagtgcccagttggagatttcataaaaataacaggcaatcacacacgttgcaggaactgtgtacagtactgagaacaccccaatcttgaccatcagtctttctaacttgtctgtctttgtcccatccttttgaagatttgaccgaattttgaacaaggccaccaaacctgcagcaatgaacaaagttccaatgaccaaataagtaaagaggggagccaccacgaacccggtgagggcatcgagattttggtttccaacatagcacaagccagtcagttcatctgcatccaccagtctcataatcaagatgacaatggttttcactgcggggatggcccaggctgcaatgtggaaataagagctgtgcatttcaatggcttcatgaccccatttgagtcctgctgccaaaaaccaagtgagtgtcagaataacccaccaaatggagctggccattccaaaaaagtacatcagcaagaaaattattgcacatcctgtgttcttaagtccttcttggatgagaacaggttctgctgcctcttcaaaatcacaggatatcctttcccggcctacagtcagcctgacaatataagcaatgctataaatattatagcacatactgagaaatatgatggggcgctcagggtaggaaaacctagaagaatcgatcaggaaggtcagtactgtgaaggcagtggagatgaaacacaggctggcccacacagccatccagatatcagtgaactccttggctgagcggctgtataagccagcatcatagccacacttgagcacacagttcaggctccttttcacccagatgtactgatcagaattggttcccacagagtgacactcttccccaggctggatgggggttttgtgaggtaagggcacctcttcatcacctggcccttccatgcacatgtggttgtggtcgttctgtggtgggaatttgctgcagttcagactctctggccaggcaaatccaaattccttcaggacgggttcacagcgtctcttgactgaaagacacatgccgccgcatgggccaatggggatgttgatcttctctgtgcacattggcacataaacagaacaaaggaagaactggaaaagtaacaaaatgaacacacacaaaaaaaacaatgacttggaagtttgaccaaatgctcccacaaagctgagttgaatgcttccaggcaatctaggtatctacttttaaaccaacctatcgggagtctgtctgtttactctgacctcaaacaagggcgcctgataatccatcacttacatacttttcttagtttggctttagtaatcctttccagaagaatgtacataaataaataaataaaataaatagggtctgaagaattgcataagccctctttgcacaacacttgaaataaatcttaaaaaactggctttcaatctccttccattttagaaactatttgaaaaagctaaagaaactaatatgactcatttaggtggtttatttttatccccgtttctttatcattttaaaaataaaagttaaaaaaaaa

SEQ ID NO: 6333 - DNA, 380 bp, Homo sapiens
cccatactgaaacaaaaaatggcccaaatgagacactgttagactcaaggatgggatgcagattgaggtctctggtcactagggatttgtttggccaggtttcctcaatgaataataatgaagcacaataggaaaatgtaaatgttaagtcgctgaaactgcagtaccagcaggggagagtccagttgctgtcctcaattcctccagcattgataaacagtctgcttggctccttacagatgttgtctatgaagtctagagttacaagtaactattttccagcatgtaaagggatccagtcttgtccttcaaaacagcttggccgctttccccaggatacatgtaattaaaaatatatatccctgcaaaagctgtttctc

SEQ ID NO: 6334 - DNA, 11726 bp, Homo sapiens
ggagccggagccaagggagtccaggctgccgggggctgcagacatggagggccagagcagcaggggcagcaggaggccagggacccgggctggcctgggttccctgcccatgccccagggtgttgcccaaactggggcaccctccaaggtaagacccctgagacccagtgccccccgctttcctgatccctggttccacacaccccccccacatacactgcaggctccctggtgctcctgactgaggggctggtactttcctctgctcagcgagcaggggctaggtgaagagagcaccctgggggctgaggggcagtgacaggatgcccggagacagatgaagttagccatctccaggagcccttgggagagtcctggactgggtatcagaggacccagctgtgctccacctttgctgtgtgaccttggccaagttgcttttcctctctgagccaatgcaaaatgagggggcttgtcgctgaagactaaaactgtgacatctgggatggctaagttgttagtactggaggcggtgtgatagttggggggaagccggcacacagtgtgacacttggagccaaggagggtgcctaaaatgccacctcaaagaactgagtttgagaagggaggtggagatggagttttaggtactctgaactgagaaggatacgggacagaaacagaagtgcgtctccagaggcagggcctccctgcgccctgttaccctacctagggccatcctggggcaagtatagacattcttctgccctccttggtgaaggacactttatcctgtcttctggagacaggggacatcagagagaatagatggggaaggaggataggtctctacaggactccgtgactccccacccctcccacctgccggacataaatgggatacctgcttgcctgtcctttcaggtaggggagaaagtggaggatgtaagagggcacaacctgggcacagagagatgtgacaccaggatcaacttagaatcctggacttgctctgaatgctagattcacacttggtgaggatggactattcaacggggctagatggaattctagcaaatgttgggctcataaatgcagacaatgggagatgaagattccccagaatataatgtggccaggaaccctagaccccatcccttcattttacagacagagaaactgaggcgctgggcagagaggtacttgcctaaggtcacacagagctgggctttgaatctacacagccagtctcagctcccagctcttgctcctgagtggagctctgggaatgggtaagagaacagagagggctgtaaccaagggatttggatgtttagggggcggtggggaactgagggtttctgggcattatgaaggaagggagaggtatttaacaagctgcacctgtaggtctgtatcttgacaatagaaaaagaaaagaaacaggctgtccccagtgtgcccagacctgggatgtcaggtcagtagccgtggctgggggagcttcagggactgcagtgggagggttgcccagggaagctgccccgaatgggcagggtgtgggtgccagccaggaaggcaaggcaagtcctcaggtttaggttcacactctgcctcatttgagtcagggtctgagtttccccatctgtgaaagaggtttcagacttaaaggaggggttagggttttgtgtcctatctcctccaagacagaagttgacctgcagcagaatagattgaagtgagatagtaggaagaacttccttggaaagatgtgcctttcttagctagatgaactctgccagggtctatatggaagttggggcccaatgccctggttagggtcactctgaatctttgacttgtcctccacaaggtggactcaagttttcagctcccagcaaagaagaacgcagccctaggaccctcggaaccaaggttggctctggcacctgtagggccacgggcagctatgtcagcttcctcggaaggaccgaggctggctctggcatctccccgaccaatcctggctccactgtgtacccctgaagggcagaaaacagctactgcccaccgcagctccagcctggccccaacatctgtgggccagctggtgatgtctgcctcagctggaccaaagcctcccccagcgaccacaggctcagttctggctccgacgtccctggggctggtgatgcctgcctcagcagggccaagatctcccccagtcaccctggggcccaatctggccccaacctccagagaccagaagcaggagccacctgcctccgtgggacccaagccaacactggcagcctctggcctgagcctggccctggcttctgaggagcagcccccagaactcccctccaccccttccccggtgcccagtccagttctgtctccaactcaggaacaggccctggctccagcatccacggcatcaggcgcagcctctgtgggacagacatcagctagaaagagggatgccccagcccctagacctctccctgcttctgaggggcatctccagcctccagctcagacatctggtcctacaggctccccaccctgcatccaaacctccccagaccctcggctctccccctccttccgagcccggcctgaggccctccacagcagccctgaggatcctgttttgccacggccaccccagaccttgcccttggatgtgggccagggtccttcagagcctggcactcactcccctggacttctgtcccccaccttccggcctggggccccctcaggccagactgtgcccccacctctgcccaagccaccccgatcacccagccgttccccaagccactccccgaatcgctctccctgtgttcccccagcccctgacatggccctcccaaggcttggcacacagagtacagggcctggcaggtgcctgagccccaaccttcaggcccaagaagccccagccccagtcaccacctcctcttctacatccaccctgtcatcctccccttggtcagctcagcctacctggaagagcgaccccggcttccggtgagggggccctctcccaagaaaggtggctggggcttagctctgaggttagccattcttccagggtggatggtgtgctctacctcagcttctctctctgaggaagagtctttggggagggggttgctgggcccactctgtgacgctcagaagatagcatcccctcctaaggaacttgccgcctctcagttgatctccccagggagagtgtggcagagggacaggattcggggcctcctgtgggtccttcttagggctttggcccacacctgcctccatttagttccccagggagtcctgtgaaaggaagcttgagggtgagggagtggtgccaggactacaccctcatatgcccctgccctcaggatcactgtggtcacatggaacgtgggcactgccatgcccccagacgatgtcacatccctcctccacctgggcggtggtgacgacagcgacggcgcagacatgatcgccatagggtgaggtggcagggcatgtggaccccctcctgagcccctcgggccttccgggccctccacccatggcaggggcttccagggcacctctccaatcccatggccaccctgcccccacccctccaggttgcaggaagtgaactccatgctcaacaagcgactcaaggacgccctcttcacggaccagtggagtgagctgttcatggatgcgctagggcccttcaacttcgtgctggtaacgcacccctcaccccctggacagccagagaccctgctgaattcctggctccagctgtaccctggctcactgtggggcccgctgggcctctgtggctgggtccgtgacatgggtgggtggaggagcagacctgaaggtgggcgcgagggcgggggagttgtgttctgtcccccagccacgtggcctcccgctgcaggtgagttcggtgaggatgcagggtgtcatcctgctgctgttcgccaagtactaccacctgcccttcctgcgagacgtgcagaccgactgcacgcgcactggcctgggcggctactgggtgagcctgtgagcaggcccagaagaggatgggacatgaagggggctttagattagtccccccgccccatgcacagcaaggtccccttcccatcctccaccctttaccctgcggcccagcccccccatgcaccacccaataccccatcctattcctctatacccccgcccttttctctccccactgtgtcccagcgttgttcctcatttctgtaggacccacccaccttccacccacatctcctctctaacccccgctcccagtgcctcacctcctggcctaagccccgcccatgagccatccgaccctgcctccctagggtaacaagggtggcgtgagcgtgcgcctggcggccttcgggcacatgctctgcttcctgaactgccacttgcctgcgcatatggacaaggcggagcagcgcaaagacaacttccagaccatcctcagcctccagcagttccaagggccgggcgcacagggcatcctggatcatgagtatgggctggggtggggccaaatagagcttgggtggggctagtgatgggggtttttgtaccaccttgggtggggcttatggagagaggcagggcctatggggtttagtgcccacccaaactagttgtaggaacacgaaagcagagagcagttggatggggaggggcggagcttgtagggtggagctttgctgaggggccccgccttgctgaaggtcagaacctaatttcctgtagaccggtccctctgcttttcctctgccctttggtgggctggaggctctggcaccactcacccactcactacatcccctcgggttggatgggctggaaggatctgggctgagcccttatcctccatggacctgttgacaccccccactgccccccacatctctcccatcccccaccccaaacagcctcgtgttctggttcggggacctgaacttccgcattgagagctatgacctgcactttgtcaagtttgccatcgacagtgaccagctccatcagctctgggagaaggaccaggtggggtccttgtccccagaagcacacagagcatgtcccaggacacgcctgtaccttagactatggtccctgtcctcacctgccccaccccctccctgggcacagcagagcccaagctgttgtccaatctgctctcctggaccccccacagctcaacatggccaagaacacctggcccattctgaagggctttcaggaggggcccctcaacttcgctcccaccttcaagtttgatgtgggtaccaacaaatacgataccaggtgagctcagtccgaggagggactgaggggaagtgggctgaggtcttctcgaacagggagactttgggaagaggggcaggaggcaaggtggagggttacatcttgatccccagcccctgaaacttggggtacccctgctcactgcagtgccaagaaacggaagccagcttggacagaccgtatcctatggaaggtcaaggctccaggtgggggtcccagcccctcaggacggaagagccaccgactccaggtgacgcagcacagctaccgcagccacatggaatacacagtcagcgaccacaagcctgtggctgcccagttcctcctgcaggtgagttctggcctcatcctccccgcatgaaatccccaggcccaactcggcataccactgcccctcaccattaccctttgtataaccccttgtacctgccctcagcagcatccatttgttgtaacagtggaaatggggttgcaatctacattttcagatgaggaagctgaggctcagacacatggcatcacctgcccagggtcacccaactagtaagaggaacagttaggatttgaacccaagtgagtctggtttcagagcccatgccttttctttttttttttttttttttttttgagacagagtctcattctgtcacccaggctggagtgcagtggcacgatcttagctcactgcaagctccgcctcccgggttcaagtgattctcctgcctcagcctcctgagtagctgggattacatcacccgccaccacgccaggctaatttttgtatttttagtggagacagggtttcaccatgttggccaggctggtcttgaactcctgacctcctgatccacccaccttggcctcccaaagtgctgggattacaggcgtgagctaccgtgtctggccaactttttttttttttttttttttctttgagacggagtcttgctcagccgccccaggctggagtgcagtggcacaatcttggctcactgcaaccaccatctcctgggtccaagcgattctcccgtctcagcctcccaagtagctgggattacaggcacccgccgtcatgcccggctaatttttgtattttagtagagacagggtttcaccgtgttggccaggctggtcttgaactgctgacctcaggtgatccacccacctcagcctcccaaagtgctaagattacaggcatgagccactgtgcccggcgccctttttttttttttttttttttaatgcagtctcactctgttgcccaggctggagtgcagtggcgtggtctcggctcactgcaacctctacctcctgggttcaagtgattctcctgcctcagcctcctgagtaactgggattacagctgcccgccaccacgcctggctaatttttgtatttagtagagatggggttttgccatgttggccaggctggtctcgaactcctgacctccggtgatctgcccacctcggcctcccaaagtgctgggattacaaggtgtgagccaccacacccagccttagagcccgtgccttttctgctaatctctaactcctgtcttctgagaaaggtttagagtaatttatcttaaaattcatttataggctggcgcagtggctcacacctgtaatctcaacactttgagaggctgaggtggaaggatcacttcagctcaggagtttaagaccggcctgagcaacacagtgagacactgtctttaaaaaaaatcaaaaaaaggccgagcgcagtggctcacgcctgtaatcccagcactttgggaggctgatgtgggcggatcacatgaggccaggagtttgagaccagcctggccaacatggcgaaacccatctctactaaaaatacaaaaattagcctggcgcagtggtgcatgcctgtaatcccagttgcttgggaggctgaggcacaagaatcacttgaacctgggaggcagaggttgcagtgagccagtatcgtgccactgcactccagcctgggtgacatgagcaagactgtgtctcagggaaaaaataaaaataaaaataaaatttagctaggtggtgcacacctgtattcccagctatttatgaggctgaggtgggaagatcactggagcttggaagatctagtctgctgtgagctgtgatcgtaccactgcactccagcccaggcaacagagcaagaccttgtctcaaaaaaaaaaaaaaattcacatatgcatcatcattttcactactagtgtcttaaaaataacaaagaaaagatataaaaattcacatatataataagaccagcaaaatcaaactccatgtaacattcattcatattcattcattcgttatttactgagtacttaactgtcttaccatatgccaagcattatgagagtgtgtagtgatggggagggagagcaaagatataaaaaatacaaagctgaactcttaagtagttactataatttatattgtatttaggattgaggttcctggttgccgacatcaaaatgggaaatcctagaatctcagaaccagacctgtgagaccaatttggcccactccctttttttctgtggcgggatctgaggctcctcatggggtaggcacatgccccaaaccatacacaggctctgcagtggcagagcagggtagatcccatcttttcagccctgaaacccaactctgggctcttcaagtctcttgatctgataagagggagcccagcaggccagaaaatgtttttcctggtaactttgtcacatggccagtcagtgggacattggccaatatctttagctgggaatggaaatatccccacgcttggcctgccatgacctctggcaaaagtgttgggcatgaagatttaacccacaattagggacctcacctgaaaaatcactccttttgacaccccatcctgtccttcccacctcctccaggactctgtccctttaaaaacatttcccaaccaggtgcagtggctcacgcctgtaatcccagcactttgggaggctgaggcagacggatcactaggtcaggagttcgagaccagcctggccaacacagtgaaaccctctctctactaaaaatacaaaaattacctgggtgtggtggtgcgcacctgtagtcctagctactcgggaggctgaggtagaggaattgcttgaacccgggaggcggaggttgcagtgagttgagatggcaccactgcactccagcctgggctacagagcgagactctgtctcaaaaaaaaaaaaaaaattcccattgagtacctactacatgccaggcctgtgtagtgcactttacatatgtcatccttttgaatgcctcagtaggccctgagatgtcccagttttcctctctgttttactggtgagggaaactgaggctcagagaacttaagtctcttagccaaggcaatgcagtcagaatagggctcagtaggggttttgatgctgcaaggccttggagggcattttcaaaggtctacccttgcccgcccctgctgttaggaacacaggaacagggaaagaatgtgccagttacttctggaacagattggctcggaagctgagggagggaaacctgaaactaggtaaacaggggatcagacaaagatctggtgttggcaacaactcagtccttccctgagggacagaggtggggtcaatatcctggcagcctgccacctcagcagctccacccattcaggtggcgcccctggtgggtctgggttgaccttggggaaaggatactcgtggttataactttccttcatggactgatgacaaggtaatagttagtaaccgcttagtacttagactcagttggagaaactgaaccttgggatggttagagcctgccctggggtaacatagcgagttagcagtagagcctggaagtggactgaggtctccatcctcccacgcagagctcttcttgcctgctcaggaatattcagcttaccccaaatacccagtgcatcataggattttattggtcttccttgctagcatagagacaaatcatttattgagcacttactggtatactgggaaatttatgggatgctttgcaaatggtgtctcactgaatctgctgaacaactccaagagtaaaataagagtctctgagtttggccgggcacggtggctcatgcctataatcccagcactttgggaggctgaggtgggtggatcatttgaggtcaggagttcaagaacagcctggccaacatggtgaaacgctgcctctactaaaaatacaaaaattagccaggcgtgatggcggtacctgtggtctcagctactggggaggctgagacaggagaatcacttgaacccgggaggtggaggttgcagtgagccgagattgcaccactgcactccagcctgggtgacagagcgagactccatctcagaaaaagaaaaaaaaaaaaaagagtctctgagtttacagatgagggccctggcattcagagaggctgaggaactcacccagcctgtcaacggcagaaccagagccaaatccaggatttgctagcttcaaagctatgttctcactcactccctaaggaggctgtgggcagaaggaaccctgggctgggaggcagcacagggcttggtatttatactagacctgttctgcctcagtttcccagtctgtaaagtggccctttgtctcaggcaatttgtgctaagacccaagagccttaagtgtgtgggatactagagggtctcccctgatgtggccccctgcccctgccttgcctggacagtttgccttcagggacgacatgccactggtgcggctggaggtggcagatgagtgggtgcggcccgagcaggcggtggtgaggtaccgcatggaaacagtgttcgcccgcagctcctgggactggatcggcttataccgggtgagaggggcagtggtggtcagcgactcagggaagaaaggggcctggaggagcagctgaacagcatggtggggtcactggcttgtccagatcttgatgccacactgggagactgctgggatcagacattatagggtcacaacactgattccacaacactgatcccccaggtgggtttccgccattgcaaggactatgtggcttatgtctgggccaaacatgaagatgtggatgggaatacctaccaggtacttaaaaggagtgggagagtcagggcaagtccttgttgcctttgggacctcagaactcaccttgggggctctcaggtggcctccctgacccccaacttaggcttatacccctgggcctaccaggtaacattcagtgaggaatcactgcccaagggccatggagacttcatcctgggctactatagtcacaaccacagcatcctcatcggcatcactgaacccttccaggtaagtaggccagactgctgggctgggggtgcctaaagacttttgtcaaatgccacagcctctacattctgctccttgagttcagacaaataacctgacctcccaagatctgccaacgagagaggcagacctcgggaggtcaggcctcagtggctgggttggggagcagggcgccccagtgaccagcatttcccccagatctcgctgccttcctcggagttggccagcagcagcacagacagctcaggcaccagctcagagggagaggatgacagcacactggagctccttgcacccaagtcccgcagccccagtcctggcaagtccaagcgacaccgcagccgcagcccgggactggccaggttccctgggcttgccctacggccctcatcccgtgaacgccgtggtgccagccgtagcccctcaccccagagccgccgcctgtcccgagtggctcctgacaggagcagtaatggcagcagccggggcagtagtgaagaggggccctctgggttgcctggcccctgggccttcccaccagctgtgcctcgaagcctgggcctgttgcccgccttgcgcctagagactgtagaccctggtggtggtggctcctggggacctgatcgggaggccctggcgcccaacagcctgtctcctagtccccagggccatcgggggctggaggaagggggcctggggccctgagggtggggtaggcagatgggccaaggtgaccaccattctgcctcaatcttttgcaagcccacctgcctctctcctgctgctcctccagctgtatctgcacctgcctctctgtcctggccaggggtggacaactggggtcccccaaaactcagtcctggcacctcaactgtgacaatcagcaaagccccacccaggcccccatctgggatgatgggagagctctggcagatgtcccaatcctggaggtcatccattaggaattaaattctccagcctca

SEQ ID NO: 6335 - DNA, 432 bp, Homo sapiens
caccccaatcctggattcagacacagacatttctgtgacatccctaacttcccacctgctacctcaggccacagcacccaggcactagggctcccctaggcaggtttttgaggcatgtattatttttgcaacacggacatacatgtacctcctcctggtactgcctggggctgctgcaataagttaccctttccccattctcatctgtatgtgaagttccctggcaaggccaaagcccagggcatcagaatgagcttcctgaacaccacatccaggcatagaagagttgtgtcatacatagctcaaggttacccagaacagcaggagatgtggtccagcatttgggccttgagatccccccattcatcctcttgattgtccacaacagcctctgccatgcttcagtctaacctacggaggggaggctgagat

SEQ ID NO: 6336 - DNA, 1271 bp, Homo sapiens
agtttccgttccaggatcttgagtacagacatatgtggttttattgcactttgctttatcatgctttgcagatattgtgttttttacaaattgaagatttttgacaatcctatgtcaagcaagtctattggtgccattgttccaacagaatgtgctcactttttgtcacattttggtaattctgaaatatttcaaaagttattattaatctgttatggtgatctgtggtctttgatgttaatattgtaattgtttgggagcacaacaaaccatgcccatgtaggttgcaaacttagttggtaaatgttgtgtgtaatagttgctacaccaaccagctgttccccaatcactctccctctccttaggcctccctattccttgagacaaaataatactgaaattaggcaaattcacaaccctataatggcttctaactgttcaagtgtaaggaagagtcacacatctttcactttaaaccaaaacctagaaaggattgagcttaataaagaaggcatgtcaaaagctgagataggccaatagctaggcctcttgttccagttagccaagttgtgaatgcaaaggaaaagtccttgaagaaaactagaactactttagcgaatacacaaatgataagatagtgtgacattctaattgctgatatggagaaagttttagtagtctggataggagatcagccacaacattctcttaagccaaagctaactctcttcaattctatgaaagcttagaggtgaggaagctgcagaagaaaagttggaacctggcagaggttggttcatgaggtttaaggaaagaagccatcctcatagcataaaagtgcaaggtggtgcagcaaatactgatgtagaagctgcagcaagttatccagaagatctagctaagattattgatgaaggtggctacactaaacaagagattttcagtgttgacaaaagggttttcttttggaagaagatgccatcttggctttgaatagctggagagaataaggaaatgactgacttcaagggacaggctatcttgttaggggctaatgcagcaggtgaccttaagtcgaagcccatgctcatttaccattctgaaaatcttagggcccttaagaattatattaaatctatcctgcctgtgctttataaatagaacaactaagcctggatgccagcacatctgtttatagcatgatttactgaagattttaagtccactgttgagacttactgctcaaaaactaaaaaaaaaaaaaaaaaaaa

SEQ ID NO: 6337 - DNA, 2450 bp, Homo sapiens
ggccgaggcaggtgggtcacaaggtcaggagattgagacaatcctggccaacatggtgaaagtccatgtctactaaaaatacaaaaattacctggatgtagtggtgcacgcctgtaatcccagctacttgggaagctgaggcaggagaatcgcttgcacccaggaggtggaggttgcaatgagctgagatcacgccgctgcactccatcctgggtgacagagcaagactctgtctccagaaaaaaaagaaaggatagattttaattgcttgatgcaagtgtggttttcctgaatctgttcattgacttgtctctgttcttacagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatggttgtttgagttttttgtgtgctgtatttctttctgttttttaatacctggttttgtacatatctaactctgttctcttttggttgttcagaaactggatttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 6338 - DNA, 466 bp, Homo sapiens
ggttaaattggcctagtgaaaataattgaattttcagagtatctctgaatgcctatctctctactatgattttttcattttactgcttatatttaagatatacagaaagcaatagtcctcacaaatcatcttccatctttctaaaatggggaggactcatattggtcagaaggaggatgatgagagcaacattttcatgttactcagatgagtgaaattcctgaggatgaattaggaattgaatggctatggaaaggggaaaatgggaccttgaaataggaatggtagtaagcacagaaagagataggatgctgaccactgctaccactagatgttcatcactgggctcccagggctcagaacagggtttggtgtatagcacatacttaggtatttgaatgaatgagtgaatgaatgaatgaatgaacgaactaataaatgctcacatgcacataacttgttaaat

SEQ ID NO: 6339 - DNA, 1782 bp, Homo sapiens
cccagcaagcacacccttttcttaatctcattagaatataaacacaaatgttatgatcttttatttaggataaatttcctcttttaaatgtttttgtttattcaaaagaaaacttcacaaagttactattactagttaaaatatatattagaagtgcctgatttttgtcagagattcttacaaacaatattaaaaacaaacttgaaaagtatctactacagaagcacttagactatcacagaaaaatacaatgaagagttaaatgtctgagataagaccagcaagcttatagttataaagaaaaacacactgtacaatgtttgggggggaaatctgttgtttatagaaaagctttacctttttcttatttatcctcagataacgttgtgaaatctgctcatcagtaaggatgatatggaaagaattctctttttctatctatggtttatttacatattaaaattttactcagtttattaagtacacatatgataccacactagatgcaaatatatatacaggctatgacagtcaatgttcaatttaatactggtcaataaagtgaatttattcaaatgtaacaacttcacttgaattttttggatcacacatatcctatataaagccatctggtttctaatattatgcacaacacattccattttaattataacattcatctacaagaaaaacaaggaaaacaattcaaaactatgttagtaattagttcttgtttggtccattgtacgcaatcaggaaagtataggacttaattagttgctatcaaattgaagcaatgaaaaaggttaaaaatcaaagtacttaaaataaaaatatggaaataaccccccctccccaatactaaagggacacaaaacaacaactactgtcccatcaagcaaaagtggaaaacaaacagagcatgtgtgtaacctcacttaccatctttttgttattctacttcaacgggtcaagaaaggtgaagagagagaaggtagaagtaagagtcagaaaaggcctaaataaaatcctcactgaaatgtttaaacatacaagcaatagagacaattaggttgaggtcagatgcagtactactatatttaatggagttaataattagggccaaattaacatggacagttattcctgaatgcaaattaactcattaaacgatttaaatttccatttttcagtctaccacattttagctaacaagacacaaaaagtataagtcaaaatactaagcacaggaattccaaaaagtaagcttctttaattcattactgaacttaagaactttaattaagaaaaataaatgataacagcaaaggtctagctgagtaggcagagtgttagatagctcagggttgtttttccaagctctagtgttcaagttaaatttatttgacacaggtatcttttgctgttttctactcgaagaataatttaacttgataggcttacaagattgcacagagtgaacagaattgagccaatagaatacagaatgacaaaccatacaagcaaatgctgctagggaattccttggcaaaaatgttttattagcatactgacaaatttgatttctatcacttggccttaaacacgaagaaagtgggcatgaagagatgtgtagttatttgtgcctatgttgcaaaataaatttatggctatacatgatatttcttcatacctcaaaaattttattgtccagtatataaaaaagccattctttaaaaacctgacactgaataaaaagtatagccttcaacttcattaaac

SEQ ID NO: 6340 - DNA, 98 bp, Homo sapiens
gagtctcactcttgcccaggctggaatgcagtggcgtgatctcggctcactgcaacctctgcctcccgggttcaagcgattctcctgcctcagcttcc

SEQ ID NO: 6341 - DNA, 1044 bp, Homo sapiens
ctgccgtgtgcacggccgtctggtctctctcccacacgtgtgcgcaacctgtcatggagatgtgagggccttgtgtgtgcttccgtgtgtgactgtgtgactgcgggtccagacccccgcctggcggtgatgtgggcccttaaatcactcttcctgctcaccccctccccagtgattcggttttactttgcagcactgtggatccgggcagctgggcggcttctcgggggtgggggatcccccaccccgcccacaagtctggccccagggttctcggaggcagggggtctctgttagtgcgctccctccagctgcaggcacatagcccgagctcacagctggcctgagtcgacgccggctggggtgaaagctccaagtgggcctctggccttcccgctgctctgggtccagagtgtctggagcatgtggcacagaccagggcccctcgtcctccgaggagggtgggacatcctctctgtctcacgcccctgggtggagattctggctggcctcctctccctgtttgccaaggtcaaagtgggccaagggtgcaggtgcttagcctggttccctctcccgggccccgaggttctgtgggtcgggcagattggagacaggactcgtgtaagggctctgctggggtgaaggatggagacagagaaaatcaagatcctttcacaagttaattctacgtctgctgagccccagcccccgacacatcaccctgaggaggtgctaggcttctctgggccccctgtgccccatccacatgttgcagagtaaatctggccccttggacctggggtccgagatggacgcctggctgcccctcctggactgcgggtgacagctggcgagacactgcggggcttgggtgcggggagatggagtggggctgagctgcatttttccagccaccccacatcccacagaaggggagtcatggtcagtgccttgagctggaaagacgggcaatgcttccggcccacaccaaccaagaaaaccaccaggggctcattcatcctctcaaagaggctaagaaaa

SEQ ID NO: 6342 - DNA, 207 bp, Homo sapiens
ggttcaagtgattctcctccctcaacctcccgagtacctgggattacaggcacctgccaccacacccggctaatttttgtatttttagtagagacggggtttcaccatgttggtcaggctggtctcgaactcctgacctcaggtgatccacccgcctcggcctcccaaagtgctgggattacaggtgtgagccactgtgcctggcca

SEQ ID NO: 6343 - DNA, 169 bp, Homo sapiens
aaaatacaaaaattatccaggcgaggtggtgcacacgtgtagtcccagttactcgggaggctgaggtgggaggatggcttgaacctgggaggtgaagattgcagtgagctgagatcacaccactgcattcagtctggataatagaacaagactctatctcaaaaaaaaa

SEQ ID NO: 6344 - DNA, 170 bp, Homo sapiens
aaaatacaaaaattatccaggcaaggtggtgcacgcgtgtagtcccagttactcgggaggctgaggtgggaggatggcttgaatctgggaggtgaagattgcagtgagctgagatcacaccactgcattcagtctggataatagaacaagactctatctcaaaaaaaaaa

SEQ ID NO: 6345 - DNA, 7734 bp, Homo sapiens
attgttcagtcactaccttagagcctgttttattttttcttaattttattgactcatttatatctcagccctttttattacaaattatttattgtttagtcactgccttagagcctgttttattttttcttaattttattaaaggataatattgatgatgaaatgtcttacgatgatcatttagaggtttattttgaacaactggcaattccaggaatgatggaataaagcatacgaagtagaaggactggaacctccagaaaaagtactttaagttacctacaggtgatcctagtcaggtatgttacagtcttaatggcttttcagaaatttgacagaaaatcactattgatctcactggatgtttacatgaattttaagcctttggttttcttttaactctgttttttacaggtatgaattgataagaaatgcctgcaccttccctccttcctatctttcccttgcctacagaaaattaaaaggcaaaacaatagacatctgcatattcttcattcagatcaaccagtggctagcatttgccaccttttgcagtttctttctctttccataagtactttcttctctgaatcatttgaaagtaagttgcaaagagcatggtgttttaccccaacacttcagcatttatctcttgtgaataatgacatgttctatgtaattacagttctaccatctaactataatacagtaatttgatgtacagcccatattcagatttacctaattgtctccaaaatgttctttatttttgttttagatccacagtttaatcaaagattaaccttgcctttggttgtcacatctctctattcttttactttggagtagttctttcaatacatgaaacattttgaaaaatctaggctctttgttttgtggagtgacccataatctagatatatctggttgcttttttcttctgactagaatagattgagcattttggcaagaatacagattaaacagtgttctcatgaatggatccagattaaacagggaataatgcctaattcagattaggcagtgttgcgtacttaccacctcacaccaggagatgtttgcgtctgtttgtcccacgattgctgatgctatgtttaataattttggttgagatagtgtcaactggacatctccttgtgagggtagcttttcccttttgttattagtcatctgtggaatgagacatcaaagcactgtgaacatcttactccccggcaaacttcacgagctggtttcagcgtcattgctgaaggctcttggaaacattgcttacacccgtggttccaatggtgatttttctcattccttttacattgattacctgcctccttgagtgaggtagatgttgtctgctccccatgttttcccttcaaatgtttaattttaatttaaatgattaatacagctaagttattctttcaacaggcaaatgaaaacagtagcctaaagtgtcagtttcaaccagaaaataacagctctgatttctcatggctcatactcgtctgaaacgactcaggtagaggctgaggaaggccgtgttgtttgtctacctgggactagtaagtatagaaatagaattcctttgttcttaaattctacctttgactttacttttaaaatataatttctttggtacgatttagctcatgcctataatcctagcattttgggaggccaaagagggagaattgcttgagcccaggagtttgagaccagactctacacacacacacacacacacacacacacacacacacacacacacacgcgcacacgaagcgggaatggtggcatgcgactgagaccccagctacctgggaggctgaggttggaggatcatttggacccaggaggtggaggctgcagtgaaccatgattgtgccactgtactccagcctgggtgacagagcaagaccctgtctcacaaaagaaaaagaagaagagatcatctattagtcttcttgatttttgttaaaatgtgttatgtgatagttgataagctttatgcatatgtcaatctgtggccatttaattttgggctaaggacttgttctattatagcacagtaatcattttactaaatagtgactatttgtcattaaaaacaatatatttagttttaatacagttgaatactcacaaatttctgggggaacttggtcaggacatttcaactgagaattgtcaggcaccttctcactgataggcatgctgctcggtggtgcagctcataagcagacaacccccttcacgtaatttagtaggaaaatgacagaaatacttgtgtaactataaagtaaagcagaattctggttattgaatcacagcacctactgaaagaagttctcaagttctgattgagttctaaaattttttgaagattggaattcttcatatgtaagtaaaaacaatttctgatgacccatttctagtccatcttctaaagaagtatttaatctgggccaggcacagtggctcacgcctgtaatcccagcactttgggaggccggggtgggtggatcatgaggtcaagagatcaagaccatcctggccaacatggtgaaaccccatctctactaaaaacacgaaagttagctgagcatggtggcgcgtgcctgtagtcccagctactcgggaggctgaggcaggagaatcacttgaacctgggaggtgggggctacagtgagctgaaattgcgccactgcactccagcctggcaacagagcaagactccatctgaaaaaaaaaaaaaaaaaaaaaaaagaagtatttagtctaagctgggcatgatggctcactcctgtaatcccagcactcttagaggccaaggtatgagggttactataaaccaggagtttgacaccagcctaggcaacaatagcaagaccccatttctacaaaaaaaaatttaaaaattagctgtgcaggaggctgagttgggaggatcacttgagcttaggagttagaggttgtagaaagctatgatcataccactgcactccaggctggatgacagtgggccctgtctctaaaacacaaaaaaaaaccaacaaaaaaagtgtttaatccataagatgaccacatttataggaggctcccggcaatcttagcctgaagccatgaaggaagacgcagtgtgaaggcaagtgcaggctggcctctggcagctgaggatcaggacaggatgtggagtgaacatccacatcaaagctttattgcttggattggaaaaaaaattcctatctgtaggtcagccttaaaatacaccatttcataaaatattgattgtctttcccatattttgagcccatgcaatttgtgctacctgagggaacagtattgtgtccttgatttggtgagatcagtagctttcttatcttattgagtgacagctacagaactcagaaacagaagctgcatattaagcaaatttatatctttcttgttataatattattgtgtataagaaatagagatggccgggtgcggtggctcacgcctgtaatctcagcactttgggaggctgaggcagatggatcacacggtcaggagtttgagaccagcctggccaacatggtgaaaccctgtctctactaaaaatacaaaaggcaataagaggttctatgtggactttgaaggtcgtctctatcaatttgaggttggaaagaacagttttgttgacatcctttagctgtgttacaagtacaattttgttttttactcaggcaaaagaaaatgtgtgtgtgtgttaaatacagtcagccctctttatctgtgggtcctgcatccttgctttctaccaacctcagatcaaaaatattccagaaaaaaaaggatggttgcatctgtactgaatatgtacaagctttttttcttgtcattctttatgcaataaagtataacaaccatttacgttgcatttccattgtattaggtattgtgggtaatctagagatgatttgaaggatattggagggtgtgtccaggctgcaggcaagtactatggcattttatgtcagggacacctacagatttttgtctccagccatggttcctgtatagtttaacatttccacacgctgagggtgtgatgggtctgagttgggttggtcccccatgtttgaggaagtgtgcccatcatgattgtacacccttgttgtaaacttcggatatgtctattttgatatttaaaacattttcaggttaagtctgaaaaatgccaagatagtaacaatattttaaaagggaattcagaagtattactataataatagaactcattattagaacattctaatagtagaaaaggaagtctatttattttataaaattgtcagttcagcttaagatctaatagtcttttccaattagcagcaacttaattgagactacctcaaaagaagaatttaacatttatttttgtagaaaaaaagcaattttaaaatagcctgggaaaacttaggtaagttttccttaatcctgactcctaatttgtggctagaagtggcaatgatatgaacataagttgtgctatttgttaatatattgcttttcataaatcaatcccttttttgtaattaggtaaaaagagaagagaaagacattcttgattttggtgactagagttgtagatgctggaagctttgccactaacattgatgaaccagatgcatgtcaccagcccatcacggtgattcttaatgccgttaagtatgaacatacagtaaaagactgttgatagaatacatcggtcttatgaaatgaaatgtgttggttaaggattttttaaacgaatttcacattacacaactggctttactaaatctgagtcttgtatttctgaacagggcaccatgggcccggcactgccacgttttccaaggaacctgccggagctcctgcggaagctgctcctcaggcgatggagtcccttcgctggtaggcccttcttcagtcaccacaggatgcctgccattcatgaacaagaaggagaggacgggctttgaataaaaaacaggtaagtttccaaactgctttttttcatcaagatttcaatcttggctgggcaaagtggctcacgcctgtaatctcagcattttgggagaccaaggcgggcagatcatgaggtcaggagatagagaccatcctggccaacatcatctcctcagcacccagctcagtcatttagacaaagaaaatatgtaagatggccgagcacggttgctcacgcctgtaatcccagcactttgggaggctgaggtgggcggatcacgaggtcaggaggtcaggagatcgagaccgtcctggctaacacggtgaaaccccatctctactaaaaatacaaaaaaaaaaaaaaattagctgggcatggtggcaggcacctctagtcccagctactcgggaggctgaggcaggagaatgacgtgaagccaggaggcggagcttgcagtgagctgagatcgtgctactgcactccagcctaggcaacagagcgagactccttctcaaaaaaaaaaagaaaagaaagaaaaagaaaacacgtaagaaatagttgccaaaataattgaatacaggatcttcaactgagattattttctttgttaggatccaggaaatatttgtgaggccatttggacttcagtgtgaaatggtgttaaaagatgaagtcatttattcaagaagtaaacctctgccacctggactgtgcgcagacatttcattgattttgtttaataaacattttctggctttgggaggtgtctctcttggtagaacacagtgtcaaagatggacaagatggacacatagtccattatttggtattgtttgtgtatgggagcagaccacaaattaatgtttggagaacaattttgtcataacacactgttgaggctcagttgtacagaactggaaaagtcttcagcttggcacatgtcctgattcagcctttgtttaacatacattccaatccggattctatcttcactggctacaaagaccacctgatacgtgcaccacgacacaggagctgctggagagggggtagtgttatcacctcaaacccacagccatatttttcaaaagccagcttagagagaggtgtactgatagctgcatagagaacatgcagtccatccattcttcccagtgatgtacatttctcaatcagtaaccacgtggtataccagccttgagtgtcacatctcccaaccataccaaatggatcacctaactggaggtggggggggccctcagaaatgagatttcgtatttactgtaaaattgccttattttttcttttgaggtggagtctcactctgttgcctgggctggagtgcaatggtgtgatcactgctcactgcaacctccgcctcctgggttcaagcagttctcctgcctcagcctcccaagtagctgcaattacaggtgcatgccaccactcccagcaaatttttatatttttagtggagacagggtttcaccatgttgaccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgttttttaattgttaagaattttctgtctagtttagatataagccctttatcagacatgtgttttgcaaatattttctcctagtctgtggcttgtattctgtctcttaacactcattttatttttacttttggaactaaagaagaagaatggtcagctttccattattcttgtaacagtaatggcagaaccaagtctgctaatgctacactgagcaaagaaagtcacctggtgaagtccaacattaatgaaatggggtagtacatgcaggcagcgttgggggtggggagggaacaaatgcttcttgagagtaatataatctgccataccatccaggaacctacaatggctatctattaccttattctctggtttgtttaatgttcgaatctttccgaaagatccttcaacctttctggaagaatctaatctgataacaccatcaaaaacacattacttcttttggcataatttaaattgtaagacatcattcacatttatcaatgttacatatataagaactcacccaccatattcttccttgaggaattacagcatgtaattctataatcatttttataatcgtctaacaattttataatggattggttgcttactatcaattttttaaaagtcatggcttctccagtcatttcttgcttatcgaaattatttcatgagatgggtctctccttgtatatttgaaaatgaggtttgcttccttctacttaaaaaacaacttgaacatacctgtttggatcacatggtcttgtcctgataacttggaagaggttgcttcagcattgttcttattgttgtggtggttattattaatattgtttcatattctgtttaaaaaattaaaattttacacaagaccaatgtcttcttttcaattccagtacatttttcagaagtaactaatgctattggctttgtgcattgtaatttcagaccattttatatgtctttagttatatgtacagtatacacacatatgtgtcatattattccattttttctagcattaaacattgctatggaaaa

SEQ ID NO: 6346 - DNA, 294 bp, Homo sapiens
gagactccacctcggaaaaaaaaaaaaaaagccagtgccaacttagaccatgactgagagctcttggtttatcttatccttgctgagctgggtgttacaacattgaagccttctgcagtgtcctccctccctttttctctctttctctctctctcctccctttcttccttttacttctcttatgataggctcgtctgtacttttttgatagaggtaaccatttgccacaccattttctgaagggcctgctctcttccccattcatttgtgatggcacatttatcctaccctaag

SEQ ID NO: 6347 - DNA, 98 bp, Homo sapiens
catattcttcattcagatcaaccagtggctagcatttgccaccttttgcagtttctttctctttccataagtactttcttctctgaatcatttgaaag

SEQ ID NO: 6348 - DNA, 407 bp, Homo sapiens
gtcccagctactcaggaggctgaggcaggagaatggtgtgaacccaggaggtggagcttgcagtgagccgagatcacgccactgcactccagcctaggtgacagagtgagactccacctcgaaaaaaaaataaataaataaaagccagtgccagcttagaccatgactgagagctcttggtttatcttatccttgccgagctgggtgttacaacattgaagccttctgcagtgtcctccctccctttttctctctttctctctctctcctccctttcttccttttacttctcttaggataggctcgtctgtacttttttgatagaggtaaccatttgccacaccattttctgaagtgcctgctctcttccccattcatttgtgatggcacatttatcctaccctaag

SEQ ID NO: 6349 - DNA, 32681 bp, Homo sapiens
aatccgtctgaacttcagttgccttacctgtaaggtaggaatgtttttcagagttcttatgagcatcaactataataatgatatagaagtgagcaatcaactataaagaggctacctgggctgggcacagtggctcacgcctgtaatcccagcactttgagaggccgaggcagatggatcacctgaggtcaggagttcaagaccagcctggccaacatggtgaaaccccgtctctactaaaaatacaaaaattagctgggcgtggtggtgagtatctgtaattccagctactcaggaagctgaggcaggagaatcgcttgaacccaggagacagaggttgaagtgagctgaaatcatgccattgcacttcagcctaggcgacaagagcaagactccatcttttaaaaaaaatttaaaaaaataaaaataaagaggctacctgtacgttactactagatatatgattactatgaagttaccatataaccgatctgtttcaaacaaatcagacttatctagtgggtaagagcaaacccatgggttttgctctcattaattcagccattgttaattaagtgcttacccagtaccatcatcatatgctagtgatgctgctgtctgctcagacctccgttttagagttcctgcagagcttgggggcagctgtggtcttaggcgtattagttgcaatgagtagaaacatagactagcttaatttataggagttttattggcaggatacagtggactttcaggtaccccgagcataggaagtaatagccacataatctggaaagttagcaggtaatggcttttccatctctttctgatttctggcctcagttcatttagatatttatggattcctcctgcagaatcacttcctctgaaaggctcttggttttttattctccatatctttggctcgtacggatctttggcttgccatggtattcgctctgaagcttactatgatcttacttctccagggtcattatcacccagttcccttagtctgtgtcttttatttgtttgtatgtatgtatgtgtgtatttatttatgatggagtctcattccgtcgcccaggctggagcgtaatggtgcaatctgtgctcactgaaacctccgcctcctgggttcaagctgtcctccctgcctcagtctcccgagtagttgggattacaggcgcccaccatcatgcctggctactttttgtatttttactagagacggggttttgccatgttggccagggtggtctcaaactcctgacctcaggcgatccacccaccttggcctcccaaagtgctgcgattatagacatgagccaccacgcccagccagtctctgtcttttaaattcaagagaaagaactggaatagttcagctaaagttgggtattcactttagtcccatcagctatggcagggttgtggagagtgtcattcagttcagagaggctgcctgggctttgtgggaaggacagagtcactgagaatgggggcttattaatatctttcaaatagtttggtggttgcaaatctccatgctttaaaatgtatacgaatttttgaacagccgagaatcattcagggctaactttaataaagagagagtcaatctaggatatgtcatatggggtcaagagaaaataatagctataacctaatgagctttagcttaatctccaaagacggcgttcagaaaggagttaaaaatcatggggtttgtttcttagcagcaccatcgaaattaaggaagggtgtaacttcatttggtaaggactttaaaatgggcatcctcacttggattttttaaattccacttaagaatcatggacttttagacttagaaggcacctgagacatgctttagttctacactcacatctttcaatagaagaaaactgagatttggttaaagggccatgtatacattgtgaaagacctaggattgggtcctgaggcctttggttctaaatccagtcacttgtttcagcagggacaattatcccagcccagtgttctttctgttgtaccttctgtgcctgcttattttaaaaataagaagaagccaaactaaacaaatgatctaaaaagtcatatcgtatagttccatttatatgaagtacaaaaccaggcaaaactcatggatgatgataagtcagaaattcccctttaaaggactggaaggattgacgggaagaggaagtatgaagtaattttctagggtgatgaaaatgttcagtgtctcgttttgagtgctggttacagggagatgcatgtgtatatttatatgatgtatatttatatatacaaacatatgtacccttaagccctctgcattttattgtatgtaaattatatctcagtttttaaaattgacctcacaaccgtgcagtcctgtctactaattgcagcagctttgccgataaggataaggatgcatctctaagcatccagagattgatggcgccacccctagaacaagaactccctgtcttgctgtaactggagcagagcattttccccagaaattatgcagatagggccagtttcttttctgaggtttgtcgtgtgtctaggcacataaaaattacatgtgaaaaattctgccatgagctgcagaagttatggaagccttgggggccataaggccaacccacttcaatccctttaggctgcgtttaattgcagtggacagaagttgaggctggctcaaaggaaaaggggaaagcattggccgaagccagtccaagttctgtcaaccgttatgacttactagctgggtgaccttgggcacttaacaaaacactgagctttagttgtgccatcttcaaatggaggtgataatcctgttctgcctaattcgtggggctgctgggaggacacaataaaataagtgaaagcacttggaaaactagttcctttacattgtcatgttctggaaatgctggctttttatgacagtagacttctgaagcatcccattctgactaggaaatggtcatgaaagcatccctctttctgaggccgatgggcttgtgggggacaggacttttactccttttcatctaagaggtttatacttaccaggctgtgagaactgacatctgtgtttgggctgaaaaattgatagcatacatgcataatagcctcgcgacagctatgctttgtacgccaggagaggcaggtggtccccattagcgaggcatgaattgtgggtgaatggctaaacctggaggatgcagaaaggtctttttcattaagagaggggcctctcctgaacttgtaggcaaggagtgtaaatatacattgaaataatccatcagccaagtgacttcccttcgtcagaccttggagagagaatgctttagttactgcttggaataccagtaagctatcagagttgcctaggataccagtcacatgggcccatcttccagacttgctcaggatgatttattttcctttattttggagagaagtgggggagggggtcagaggtacttgcaaagccttgtccttataagaggggcccttgtgtgaggatatccttacctctctccacttgagttgtcagccgcccttgcccttggcagtagggacgaaaatagcatttcctgtcccagttatcttccccattttctgatgtcgtcccacacagaggaggctttgcattgtgtcctttgaggggaaaggggtggcatcgatgagtggggaggaagcaagagagcatgtagctgggccctgctgatgctgggatcttcctaggatgactgcagaaagaagtagcctggctcctccagctaaccactcaaccaagaaaaggctgtctattcttatctgtctcggagcatatgcttctctcctcccaaggtctcaagacaggaatttgcagtaaatacattcctctaccactgagtcttcttgactcttaaactgaagtgccacattggcatatcttgctactggctgatctatggatgatagatagtttgtcccatttcttcttgctgatttaatctcaagagacaaaatcctaagcagaagttgtggtatgatctagaaaaattcaaaccaggtagtttcatgtgttactttatgcagtgtctgtcttcaaactcttcaaaacatgtaacaagagtgaaaaatgaagaaatactctttttccacctttctgattctttctccccaggcagccgtgtctgtgtttttgtctcgcagaattagagcccattgggaacgatgccaccaccgtcagacattgtcaaagtggccattgagtggccaggtgctaacgcccagctccttgaaatcgaccaggtatgctcctgaagtgagaagcagtggttcaaggaaaggcacctggggagtgcatggcagaggacatcttgagggatggggaccaccggcatcaagagtaagaacgagcaacaggaaggctaagctttgggcctggcccaccctagggaaggtcggtcaccatggcttgggagaggcttcctcttcaacaaaagctgttaggaaagaagttcattctcatgccccagcttgaccctgcttggcaggcctcttgtcagaaccttggcatgagtaggatgttgctgctgttgaaggctttctctctctctctttcagaaacggcccctggcatccattatcaaggaagtttgtgatgggtaggttgaaatggacctcgttttcaacagtggcagctccgactgaaagagcactcctacaccttgaggggagttctgggaaggatctccagttaggcaggtcctcagcatgggggtcttgggaatcattgtcttgggaaggaagtacagttgacaaccatacccctaagacgtttatacttcttaattttttccttaaagtctagcattgccctattgaggtaggatctgagacccctcctcagttctgcacacctcctattgtggtgctcatctttacaaaaggctgaggccatgattttttcaacatgacaacctaaagctttgtttccactgtattccaaataggccacccaatcccttgagcaactcttttgaaaattacttatgagcagcttctgaacaagagagtggccaagtgggatatactgtttttctcttgcataggtggtcgttgccaaacccagagtattataccctccgttatgcagatggtcctcagctgtacatcaccgaacaggttagtacagggagaggcaaaatcaatatgggccttgcttggaattaaacgacccaaggagacggcactatttatcttcactcagcatccaggtagcttccatgtgttgggtaaagagtcactctccggacagactgggaaacaccagcccttgttcttccctagtggctagaaaaaggtggcttttacttcctgagtgcccagggtgctagaggaggatcttagaaattctttgccaaggaataagcaggagaagagggcccgactgaagatcctcagttacatctactgtaaaaaagacaaaacattattgttgattcaacttgcttgtaccactttaacattttatcttagttactttttttgtttatttttcactacccagactcgcagtgacattaagaatgggacaatcttacaactggctatctccccggtaggtattctttcttccttaggagtttattcatgtcacaaacaaatatgagcacctaccatgggccagactctgttctagaaataagtactctggagataagaaagtcagtctttttgtatcaggaaatagtacaggaaaataagtctgtcttggttctcaccacctagtggggagtaaacaaatgcaatagaaggcctgtctcaagggtcttgagagaaagttgcttagggagctgtgggaactcacaaaggggaccacctaactcagcctggagatttccagaaagtcttgccagagaaggcgtcacttagctcagatgttaaaggatgagcaagaattagctagagaaataagaaaaggaaaagtattccagtcagagaaatcagcatatgccaaggcacagaggtatgctgtgtttgggaaaagcaggagtgctgggtggctggaggcttgtagcagtcattgagaagccagatattcaaggttccttgatggcctactcgtaggtttcaactctgtccagaaggaaactggggacattgaagaattttaagcaggaagatatgttatgtttagattttaagttttagaaagatcactttagtgaccatgtggaagatgggccttaagaagaaggttggtggtagtaggaacctttgaagaggctaataaggaatgttaacagcccagtgaaggcaagtggtaatggagatgaaaggatggatatgaagagtatctaggaggtaagctttatgagtatggtgatatgctagatgtggaaggaaaggggagaatggaggatgaccctgatttgtgcaagagcagcccttaaaggtcactaaggaagcaaccagaagggtagaaagaacaccaagaaggtgaagtgactgaggagctttgggcagggagagtgtcaggactgaggagagtatggtctgcaatttttaataagcagagagatttagtaaactgagagcagaaaagctgtctaatgacttgggaggttagaggacactggtgatactcacaaaaaagttatggtggggaggccaggtggccacactgaagtggtcaagtaaaagaaaggtaaaacagtgaggactttgagtctactgctgtatcaagaagcttggttttaaaagaaaacacagagaaggtgataatgcgaaggggacgtggagtcaaaaagatgtgctttttaaaagcaggtaaagcattcatgtgtttcacaaatcaaaaattttcacagagatgtagcaaaaggtctccccgcaactcctgtccccatctgcccagttccccacctttctgacccttcgtgttggttgtttctgttgcaattttttatgtgcccttaagaatgtgttcagatggaagagaggaaggttgaaggtgcaggaaagcaggtaatcaatagaacaggaccttactggaccaggagaggaaggactcaaagcccaggtagagggaatcactttgactgctaggcccatgaagaagacagccaatatggttgcacctttggttacatttgtagaagggcagccagaaaattaagggcatgatggcacttcttttcttggtgcagagagagactggttcatctgagaggaggggaggtatgaagtgatatcagccagcgtttactgaatgcctatattttgctaaatactttgtgtaattaaatcatctaatctttacagacatcccatgagataggtactcttgatagccccattctgtaggcaaggaaactgagggttagagaggttaaattacttgccacttgtcacacagctaataaagtagccaagcccgctctcagacccaggtctgtctgactctaggcccatattcctcccatcatgttcttctgcctccccctcttctcctgaactcttctcatcttaaggacttcattcttccctcctaagctctggtaatttaatatgacagtctgggagttactcacttttatggaagtgccgacacatttcacagacctcttgcacagtgtagttgactttcccagaagcacatctctctggagcgggaggcagcagcccagaaatgctgtctcaggaggaaaattgacatttggagttggaggtttctaagtgggatgcagaccagtgctcttcagattgttctatgctatgaccttttcccgtggcgcacattttctccactgtagagatagcgagggcttctgtattgcagagagcactgtgctttgaagggccagctttgtaatagtaaaagaggagaggcaaaggggagagggccagcaggcctgactccttggcggcagcaggaattgggctccagtcacttgcttaacactgagaaaaaggaaagaagacaggtgtgtttttgttcttaagtctcttgctttctagtggagaacattaaattaacacccaaaaaacagagaatgatgaaacaataaattgtgaggcactatgtagtaatgagctcagcggaaggaaagcccagtgaatactagaggagggattttagccgcagcttgcagaaaaggaggcaggcatcctgctaggaaaagttcatgtgctaggaggaggttttgtcttcaccagccttcattttcaaaaaacaattgggaaattgtttctggctccttgatgttcttaaagtttccccagaactgtcactttgaggaacaatcatatggattctaagagaaagtttttaaaaaattgccaggcttttcacattttaggattaaaagggaccttagaggacatcagattaaattcttcacccaatgcaagaatcccttctacagcgtctttgacaggtggttgtccagattctccttgattgcttctgctgacagggagcttaatacctcaagagaaacctcttctgctgtctaacagttttataaattttattttattttattttattttttttgagatggagtctcactctgttgcccaggctggagtgcagtggcatgatcttggctcactgcagcctccacctcctgggttcaagcaattttcctgcctcagcctcctgagtagctgggattacaggcgcatgccaccatgcccagctaatttttgtgtttttagtagagacggggtttcatcatgttggtcaggttggtctcgaactcctgacctcgtgatctgcccgccttggcctcccaaagtgctgggattacaggtgtaagccactgtacctgaccaattttattttcttttttatttttgagagagagtcttgctctgttacccgggctgcagtgcagtggtgcagtcctagctcactgcaaccttgaattcctgggctcaagcagtcttcccacctcagcctcctgagtagctaggactacaggtgtgcaccaccacacctggctcattttaaaaaattttttgggagtcagggtgtcactctgttggccaggctggtgtctaactcctggcttcaagcaatcctgccttggcctttcaaagccttgggattacatgcatgagccacgcacccagcaagacagcttaaatagaaaaccttcctctattaaaccagtatctgtttctctgtgacttaccatcgttagtgggcctcccagatgcctccagtattcccttggtaggaattttttaaatccataggccaaagcggtacagaaaagatgcagataactacagattggttttggcatactaataactccctgattgattccacaaacatttatttagcaactcctaagctgtgtgaaaaaactagttctgcctcaggtttggatgtccacagaagggcctctgtgagctatccacagagtagtaacctgctccaaggagcagatggcacatatcttgtccctggcctcctagtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccagtgagtatgactaaggtctcgttccaaggacttcgacgatttactacatcccacagggcatcctagtctcatttcccttgagtcaaataaggagtttattgaataccacctgtgtgcagagcagtgtgccaagcactagagtccataccaagatatataattccatattgtgattctaaatcgtgtagtctatttgggctctcacaaattaaataacagtacaaaacagtactgtgccaagtgagcagtgaaaataggggctagagaagtcaggaggagagcagtcacgtcgtgacagacctgttaattgctggaaatgtttggtttgatgagggttagtgagcagatggtccagtatctcccaggtgtctgtttgtaatcatcccctgctcctccctcttcagtcacctcccagcccatacacacacacacacacacacacacacgccttcctttgtgtttaccacaggtgtcaacctacccattcaccatctccctgccacacttttgcacagggaggaggagaccagaactttgtgatacccacaagcatcttcatcataccccagagttcacatgcatgcggtgggcagctgtgccttgtgagcagcagtcagtaaacaggtgcttggagcctaacctgccaaagagggagtcagaaatcttctcagcccatagatcaactattgaaattgttagccaaatcgagtaactaatcatagatatttgttttacatattggatcttccagctgtattgaagtcctgaagccttcagctgccatcagcactgacatagttctacagtctcccaagggtacagggttagactggccttagtttcactctcttcagcctgaggataataatagctaccttgcagtattattgtgagaagtattgttaatgagaatgtgtctgaacatgctttgtaaataggaatatcatctgttaattctagagcactgtacagatgtataaaggattaaatgtataaggagaagagaaaaaagagaaaacattttaatccttattctctaccagcactagaataagagctttgcatacatcatcatcttgtcgtctccacaaccctgtgaggttaacgctgtgagactaacttgattttacagaggaagaaattgaattttgaaaagataaaatttgcttggttagtaaggtggacaggaactgaacccatctcttgcactctactgcctcttggcccaaaggttaacatggcacttacacttccttaggttctcccaacaggtgttggagtttgacaaaggtccaatgtcttctttggtcttgggaaatagataagtgattctgtgtccctgggatgaagcatatggagaaggaagatctaattacccagcaacatttttttttttttttttttttgcagcgatagatacctgggctgaatctgctctacactggctaggtgtgcacacaggcacttacagttacagttgcatcgactgatttcccatggggtgttcacattaaaattcatcttttttgtggctgccctcacacctgtgtttcccgatctgaatctttgtctattttgtgtgtgtgttgcacgtgtctcagctacagtgagatgctggcattcaccctgactgccttcctagagctcatggaccatggcattgtctcctgggacatggtttcaatcacctttattaagcaggtgaggcctccaacattctgtctttctctcctccctcagctgccagttcacaaggcttaaggggagatacaggcaatatcgccattctggtgagatcagctttatattccctggggccagatttttcatcctcaagctctagtcttctgtggcttctgaaagatttgcattttgttatattctcagggcctgcactgagatggaactggaccgtcagaactaaatatgatcaaagtagaattagattgtcagtgagactggggataaagccagccagtcaaccagtactagccctgagtcttttgaccgacttcctgagctctctcttctttttgtatatatataaaaaaaatttgcatttcatttgtaaatttgccttctatttacaaatctgcaaggtagcctgtttggattgtcagactaagttcagtgggtaggagagggtacttctggttttaccctcctttcttttacacaaaggagcagtgtcaattcagaatactgaactaaaaccaatgaataatattgtatctgctgccctagaacttcagctatcattggcttaggacattgggactccccgacactggacacaagtgaaatgaccatgtgtcaaggatattataatggggactgagaagaaggattagagtaaaaggcttcaaggtcctttctacctctcaaagtctaagtgtgtttagggggagtgtgtgtcaggggaggtacatggagataaaatgagatcccagtatcagtaaaatcctctgcttttttataccccactttctcaaactggaacccttattttgataaaaagaattaagcttttagattttgaggaaacacaattaagtggatactataatctgagattaaggtatccatgccaagggaatccctggcacattggccagggtagccgtaaaccagataccactatccacctagcaacagctgcccaaatgtgaagcagagagagcttcaagggctagcatcagatgctaagcttctatctttcttgggccctgagcttctcaattgatgtgccatctctgggtctagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtgtgagtaaaaaaccctacacctccctcccttcacttgtctgtcctcttttctcctcttattttaagtcttccaatcctactctcctttgcttatattccaagctgttggttggcttcttcattcatcacctcttccacactcctgccagaatttctcccatcattcagacttgatcatgtcatgctcctgcccaaaatcctctgtaactctctctgccccttaggttaaaatgaagattttcccagtcttcccataccagggtggtaccaggcaaaattagatgctttctcacatgggcccagtagtctctgtacctatgataattatataaaatactggatttttattatctgttgcccattttgaacatagagcccccttgaaacagagaccaatcattgttgtatcccctgttttgatttaagtagaggctcaattagtgcttgttgaatgaatgctcactgaaccgacgatgcactgtgggtgatttgtaagaaatatcacacaggtgtgagtttggaatatcagttcaaatccaggctcttctgcatactaggtctctgccatcagcaagtaacctagtctcttctggcctcagtttcttcatctctagaataggttaatcaccttcacctctcacactgtgaggatcaaaggagattttaaaaaggtccagcatagaggccaacctgggttaggtattcagtaaattcaggggcttttttcctttgtttgtttgttaagactcttatcacatcctaaaacattttaccagatactgagaccatatgacaaatgaacccattggagcaatgtttctcccgtctccgctgtttttacctcacttccaaccaacctacaccatgtaaggaagctggactttgcaaaacagtggtggcactcctgttgattctcttctgactgttgttcacttctgttttttagacattgtcagaatgttgccagaatcccccaccagttcgaggggaagtcatagctcccagatttgggagtttatagtggccctgtcttcactcagctatgctcccaacttgtttttccccactaatccaagtaaaaagaaagcacaattatttctttgcaactctgatttctccttgtcacttttaaggaattttcagcctcagctttctttgcttttcttttttgagacagggtctcactctgccgtccaagctggagcgcagtggcatgatcataactcactgcaggctcaagcgatcctccccatctcagcctcccgagtagctggaatcacaggcacactccacaacacctggctagttttttttttttttttatttttgtagagacagggtctcgctgtgttgtccaggctggtctcaaactgttgggctcaagcagtcctcccaccccagcctcctgagtagctgggactacaggtgtgagtcaccatgcctggtctagcctcagctttcatacccagcgagccaccaaggttgattaaggtgagagggacattataaactccagatagagaattctgattttcctgtaacctcacatctacttctctggtttttttttttgtctctgaattcagagtggccccagttgcctccctagggatgataggggaacatggcatttcataggagccaatactttcagcccacagctgtcaccagaacttatatgctttcctttttgggctgagggatacttagtgccctctgttagactccctgggtaccatgtgactaaccaggaagcccatcagaccctctggaaagacagccacagaatgcacccaagacatggcaggtggagatgtcaagtaccaggattgtaagattccagagaatgattgtagttattttgtttgttcataataaaataagtttatagtcaaagactttaaaaatacagaaaaacgcaaaattatttgcccattatctcacctccagacatacccactgttaaacattaaattgaatgtcccttcagtatttttatgcatatttttaacaaaatcgggatctcattatatatactatgtgtaccttgattttttttaactgaataatacaccttgaacatttctccatgtcaaagatttttctaaaagggtagttctaagtcttttttgcaacctagacacctttgaaaatctggtaacaagtatatactctcaccagtttggaaaaaataccacttagttggcaaactacatagaataatttctgtatcattcctggggttcacaaatactctaagctcatccctgaatcccaggttaagaatctttaccctaaaacatgacttttaataactacttaagattctcatatgtataaatgttggctaatgtgaccatttggattactttccattcttttttaagtagtactttaatgaaacgccttgtcagtaaatcttgcatagctctctgattactgtcttaggataaattcctattagtgaaattgctgggtcaagagcatgcccactttgaatgcttttgagactgagctccagatcattatttgcttataatctgtgagtgattgttttaaaccatttctaagcatcatcttgctgttcagtcttctaatctccctctctcttctttctccattgacacagctccaaccaggagattcagacctacgccattgcactgattaatgcactttttctgaaggctcctgaggacaaacgacaggtctgtggctgccttttcacatttttcatctgggctcttctgagataattctcaccccatgcactctttgctatgcagagagcacaaatccagcaattttcccaagagttcttcctcttagctgtctggtctggagcccaggagggtggctttgctaaggaagacccagggaagacctatgaggggaaaccagctgggtcttagatgagagcagggcccttcaaactttttcctctaaagggccagagaataaatatgtttgactttatgggccatatggtctatgtgatagctactcaaccttgccattgtagccaaaagcagcctcggccagtaggtaaatgaatgggtatggctgtcttccaataaaatcttatttacaaaaacaggcaacaggcctaatatggccatagtttgccaactcctgggttacagaatcaagaataaggaagaggagaccctgtggctaccctgagtccaaggagtccaatatgaatgggatttcacactaaatcttaggtttaaaggttctctgatggagattctaaacatcttccttcccctgttcattaactgtgacattatgcagatagctctgcctctgtgaaccttagtttcctcacctgtcacatgggagcaacaacatctgccttgtttacctcacaaggatgtctgaggaaaaacaagatccctgtttcacaaataaggaaactaagaatcagctgggtggtggaacaaacactgacctaagagccgaggggcctgggactaagtattctccctgctgctggctggacaagtgtttgtaacctctttttgggtctcagtttctctttctgtaaaatgaaagggccagtttaaatgatctctgacagcccttccaatactaacattctagatttctctgagaaaagcccaagtggtgttaaaagtaagacattttagttctctgacaatctcatgggctcagtaagatgaaattcaagtgggatcatgtatgtacccagctcttggtagattctagagggaagaccagaagcatctgtggttctgtctgtccttgtctttcttggatggcttggctctgttaatctgccttcccggtccttgtttgaatgtaagctgaaagctcattccgtctgcttctctctgtgcttttgctttctgccggcaggacaagcaccttaatcctctagacctgcctgtcactgtaagtagcactgccatgtggaaagggccccagctcttgcaggtggggaagtcaaagctaggcaagaatctcatggtctgatctagatgttcagggcatgccaagacccagggaaaggttgtgtgctgtgaatctcctttgtcaggacacttagggaagtactgcagattagagtcacagaaaggattaagggggtacctgccccagggagtgtggccccagccttcctttataacttgcctttgcatgggtctgtagttcaactagggcagaccagactcagaaacagctcgtaactttgatctagacaataccatggatgcgtcaccttcttacttgctttagtggaagagaaaaggtatccgtgccctttttggactcttactagaccgtgggaatccgaaaaggtttagacaatcgacaaaagggaatttggatgctcatttcttcattatagggagctttagagaggtcagctttgcgaggagatgaaaggggataagtgcctccccctgacaccacagagaagcttttggtctaagacctttatattctagctgcagaccactgtcaattacccaccttatgagttgtccacagcaagatttaatctcagtcgacctcctatagttaccagagaagtttctaggccactgtcctcctctgctagccagtatgtattcagagaatgcaaagtaaaatttaatgttcctggcagcattagccatttggaatatggctagaaatccagaagtgtgacagaggggcctttcagctctgagaaaaatgacacagagctcacagatactactccataggagaggtgtgacagctccctcaggcccactgatttaggattctctataaaattaaatgaaggcagcagtttagaaaatgaagtcatggtaattaacatcagtaagaagtgatggtcgacactggaaggaggagacaagaattatgaaaagctgtcagaaaaattaaaggcattgtaatctgggaccattttgtttatgggaaaatagcttcacatctcagtagctcctcagggtatcacagtgtcacaacacagaataatcactgatgttctttttgatgaagccgactccttagcagtgattaaattatcactgtagtcacttcagaaataaatgtatataatatgtctttaaaagatttgcataagaatggtcaaaataatgattctgagagaacccttaaagctttgctccctggaagattcatttatgtaggaaacttgatttcctgggtgggctaaataaataaagcataactatcaaagtctggatcaaatattataaaaaaggtgagcctgttataaaaaattacccaaaacaccagactcattgttctctaagccagttagaacggaatcctagactacttactgttgtagagcgtccagaccccagccgtctgctgtagggtgggagggggttgctggaccaaagcccttccttgtttggagtcagtgcttcactagagttccttctagccttagcagtggggtctacctggcacgatgcatgtggcttagaaaccatcacactgctctgtgtccatgtgcaatgtccttgtgacacaagcgtctcatcttcaagcagtcctcatctctctttgaagacagtggagttgattgtgccattaggaaaggaaatcctatttgaattaatttgcactcacaaaaatagggaatgttgcagagtgtaaaatacatctgatggtcagtggattttcgttcattcacccacttttcatttgggaggaaaaaaatttaagaaagcaaaaaaggcccagaattttgacatcaccttcctctcgatagtagtcacaggtgtgtgcctgccaccctgccttatatttgcttattttcctccacaggatatggcaaatgcatttgcacagaagcatctccggtctataatcctgaatgtgagttcctggaacatgctgtattttattactattaacaacaattattactgttattgttaatatattattattgaaattattaatgagtgaggaggacacacagaggaaccttatcaataggtaaatacctcttgaactgaatagctttttcccgcgatcctctgtgagcagagttgcctctaggcagccatctcaccagcaattgcagtgcgtccagggagggaccaaggccagctctactgtttgttgccctgcaactccagaatttttatccagagggaatatgttaaaataggcacaaagggggaaaataactcatccaactgacactgattaaaaatctgaattgtgtagggcactgacagaactaagtaagcaagtgtatttgctctcaaagaccttctggcctggtaggaaagactagtgatcatagtggggtgtgatctgggtttgtggtctaggaaaggatggaggaggaacagtgatttctgccttgaagaagagtgtttccggaaacttttagaggaatgtcttcaggtgacccttagaggatgagtaggcagaccgggaataacaggaatttcagtcagagggcagccagaacccagaaggagtgtgtgattaggcacagagcaaggagcaagtagatgaggaggctagagaggtagcgaggaccagatcaggaaaggttagtctcattcctaaggacagctgagggcatttaattgagcttgtgaagtaaccagatttgcattttagaaagagcacatgaaagacatgtgtttgctaaggggtacctgagggaggagagcagagcaggagctggcagggggatctggaaagaggtataaatccctgttaccacctgtggggtggagtagggctgatgttgggaggtggggccggtgggagtggaggaggagagccaaggatctgaattaaaaggaggcaactttggccggacgtggtggctcacacctgtaatcccagcattttgggaggctgaggcgggtggattgcctgaggtcaggagttcgagaccagcctgaccgacatggtgaaaccttgtctttactaaaaatacaaaaattagccgggcgtggtgataggcgcctgtaatcccagctactcaggaggctgaggcaggagaattgcttgaaacccgggaggtggaggttgcagtgagccgagaccaggccattgcgctctagcctggacaacaagagcgaaactctgtctcaaaaaaaaaggaggcaactttatcaactgtcagaaacaagggaaacctgggagaccacagtgaagggaataaaatgaaaaattagaagtcaagtttaagacttaagctaaacatggactttggagtctgccattttccaatctttgatcttgagcatttcacataacttctctggacttcagtttgctcatctggatatgaggactaagtgagctaatataatactgtgcttagcagggtgtctggcactcagtaagcactttgctcgtattggcagaacaggatgcagaggtgataggattgaagaagtaagctctgagcacttgtgaagctgagcagtcagctgctctaaaatgcagagtctgccagacttcaccttgcagaaccagcttctccctgctggctgcttccctggtcacacccagctaccagcctggcaggaggggccccaagcccacaagtgacaggagtacacaggttcccacacattcctgcctacactcctgagcagctgtcctggtcaccctcttctgcatgtgtggggatgagtgcgcccttctgaaggaaatttaattatgtttgagacttactatttaatcgggttagaagttcaactcatttctggacaaaccttgtgaacaagtaaagatttcactatagaaggcagttcagcatcaggactcaggacttaagtggcctggcaggaaatggctaatgcatggtcactgaagtccagggatttcactgagtcaagccagagaactaagaccctgagatacttgacagtcaagtgagacttcaggtaaaacctcaaactgtcactcatcagactggagctgtacttctttaagccattgatgctaggataattaattaccttcctgccctgatgtttcttaagttggagaaagagaattaaagagaatgaaaatcagaatcacattaacttccacctctattcaaagctgttttataaattagggagaagagtgaggagagaggaataggatagacgaaggtagagagagggagcagtggagaagaaaacctcagagtgaggcaaaggaagaggtgtgaaggggaaaagaagtggcgatggcagggaagagcccctggccatgagagagactggggggagtgggaaggaagggaagttatggggcagggggcacagagcagagaacaagagagtaaggctagagagatgaaagaaacagtgagactgagctaagaagagcgatctcacgcttaagagacagagggcgtgcctgtgacagggcgggagctacaggactggacatgatcaccgattcagggggagggagggatgcaggcagaggcctaactccagcatgttagcatgtgctatggaagtgctgtccacaatggtggccaccagtcatgtgtagtactttaaataagtctgttgtggctgaggacctaatttgtaattttaatttcattttaaatttaaatatccgtatgtggctcatggctgctgtattaggaagtgtagatctagagaaacagctagaaaaaggagagagcactggagtcacagtaggggaagaggtctagagcaggaccgtccagtggacatagaacccaaaccatgcacatgattttaaacattttagtagcagcatgaaaaaggaatagggacattaagttcaataatatattttattcagcccatgatatcgaaaacgttaccatttcaacaagtaataaatatgaaatattattaataagacattttacattttcttttttcctactaaggcttcaagatccggtatgcatttacactcacagcacctctcagtttggcctaacatttcatgggcctgggggctaccaaactggacctcacaggtctaaagagattgatctagagtcagagcaaactctagggagagctgatccaaagttagaaggagctttaaaaagatactgagtcagatacctctctaaagtcagagcgctctagagcattgctattcagtagaactctgttaatggaagtgttccgtatctgcattgctgtagccgctagccacggtgactactaagcacttaaaatgtggctggtgcaactaaggaaccaaattttcaacttaaatttgttttaactgatttaaatgcaaatagctgcatatggctagtggctgctatactggacagcacagccctagagacagagctactgagtagggaaattgaaggacatagtggtggtacatgtggaaaatggaggagagcctcatttgggcaagaaagaaccaagagggacaggattcataatggtgggtgagacagagggagtgacaaatacaagggagcaagaagggaagcaggatattgtgggagtgaggacaggatggtgagagacaggaatgtaatcaagggttgatcagctaggacagaccgagggagacatagcatgcaagagaaagacagagacagaacatgagacaggaccaggggacctaaagtggggtgtgggcatcagagggacaaaggaggaggtgatgaaccgacaggggaatgtgggggcacagagacagtggggagggagagtcaggagggagagggacatggtgtgggcggcacagggagcagggacagagtgataggagagaggagaggacaagtgagaggaaggaaggaaggagagggccgtgggagggagctggtaggagagtgaactgttcctcctttgtgttgctatctcagtatcattgaaagaaaatggcctttcccaaagcctctctgctgggtgaagccatccaaaacattttatttttctaagggaaaaacaactctgcctccatgcacaccatctattgttttgcatttagtaggcctgtgaaatgcctgattggaggaaggtccagcccccaatgttctgtatcatagccttgatggagtagcctcccccatttctggtgtggttgggtatagcccctgccttcactctgcttcccctgcccaggggaatgcagaggaagggatggcgcctttcaggcctgcagtgagtcatctctgcctgaaccaagcccattcatgctccatcgccttctagaatatgaagtcctcgtgtgtgggaggaaagctctgttcccttcccaacatacattccttttccttagcatggatgtggcccttcattaaaagagatcagttcagtcccctgctccctgcctgtgctttttctagcatgtgatccgagggaaccgccccatcaaaactgagatggcccatcagctatatgtccttcaagtcctaacctttaaccttctggaagaaaggatgatgaccaagatggaccccaatgaccaggtaggtgctaagtggggcagctgttttctcatggctgtggtgcagtccagccttagtctatgtgccaggcactgtgcttggtctttgtctgcagaagtagtttgcatctgccctagaaaatctagcatgatctgcaccatgagccaagcccatttctgtcctgctgtggtagaggtgatgcctcctaagggattgattggggccaaagtttggcccagaaaagcctgacccactgtttcttttccttgctcccttggttagccgattcacctgctgactgtctgtttcacctcgcaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccgtaagtacctcagagcatagacggtggtaggccctctcccctgatgggaagtcaatggtcccacccagacagagctctgacaaccaaccccatggtggccctggaatagatgacagttaggaagctggtggagctttaatgcttgctttgctttgttgatggtgagtctgtgagtttatgtgcaaagtttggccctgtgaaacgaatccatctgtaggggggttgcggtcagctagagtgggtagagaggggacctgtcctcttacccaaactgctaggttctttgcaaagctagtgtgaatattttgtgatagagtagggcttgaggatggggttaactggaagaagtatttcttgcgtacctactcagtgtgcagcagcatgtgaagtaggttctgggatgcatggtgaggcagccaccgtccagcactcaagagctcacagttcagtggtggtgatgggtgtgaaaagagctaggacagaggtgggtgctgagtggtagcagcatcaagaggagaggcgagagggcatcccctcaggtccctgcatacacggagactgccgcatctcaaattgggtgtctttatttctctagaaccacatcaatccagccatggactttacccagactcctcctggaatgctggccttggacaacatgctgtacttggctaaagtccaccaggacacctacatccgggtaaaggcaggggagctggccttctcagtcctggtgccacatctcctgccttcctccttcatctccctaatcctccctttctcttcccccgacagattgtcttggagaacagtagccgggaagacaaacatgaatgcccctttggccgcagtgccattgagctcaccaaaatgctctgtgaaatcctgcaggttggggaactacgtaagtctctgcagctccctcttcttcagccattccttgtcatcaagagctcagtgagactcaaaattataaacagttacatgtcagtggggtcgggcgtggtggttcacacctgtaatctcagcactttgggagactgaggcaggaggatcacttgagcccaggagtccaaaaccagtctgggcaacatagtgagaccccatctctaaaaaaaaaaaaaaaaaaaaaaaaaaccaaaaattagccaactggtagtgcatgcctctggtcccaactactcaggaagctgaggcaggaggatcactgtgtcaggaggtcaaggctatggtgagcatagtcatgccactgcattccagcctgggcgacagagtgagactctatcttaaaaaaaaaaaaaaaaaaaagatgtcagtgggactagacaaccttaggtgggtttttaattttgttttttgttttaaatcactgcatcagctgataattccatcttatccttatttatgggaatcatggttgttgctttgtttgaactggcaatttgaatcatattccaaagctaccccatgcctgtgggtaagggctggctgagtctgtaacagggtagagggaaggcaagaaaatgcaccctggagaagaaagctaaggacgtgagaaacgcccatcccacgctccctgttaattgcgcgccttaggctgcttttgttcctcgggactttggtgcaaagtttccagacatgagctcccaggcccttgtggacagaggcttcatcttctccctgttttttcacttccacagcaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacaccatccagtgacaaacatttttgttttcctctagtcttttttatcccctacaggtttttccttcattagcaagatcatactgcgcatgcagtgtggtatcctgttgttttctttaatagttgttttaaggggaccaatgcatttttttaaaacaccacagcgtgccagaactgcgcttgcctttctattcttttgtttgtttttttgagacagagtttcactcttgtcacccaggctggagtgcagtggcactgtctcggctcactgcaacctccacctccgaggttgaagtgatccttctacttcagcctcctgagtagctgggactacaggcgtgagccaccacacctggctaatttttgtatttttagtagagacggggtttcaccatgttggccaggctggtctcaaactcctgacctcaggtgatccgcctgcctcagcctcccaaagcatgagctactgcaaccggctggtatctcatattctttatggcaacacctatcaggagatgtgtcttcctttctctcggtttagagatgagtagatgcacacctaaggatgttaagtgacttgctgaagggacagagtcaagatgtgaacccatttctttctgactacaaaaatccatgctcatttcccccacaccattgaccaattgaaatatatgggaaataaagcatctatcagtgtcagtcatgtgacctgaataaccatctaagaaggtataccttactcacccagcagatgtctgtagtgcctgccctgctcaagaccctggggcaggaaagagccttggtgctccataataggcctgtccatttctcaagagtagtggtgtgagttggctgggttcttctcctcttaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtgtaagttccatctcaggggaggctggcgggggaggtggctgccagctctgctttccttccagagctccactgtccccatgaccttccgctcactccagtgtgtgtccaccccagggagctgagggagaagatccagcccgagatccttgagctgatcaagcagcagcgcctgaaccggctctgtgagggcagcagcttccgaaagattgggaaccgccgaaggcaaggtgagaggagacggggcaatccttggtgccgggaagagcctgcctggatggccccttttgtgcccaggcctttcccagtactgtcgttgctcacctgtttggcttcccttgtgttccagaacggttctggtactgccggttggcactgaaccacaaggtccttcactatggtgacttggatgacaacccacaaggggaggtgacatttgaatccctgcaggagaaaagtaggttcatttctctgttgatgtgtcatggttgctggacttgtcaggagacaggagttctagtccagctgtttgtagctgatcatctgggcttgtacctgttacctctctggacctgtttccttatctgtcagcgatttcctctacctggcctactcggtggggtggtttggagaaacaatgagttcacaggtgtgaatgtattgtgtagactgtaaagggtggtacatgactaagtcgaaaggcagtagttaagaggagaagctgtgaagccagactgcccacattcaaatcctggctttgctcctaattaacttgaattctaattaattgcaagttctcccctctgccttggtttcttctcctgtaaagtgggaataatagccacactttcctcctaagaggattgcatgagtaatgtatgcaaagcacttagaagagtggttggcaggtagtcagcataactgttagcagctgccactgctgttggcgatgatggcatcatcatcgccattattgtgaaggagaggggaagggagtcaccaaggtcccgttccttggggatataaatccaagagccctgaagtgaccctcagttagctttgacacagcctcactgggctgtggtctacaggagtgaccaagacggagggaacagtacaaggccatcctccccaccaccctcactgagctcatacagcagcccttggagtttggggctgaggcttcctatgcatctgccccagtacctcccttccagcactgatgtaggcactgaccagcttgcagcatgaacttccagagactaattcccatcatttatcagttcctgttgcagacattaaggccattgtcactgggaaagattgtccccacatgaaagagaaaagtgctctgaaacagaacaaggtgagtagagaggccagtttgagtagctggcccagtgatacttggagagtgccattggtggtggttttttccaggtgcattcttggcatcttcccctctctattcctgaatgttttattaagaattttgaacatacacaaaaatagatggaacctctgtatacacatcacccagactcagcaaccatggccagttctgcccatccacttgtttctctcctttatcgctttgaagaaagtcccaagtatcacactgtttcatctgtaaatatttagtgtacatcgtatagtgtataacattgccaccagtccattagcacacataacaggaaatgaaagtagttatttcagatcaaatattccactgatggtgactttctaccaattgtcttataaatgtcataatttctctacagatatataaatgtttatatggatacacacacacacacacacacacacacacacacacacacacacacccccatacccatcttgtctaaaccagagtctaagactggtcttttaagtttcttaattcataagttcccccgcccccccatcccccaccatcttttcctttgcagtttattagctgaagaaccagattgcttgtttggtagtttcctagcatctgaattttgctgattgtttccccgtggtacagtttaacttgttcctctgtcccagatctgtacattggaagagggatctagaggtttgatccagttcaggtttaacttttttcctggccagtgtcatcagtggtattatgttctatcaagaggcacataacgtctggtggtctctccttttgtgataattagcagactgttgaagctcagtgcctcattccatcagtcaactaaggtttgcaaactcatgatattttgatgcagtcattgcttttcatttatgagctgaaccatgaaacttgcccttatctactattggtttcccagtggtacagtttatataggaaacgagaataaatgctgattcttcttttatgtacttactttcaaaataatgagttagttccttggtatcatgcaacagtgaccaattttgtgtgtgtgtgtgttttgttttgttttttaattgttaagacattcctatgccaaatacagcacgatagaagttgttagtcatcttggtaatataaaaacttttaggataacttacagtcatggatcgtgaccttccagggttctgagtgttgaaaatgacttttttccaatcttaaaaatatcacaacatctttgatgtgacttgggcagggagtgggtaagttaaggttgatttatgctgggcctcatctccagccacacttgtggccgcctaggagcattgatgacattcatctgaatcagcatgtttggtgatgatgccgagtcactaggactttggccaagatcttgatgtgcagaccccaggctgttccatcgctctaatttaaaccctttctccttcaggaggtgttggaattggccttctccatcctgtatgaccctgatgagaccttaaacttcatcgcacctaataaatatgaggtgagcagtgtggcgctgccttagacaacagagctatttctgtaactcttcagttggtggcaggaatgagcaaaacaggaaagtcccctgtggtgggtggctgcagtgtatattgaagcctaggaaggctttgagaagaaggtggcatttcaataggatgggaatgtctcaaaggaggagctgtggttgggggggcacccagatgaagcagcaggtatcattacataatgctggacctgaggttcctccaggcgcattgggtggctgccaaggatctgtcacactctggattgtttatctgtgagctgggctctccacattactcttcagcagcagccataggttgtcattacaaagataaggtcaactaggaatgagtcatttacctgggactgggaaaattctccccttttcagtttctctgtggtcagctacccaagagaacttgacagatccttcctcctaggggctcctggtcacatgttgtaatggatccagtgtggactttgaagccagatggaactggtccttctgacaagggccctgtagttccatctgcagcactggaagatactagatattaaatgagtgattgcatttgagaccctatgtgcctggtgagctctgagagccatcactgggaactagaggtgggacttctggcagaggagacacttgggcagggcctgagctgccgctagtggaatttggttgagaggaaatgaagaacaagcaagtggggaaccaggtgagcaacggtgtggaaaaaggaaaatggcagcagaggaagcaggaagagtcagggagcggtgggatcagaaggcttcctggtcaccccctcttagcatgagacccaccagttccatttctttagtatttactctttaatatgtattgactggattatttttaattttgttttcgggggggcggggcacaaaattgagatcccacagtgacttctgtttgtgtcttgcttcttttcacctaatacatatttcccttctctcgcttctgattttgggtaacttcaggtagatgatgccccagtactcagatctcattttgctgtattcgtttattgcatttttaggttctccttcatattattgtaaggagttgtaatataaaaccccttataaaaaccagatctcttgagaaagtgaaggatcacctcctaatttatctttgctatcattccaaatcagttttgcctatactgattagttccaaaaggaactgttgtgagccccatcagaaaagagaccttggcaggatctcctgctgaccaggggtcacgatgtgacattttgcaacttgctccccacagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaa

SEQ ID NO: 6350 - DNA, 28482 bp, Homo sapiens
aggcagccgtgtctgtgtttttgtctcgcagaattagagcccattgggaacgatgccaccaccgtcagacattgtcaaagtggccattgagtggccaggtgctaacgcccagctccttgaaatcgaccaggtatgctcctgaagtgagaagcagtggttcaaggaaaggcacctggggagtgcatggcagaggacatcttgagggatggggaccaccggcatcaagagtaagaacgagcaacaggaaggctaagctttgggcctggcccaccctagggaaggtcggtcaccatggcttgggagaggcttcctcttcaacaaaagctgttaggaaagaagttcattctcatgccccagcttgaccctgcttggcaggcctcttgtcagaaccttggcatgagtaggatgttgctgctgttgaaggctttctctctctctctttcagaaacggcccctggcatccattatcaaggaagtttgtgatgggtaggttgaaatggacctcgttttcaacagtggcagctccgactgaaagagcactcctacaccttgaggggagttctgggaaggatctccagttaggcaggtcctcagcatgggggtcttgggaatcattgtcttgggaaggaagtacagttgacaaccatacccctaagacgtttatacttcttaattttttccttaaagtctagcattgccctattgaggtaggatctgagacccctcctcagttctgcacacctcctattgtggtgctcatctttacaaaaggctgaggccatgattttttcaacatgacaacctaaagctttgtttccactgtattccaaataggccacccaatcccttgagcaactcttttgaaaattacttatgagcagcttctgaacaagagagtggccaagtgggatatactgtttttctcttgcataggtggtcgttgccaaacccagagtattataccctccgttatgcagatggtcctcagctgtacatcaccgaacaggttagtacagggagaggcaaaatcaatatgggccttgcttggaattaaacgacccaaggagacggcactatttatcttcactcagcatccaggtagcttccatgtgttgggtaaagagtcactctctggacagactgggaaacaccagcccttgttcttccctagtggctagaaaaaggtggcttttacttcctgagtgcccagggtgctagaggaggatcttagaaattctttgccaaggaataagcaggagaagagggcccgactgaagatcctcagttacatctactgtaaaaaagacaaaacattattgttgattcaacttgcttgtaccactttaacattttatcttagttactttttttgtttatttttcactacccagactcgcagtgacattaagaatgggacaatcttacaactggctatctccccggtaggtattctttcttccttaggagtttattcatgtcacaaacaaatatgagcacctaccatgggccagactctgttctagaaataagtactctggagataagaaagtcagtctttttgtatcaggaaatagtacaggaaaataagtctgtcttggttctcaccacctagtggggagtaaacaaatgcaatagaaggcctgtctcaagggtcttgagagaaagttgcttagggagctgtgggaactcacaaaggggaccacctaactcagcctggagatttccagaaagtcttgccagagaaggcgtcacttagctcagatgttaaaggatgagcaagaattagctagagaaataagaaaaggaaaagtattccagtcagagaaatcagcatatgccaaggcacagaggtatgctgtgtttgggaaaagcaggagtgctgggtggctggaggcttgtagcagtcattgagaagccagatattcaaggttccttgatggcctactcgtaggtttcaactctgtccagaaggaaactggggacattgaagaattttaagcaggaagatatgttatgtttagattttaagttttagaaagatcactttagtgaccatgtggaagatgggccttaagaagaaggttggtggtagtaggaacctttgaagaggctaataaggaatgttaacagcccagtgaaggcaagtggtaatggagatgaaaggatggatatgaagagtatctaggaggtaagctttatgagtatggtgatatgctagatgtggaaggaaaggggagaatggaggatgaccctgatttgtgcaagagcagcccttaaaggtcactaaggaagcaaccagaagggtagaaagaacaccaagaaggtgaagtgactgaggagctttgggcagggagagtgtcaggactgaggagagtatggtctgcaatttttaataagcagagagatttagtaaactgagagcagaaaagctgtctaatgacttgggaggttagaggacactggtgatactcacaaaaaagttatggtggggaggccaggtggccacactgaagtggtcaagtaaaagaaaggtaaaacagtgaggactttgagtctactgctgtatcaagaagcttggttttaaaagaaaacacagagaaggtgataatgcgaaggggacgtggagtcaaaaagatgtgctttttaaaagcaggtaaagcattcatgtgtttcacaaatcaaaaattttcacagagatgtagcaaaaggtctccccgcaactcctgtccccatctgcccagttccccacctttctgacccttcgtgttggttgtttctgttgcaattttttatgtgcccttaagaatgtgttcagatggaagagaggaaggttgaaggtgcaggaaagcaggtaatcaatagaacaggaccttactggaccaggagaggaaggactcaaagcccaggtagagggaatcactttgactgctaggcccatgaagaagacagccaatatggttgcacctttggttacatttgtagaagggcagccagaaaattaagggcatgatggcacttcttttcttggtgcagagagagactggttcatctgagaggaggggaggtatgaagtgatatcagccagcgtttactgaatgcctatattttgctaaatactttgtgtaattaaatcatctaatctttacagacatcccatgagataggtactcttgatagccccattctgtaggcaaggaaactgagggttagagaggttaaattacttgccacttgtcacacagctaataaagtagccaagcccgctctcagacccaggtctgtctgactctaggcccatattcctcccatcatgttcttctgcctccccctcttctcctgaactcttctcatcttaaggacttcattcttccctcctaagctctggtaatttaatatgacagtctgggagttactcacttttatggaagtgccgacacatttcacagacctcttgcacagtgtagttgactttcccagaagcacatctctctggagcgggaggcagcagcccagaaatgctgtctcaggaggaaaattgacatttggagttggaggtttctaagtgggatgcagaccagtgctcttcagattgttctatgctatgaccttttcccgtggcgcacattttctccactgtagagatagcgagggcttctgtattgcagagagcactgtgctttgaagggccagctttgtaatagtaaaagaggagaggcaaaggggagagggccagcaggcctgactccttggcggcagcaggaattgggctccagtcacttgcttaacactgagaaaaaggaaagaagacaggtgtgtttttgttcttaagtctcttgctttctagtggagaacattaaattaacacccaaaaaacagagaatgatgaaacaataaattgtgaggcactatgtagtaatgagctcagcggaaggaaagcccagtgaatactagaggagggattttagccgcagcttgcagaaaaggaggcaggcatcctgctaggaaaagttcatgtgctaggaggaggttttgtcttcaccagccttcattttcaaaaaacaattgggaaattgtttctggctccttgatgttcttaaagtttccccagaactgtcactttgaggaacaatcatatggattctaagagaaagtttttaaaaaattgccaggcttttcacattttaggattaaaagggaccttagaggacatcagattaaattcttcacccaatgcaagaatcccttctacagcgtctttgacaggtggttgtccagattctccttgattgcttctgctgacagggagcttaatacctcaagagaaacctcttctgctgtctaacagttttataaattttattttattttattttattttttttgagatggagtctcactctgttgcccaggctggagtgcagtggcatgatcttggctcactgcagcctccacctcctgggttcaagcaattttcctgcctcagcctcctgagtagctgggattacaggcgcatgccaccatgcccagctaatttttgtgtttttagtagagacggggtttcatcatgttggtcaggttggtctcgaactcctgacctcgtgatctgcccgccttggcctcccaaagtgctgggattacaggtgtaagccactgtacctgaccaattttattttcttttttatttttgagagagagtcttgctctgttacccaggctgcagtgcagtggtgcagtcctagctcactgcaaccttgaattcctgggctcaagcagtcttcccacctcagcctcctgagtagctaggactacaggtgtgcaccaccacacctggctcattttaaaaaattttttgggagtcagggtgtcactctgttggccaggctggtgtctaactcctggcttcaagcaatcctgccttggcctttcaaagccttgggattacatgcatgagccacgcacccagcaagacagcttaaatagaaaaccttcctctattaaaccagtatctgtttctctgtgacttaccatcgttagtgggcctcccagatgcctccagtattcccttggtaggaattttttaaatccataggccaaagcggtacagaaaagatgcagataactacagattggttttggcatactaataactccctgattgattccacaaacatttatttagcaactcctaagctgtgtgaaaaaactagttctgcctcaggtttggatgtccacagaagggcctctgtgagctatccacagagtagtaacctgctccaaggagcagatggcacatatcttgtccctggcctcctagtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccagtgagtatgactaaggtctcgttccaaggacttcgacgatttactacatcccacagggcatcctagtctcatttcccttgagtcaaataaggagtttattgaataccacctgtgtgcagagcagtgtgccaagcactagagtccataccaagatatataattccatattgtgattctaaatcgtgtagtctatttgggctctcacaaattaaataacagtacaaaacagtactgtgccaagtgagcagtgaaaataggggctagagaagtcaggaggagagcagtcacgtcgtgacagacctgttaattgctggaaatgtttggtttgatgagggttagtgagcagatggtccagtatctcccaggtgtctgtttgtaatcatcccctgctcctccctcttcagtcacctcccagcccatacacacacacacacacacacacacacgccttcctttgtgtttaccacaggtgtcaacctacccattcaccatctccctgccacacttttgcacagggaggaggagaccagaactttgtgatacccacaagcatcttcatcataccccagagttcacatgcatgcggtgggcagctgtgccttgtgagcagcagtcagtaaacaggtgcttggagcctaacctgccaaagagggagtcagaaatcttctcagcccatagatcaactattgaaattgttagccaaatcgagtaactaatcatagatatttgttttacatattggatcttccagctgtattgaagtcctgaagccttcagctgccatcagcactgacatagttctacagtctcccaagggtacagggttagactggccttagtttcactctcttcagcctgaggataataatagctaccttgcagtattattgtgagaagtattgttaatgagaatgtgtctgaacatgctttgtaaataggaatatcatctgttaattctagagcactgtacagatgtataaaggattaaatgtataaggagaagagaaaaaagagaaaacattttaatccttattctctaccagcactagaataagagctttgcatacatcatcatcttgtcgtctccacaaccctgtgaggttaacgctgtgagactaacttgattttacagaggaagaaattgaattttgaaaagataaaatttgcttggttagtaaggtggacaggaactgaacccatctcttgcactctactgcctcttggcccaaaggttaacatggcacttacacttccttaggttctcccaacaggtgttggagtttgacaaaggtccaatgtcttctttggtcttgggaaatagataagtgattctgtgtccctgggatgaagcatatggagaaggaagatctaattacccagcaacttttttttttttttttttttttttgcagcgatagatacctgggctgaatctgctctacactggctaggtgtgcacacaggcacttacagttacagttgcatcgactgatttcccatggggtgttcacattaaaattcatcttttttgtggctgccctcacacctgtgtttcccgatctgaatctttgtctattttgtgtgtgtgttgcacgtgtctcagctacagtgagatgctggcattcaccctgactgccttcctagagctcatggaccatggcattgtctcctgggacatggtttcaatcacctttattaagcaggtgaggcctccaacattctgtctttctctcctccctcagctgccagttcacaaggcttaaggggagatacaggcaatatcgccattctggtgagatcagctttatattccctggggccagatttttcatcctcaagctctagtcttctgtggcttctgaaagatttgcattttgttatattctcagggcctgcactgagatggaactggaccgtcagaactaaatatgatcaaagtagaattagattgtcagtgagactggggataaagccagccagtcaaccagtactagccctgagtcttttgaccgacttcctgagctctctcttctttttgtatatatataaaaaaaatttgcatttcatttgtaaatttgccttctatttacaaatctgcaaggtagcctgtttggattgtcagactaagttcagtgggtaggagagggtacttctggttttaccctcctttcttttacacaaaggagcagtgtcaattcagaatactgaactaaaaccaatgaataatattgtatctgctgccctagaacttcagctatcattggcttaggacattgggactccccgacactggacacaagtgaaatgaccatgtgtcaaggatattataatggggactgagaagaaggattagagtaaaaggcttcaaggtcctttctacctctcaaagtctaagtgtgtttagggggagtgtgtgtcaggggaggtacatggagataaaatgagatcccagtatcagtaaaatcctctgcttttttataccccactttctcaaactggaacccttattttgataaaaagaattaagcttttagattttgaggaaacacaattaagtggatactataatctgagattaaggtatccatgccaagggaatccctggcacattggccagggtagccgtaaaccagataccactatccacctagcaacagctgcccaaatgtgaagcagagagagcttcaagggctagcatcagatgctaagcttctatctttcttgggccctgagcttctcaattgatgtgccatctctgggtctagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtgtgagtaaaaaaccctacacctccctcccttcacttgtctgtcctcttttctcctcttattttaagtcttccaatcctactctcctttgcttatattccaagctgttggttggcttcttcattcatcacctcttccacactcctgccagaatttctcccatcattcagacttgatcatgtcatgctcctgcccaaaatcctctgtaactctctctgccccttaggttaaaatgaagattttcccagtcttcccataccagggtggtaccaggcaaaattagatgctttctcacatgggcccagtagtctctgtacctatgataattatataaaatactggatttttattatctgttgcccattttgaacatagagcccccttgaaacagagaccaatcattgttgtatcccctgttttgatttaagtagaggctcaattagtgcttgttgaatgaatgctcactgaaccgacgatgcactgtgggtgatttgtaagaaatatcacacaggtgtgagtttggaatatcagttcaaatccaggctcttctgcatactaggtctctgccatcagcaagtaacctagtctcttctggcctcagtttcttcatctctagaataggttaatcaccttcacctctcacactgtgaggatcaaaggagattttaaaaaggtccagcatagaggccaacctgggttaggtattcagtaaattcaggggcttttttcctttgtttgtttgttaagactcttatcacatcctaaaacattttaccagatactgagaccatatgacaaatgaacccattggagcaatgtttctcccgtctccgctgtttttacctcacttccaaccaacctacaccatgtaaggaagctggactttgcaaaacagtggtggcactcctgttgattctcttctgactgttgttcacttctgttttttagacattgtcagaatgttgccagaatcccccaccagttcgaggggaagtcatagctcccagatttgggagtttatagtggccctgtcttcactcagctatgctcccaacttgtttttccccactaatccaagtaaaaagaaagcacaattatttctttgcaactctgatttctccttgtcacttttaaggaattttcagcctcagctttctttgcttttcttttttgagacagggtctcactctgccgtccaagctggagtgcagtggcatgatcataactcactgcaggctcaagcgatcctccccatctcagcctcccgagtagctggaatcacaggcacactccacaacacctggctagttttttttttttttttatttttgtagagacagggtctcgctgtgttgtccaggctggtctcaaactgttgggctcaagcagtcctcccaccccagcctcctgagtagctgggactacaggtgtgagtcaccatgcctggtctagcctcagctttcatacccagcgagccaccaaggttgattaaggtgagagggacattataaactccagatagagaattctgattttcctgtaacctcacatctacttctctggttttttttttgtctctgaattcagagtggccccagttgcctccctagggatgataggggaacatggcatttcataggagccaatactttcagcccacagctgtcaccagaacttatatgctttcctttttgggctgagggatacttagtgccctctgttagactccctgggtaccatgtgactaaccaggaagcccatcagaccctctggaaagacagccacagaatgcacccaagacatggcaggtggagatgtcaagtaccaggattgtaagattccagagaatgattgtagttattttgtttgttcataataaaataagtttatagtcaaagactttaaaaatacagaaaaacgcaaaattatttgcccattatctcacctccagacatacccactgttaaacattaaattgaatgtcccttcagtatttttatgcatatttttaacaaaatcgggatctcattatatatactatgtgtaccttgattttttttaactgaataatacaccttgaacatttctccatgtcaaagatttttctaaaagggtagttctaagtcttttttgcaacctagacacctttgaaaatctggtaacaagtatatactctcaccagtttggaaaaaataccacttagttggcaaactacatagaataatttctgtatcattcctggggttcacaaatactctaagctcatccctgaatcccaggttaagaatctttaccctaaaacatgacttttaataactacttaagattctcatatgtataaatgttggctaatgtgaccatttggattactttccattcttttttaagtagtactttaatgaaacgccttgtcagtaaatcttgcatagctctctgattactgtcttaggataaattcctattagtgaaattgctgggtcaagagcatgcccactttgaatgcttttgagactgagctccagatcattatttgcttataatctgtgagtgattgttttaaaccatttctaagcatcatcttgctgttcagtcttctaatctccctctctcttctttctccattgacacagctccaaccaggagattcagacctacgccattgcactgattaatgcactttttctgaaggctcctgaggacaaacgacaggtctgtggctgccttttcacatttttcatctgggctcttctgagataattctcaccccatgcactctttgctatgcagagagcacaaatccagcaattttcccaagagttcttcctcttagctgtctggtctggagcccaggagggtggctttgctaaggaagacccagggaagacctatgaggggaaaccagctgggtcttagatgagagcagggcccttcaaactttttcctctaaagggccagagaataaatatgtttgactttatgggccatatggtctatgtgatagctactcaaccttgccattgtagccaaaagcagcctcggccagtaggtaaatgaatgggtatggctgtcttccaataaaatcttatttacaaaaacaggcaacaggcctaatatggccatagtttgccaactcctgggttacagaatcaagaataaggaagaggagaccctgtgggtaccctgagtccaaggagtccaatatgaatgggatttcacactaaatcttaggtttaaaggttctctgatggagattctaaacatcttccttcccctgttcattaactgtgacattatgcagatagctctgcctctgtgaaccttagtttcctcacctgtcacatgggagcaacaacatctgccttgtttacctcacaaggatgtctgaggaaaaacaagatccctgtttcacaaataaggaaactaagaatcagctgggtggtggaacaaacactgacctaagagccgaggggcctgggactaagtattctccctgctgctggctggacaagtgtttgtaacctctttttgggtctcagtttctctttctgtaaaatgaaagggccagtttaaatgatctctgacagcccttccaatactaacattctagatttctctgagaaaagcccaagtggtgttaaaagtaagacattttagttctctgacaatctcatgggctcagtaagatgaaattcaagtgggatcatgtatgtacccagctcttggtagattctagagggaagaccagaagcatctgtggttctgtctgtccttgtctttcttggatggcttggctctgttaatctgccttcccggtccttgtttgaatgtaagctgaaagctcattccgtctgcttctctctgtgcttttgctttctgccggcaggacaagcaccttaatcctctagacctgcctgtcactgtaagtagcactgccatgtggaaagggccccagctcttgcaggtggggaagtcaaagctaggcaagaatctcatggtctgatctagatgttcagggcatgccaagacccagggaaaggttgtgtgctgtgaatctcctttgtcaggacacttagggaagtactgcagattagagtcacagaaaggattaagggggtacctgccccagggagtgtggccccagccttcctttataacttgcctttgcatgggtctgtagttcaactagggcagaccagactcagaaacagctcgtaactttgatctagacaataccatggatgcgtcaccttcttacttgctttagtggaagagaaaaggtatccgtgccctttttggactcttactagaccgtgggaatccgaaaaggtttagacaatcgacaaaagggaatttggatgctcatttcttcattatagggagctttagagaggtcagctttgcgaggagatgaaaggggataagtgcctccccctgacaccacagagaagcttttggtctaagacctttatattctagctgcagaccactgtcaattacccaccttatgagttgtccacagcaagatttaatctcagtcgacctcctatagttaccagagaagtttctaggccactgtcctcctctgctagccagtatgtattcagagaatgcaaagtaaaatttaatgttcctggcagcattagccatttggaatatggctagaaatccagaagtgtgacagaggggcctttcagctctgagaaaaatgacacagagctcacagatactactccataggagaggtgtgacagctccctcaggcccactgatttaggattctctataaaattaaatgaaggcagcagtttagaaaatgaagtcatggtaattaacatcagtaagaagtgatggtcgacactggaaggaggagacaagaattatgaaaagctgtcagaaaaattaaaggcattgtaatctgggaccattttgtttatgggaaaatagcttcacatctcagtagctcctcagggtatcacagtgtcacaacacagaataatcactgatgttctttttgatgaagccgactccttagcagtgattaaattatcactgtagtcacttcagaaataaatgtatataatatgtctttaaaagatttgcataagaatggtcaaaataatgattctgagagaacccttaaagctttgctccctggaagattcatttatgtaggaaacttgatttcctgggtgggctaaataaataaagcataactatcaaagtctggatcaaatattataaaaaaggtgagcctgttataaaaaattacccaaaacaccagactcattgttctctaagccagttagaacggaatcctagactacttactgttgtagagcgtccagaccccagccgtctgctgtagggtgggagggggttgctggaccaaagcccttccttgtttggagtcagtgcttcactagagttccttctagccttagcagtggggtctacctggcacgatgcatgtggcttagaaaccatcacactgctctgtgtccatgtgcaatgtccttgtgacacaagcgtctcatcttcaagcagtcctcatctctctttgaagacagtggagttgattgtgccattaggaaaggaaatcctatttgaattaatttgcactcacaaaaatagggaatgttgcagagtgtaaaatacatctgatggtcagtggattttcgttcattcacccacttttcatttgggaggaaaaaaatttaagaaagcaaaaaaggcccagaattttgacatcaccttcctctcgatagtagtcacaggtgtgtgcctgccaccctgccttatatttgcttattttcctccacaggatatggcaaatgcatttgcacagaagcatctccggtctataatcctgaatgtgagttcctggaacatgctgtattttattactattaacaacaattattactgttattgttaatatattattattgaaattattaatgagtgaggaggacacacagaggaaccttatcaataggtaaatacctcttgaactgaatagctttttcccgcgatcttctgtgagcagagttgcctctaggcagccatctcaccagcaattgcagtgcgtccagggagggaccaaggccagctctactgtttgttgccctgcaactccagaatttttatccagagggaatatgttaaaataggcacaaagggggaaaataactcatccaactgacactgattaaaaatctgaattgtgtagggcactgacagaactaagtaagcaagtgtatttgctctcaaagaccttctggcctggtaggaaagactagtgatcatagtggggtgtgatctgggtttgtggtctaggaaaggatggaggaggaacagtgatttctgccttgaagaagagtgtttccggaaacttttagaggaatgtcttcaggtgacccttagaggatgagtaggcagaccgggaataacaggaatttcagtcagagggcagccagaacccagaaggagtgtgtgattaggcacagagcaaggagcaagtagatgaggaggctagagaggtagcgaggaccagatcaggaaaggttagtctcattcctaaggacagctgagggcatttaattgagcttgtgaagtaaccagatttgcattttagaaagagcacatgaaagacatgtgtttgctaaggggtacctgagggaggagagcagagcaggagctggcagggggatctggaaagaggtataaatccctgttaccacctgtggggtggagtagggctgatgttgggaggtggggccggtgggagtggaggaggagagccaaggatctgaattaaaaggaggcaactttggccggacgtggtggctcacacctgtaatcccagcattttgggaggctgaggcgggtggattgcctgaggtcaggagttcgagaccagcctgaccgacatggtgaaaccttgtctttactaaaaatacaaaaattagccgggcgtggtgataggcgcctgtaatcccagctactcaggaggctgaggcaggagaattgcttgaaacccgggaggtggaggttgcagtgagccgagaccaggccattgcgctctagcctggacaacaagagcgaaactctgtctcaaaaaaaaaggaggcaactttatcaactgtcagaaacaagggaaacctgggagaccacagtgaagggaataaaatgaaaaattagaagtcaagtttaagacttaagctaaacatggactttggagtctgccattttccaatctttgatcttgagcatttcacataacttctctggacttcagtttgctcatctggatatgaggactaagtgagctaatataatactgtgcttagcagggtgtctggcactcagtaagcactttgctcgtattggcagaacaggatgcagaggtgataggattgaagaagtaagctctgagcacttgtgaagctgagcagtcagctgctctaaaatgcagagtctgccagacttcaccttgcagaaccagcttctccctgctggctgcttccctggtcacacccagctaccagcctggcaggaggggccccaagcccacaagtgacaggagtacacaggttcccacacattcctgcctacactcctgagcagctgtcctggtcaccctcttctgcatgtgtggggatgagtgcgcccttctgaaggaaatttaattatgtttgagacttactatttaatcgggttagaagttcaactcatttctggacaaaccttgtgaacaagtaaagatttcactatagaaggcagttcagcatcaggactcaggacttaagtggcctggcaggaaatggctaatgcatggtcactgaagtccagggatttcactgagtcaagccagagaactaagaccctgagatacttgacagtcaagtgagacttcaggtaaaacctcaaactgtcactcatcagactggagctgtacttctttaagccattgatgctaggataattaattaccttcctgccctgatgtttcttaagttggagaaagagaattaaagagaatgaaaatcagaatcacattaacttccacctctattcaaagctgttttataaattagggagaagagtgaggagagaggaataggatagacgaaggtagagagagggagcagtggagaagaaaacctcagagtgaggcaaaggaagaggtgtgaaggggaaaagaagtggcgatggcagggaagagcccctggccatgagagagactggggggagtgggaaggaagggaagttatggggcagggggcacagagcagagaacaagagagtaaggctagagagatgaaagaaacagtgagactgagctaagaagagcgatctcacgcttaagagacagagggcgtgcctgtgacagggcgggagctacaggactggacatgatcaccgattcagagggagggagggatgcaggcagaggcctaactccagcatgttagcatgtgctatggaagtgctgtccacaatggtggccaccagtcatgtgtagtactttaaataagtctgttgtggctgaggacctaatttgtaattttaatttcattttaaatttaaatatccgtatgtggctcatggctgctgtattaggaagtgtagatctagagaaacagctagaaaaaggagagagcactggagtcacagtaggggaagaggtctagagcaggaccgtccagtggacatagaacccaaaccatgcacatgattttaaacattttagtagcagcatgaaaaaggaatagggacattaagttcaataatatattttattcagcccatgatatcgaaaacgttaccatttcaacaagtaataaatatgaaatattattaataagacattttacattttcttttttcctactaaggcttcaagatccggtatgcatttacactcacagcacctctcagtttggcctaacaacatttcatgggcctgggggctaccaaactggacctcacaggtctaaagagattgatctagagtcagagcaaactctagggagagctgatccaaagttagaaggagctttaaaaagatactgagtcagatacctctctaaagtcagagcgctctagagcattgctattcagtagaactctgttaatggaagtgttccgtatctgcattgctgtagccgctagccacggtgactactaagcacttaaaatgtggctggtgcaactaaggaaccaaattttcaacttaaatttgttttaactgatttaaatgcaaatagctgcatatggctagtggctgctatactggacagcacagccctagagacagagctactgagtagggaaattgaaggacatagtggtggtacatgtggaaaatggaggagagcctcatttgggcaagaaagaaccaagagggacaggattcataatggtgggtgagacagagggagtgacaaatacaagggagcaagaagggaagcaggatattgtgggagtgaggacaggatggtgagagacaggaatgtaatcaagggttgatcagctaggacagaccgagggagacatagcatgcaagagaaagacagagacagaacatgagacaggaccaggggacctaaagtggggtgtgggcatcagagggacaaaggaggaggtgatgaaccgacaggggaatgtgggggcacagagacagtggggagggagagtcaggagggagagggacatggtgtgggcggcacagggagcagggacagagtgataggagagaggagaggacaagtgagaggaaggaaggaaggagagggccgtgggagggagctggtgggagagtgaactgttcctcctttgtgttgctatctcagtatcattgaaagaaaatggcctttcccaaagcctctctgctgggtgaagccatccaaaacattttatttttctaagggaaaaacaactctgcctccatgcacaccatctattgttttgcatttagtaggcctgtgaaatgcctgattggaggaaggtccagcccccaatgttctgtatcatagccttgatggagtagcctcccccatttctggtgtggttgggtatagcccctgccttcactctgcttcccctgcccaggggaatgcagaggaagggatggcgcctttcaggcctgcagtgagtcatctctgcctgaaccaagcccattcatgctccatcgccttctagaatatgaagtcctcgtgtgtgggaggaaagctctgttcccttcccaacatacattccttttccttagcatggatgtggcccttcattaaaagagatcagttcagtcccctgctccctgcctgtgctttttctagcatgtgatccgagggaaccgccccatcaaaactgagatggcccatcagctatatgtccttcaagtcctaacctttaaccttctggaagaaaggatgatgaccaagatggaccccaatgaccaggtaggtgctaagtggggcagctgttttctcatggctgtggtgcagtccagccttagtctatgtgccaggcactgtgcttggtctttgtctgcagaagtagtttgcatctgccctagaaaatctagcatgatctgcaccatgagccaagcccatttctgtcctgctgtggtagaggtgatgcctcctaagggattgattggggccaaagtttggcccagaaaagcctgacccactgtttcttttccttgctcccttggttagccgattcacctgctgactgtctgtttcacctcgcaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccgtaagtacctcagagcatagacggtggtaggccctctcccctgatgggaagtcaatggtcccacccagacagagctctgacaaccagccccatggtggccctggaatagatgacagttaggaagctggtggagctttaatgcttgctttgctttgttgatggtgagtctgtgagtttatgtgcaaagtttggccctgtgaaacgaatccatctgtaggggggttgcggtcagctagagtgggtagagaggggacctgtcctcttacccaaactgctaggttctttgcaaagctagtgtgaatattttgtgatagagtagggcttgaggatggggttaactggaagaagtatttcttgcgtacctactcagtgtgcagcagcatgtgaagtaggttctgggatgcatggtgaggcagccaccgtccagcactcaagagctcacagttcagtggtggtgatgggtgtgaaaagagctaggacagaggtgggtgctgagtggtagcagcatcaagaggagaggcgagagggcatcccctcaggtccctgcacacacggagactgccgcatctcaaattgggtgtctttatttctctagaaccacatcaatccagccatggactttacccagactcctcctggaatgctggccttggacaacatgctgtacttggctaaagtccaccaggacacctacatccgggtaaaggcaggggagctggccttctcagtcctggtgccacatctcctgccttcctccttcatctccctaatcctccctttctcttcccccgacagattgtcttggagaacagtagccgggaagacaaacatgaatgcccctttggccgcagtgccattgagctcaccaaaatgctctgtgaaatcctgcaggttggggaactacgtaagtctctgcagctccctcttcttcagccattccttgtcatcaagagctcagtgagactcaaaattataaacagttacatgtcagtggggtcgggcgtggtggttcacacctgtaatctcagcactttgggagactgaggcaggaggatcacttgagcccaggagtccaaaaccagtctgggcaacatagtgagaccccatctctaaaaaaaaaaaaaaaaaaaaaaaaaccaaaaattagccaactggtagtgcatgcctctggtcccaactactcaggaagctgaggcaggaggatcactgtgtcaggaggtcaaggctatggtgagcatagtcatgccactgcattccagcctgggcgacagagtgagactctatcttaaaaaaaaaaaaaaaaaaagatgtcagtgggactagacaaccttaggtgggtttttaattttgttttttgttttaaatcactgcatcagctgataattccatcttatccttatttatgggaatcatggttgttgctttgtttgaactggcaatttgaatcatattccaaagctaccccatgcctgtgggtaagggctggctgagtctgtaacagggtagagggaaggcaagaaaatgcaccctggagaagaaagctaaggacgtgagaaacgcccatcccacgctccctgttaattgcgcgccttaggctgcttttgttcctcgggactttggtgcaaagtttccagacatgagctcccaggcccttgtggacagaggcttcatcttctccctgttttttcacttccacagcaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacaccatccagtgacaaacatttttgttttcctctagtcttttttatcccctacaggtttttccttcattagcaagatcatactgcgcatgcagtgtggtatcctgttgttttctttaatagttgttttaaggggaccaatgcatttttttaaaacaccacagcgtgccagaactgcgcttgcctttctattcttttgtttgtttttttgagacagagtttcactcttgtcacccaggctggagtgcagtggcactgtctcggctcactgcaacctccacctccgaggttgaagtgatccttctacttcagcctcctgagtagctgggactacaggcgtgagccaccacacctggctaacttttgtatttttagtagagacggggtttcaccatgttggccaggctggtctcaaactcctgacctcaggtgatccgcctgcctcagcctcccaaagcatgagctactgcaaccggctggtatctcatattctttatggcaacacctatcaggagatgtgtcttcctttctctcggtttagagatgagtagatgcacacctaaggatgttaagtgacttgctgaagggacagagtcaagatgtgaacccatttctttctgactacaaaaatccatgctcatttcccccacaccattgaccaattgaaatatatgggaaataaagcatctatcagtgtcagtcatgtgacctgaataaccatctaagaaggtataccttactcacccagcagatgtctgtagtgcctgccctgctcaagaccctggggcaggaaagagccttggtgctccataataggcctgtccatttctcaagagtagtggtgtgagttggctgggttcttctcctcttaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtgtaagttccatctcaggggaggctggcgggggaggtggctgccagctctgctttccttccagagctccactgtccccatgaccttccgctcactccagtgtgtgtccaccccagggagctgagggagaagatccagcccgagatccttgagctgatcaagcagcagcgcctgaaccggctctgtgagggcagcagcttccgaaagattgggaaccgccgaaggcaaggtgagaggagacggggcaatccttggtgccgggaagagcctgcctggatggccccttttgtgcccaggcctttcccagtactgtcgttgctcacctgtttggcttcccttgtgttccagaacggttctggtactgccggttggcactgaaccacaaggtccttcactatggtgacttggatgacaacccacaaggggaggtgacatttgaatccctgcaggagaaaagtaggttcatttctctgttgatgtgtcatggttgctggacttgtcaggagacaggagttctagtccagctgtttgtagctgatcatctgggcttgtacctgttacctctctggacctgtttccttatctgtcagcgatttcctctacctggcctactcggtggggtggtttggagaaacaatgagttcacaggtgtgaatgtattgtgtagactgtaaagggtggtacatgactaagtcgaaaggcagtagttaagaggagaagctgtgaagccagactgcccacattcaaatcctggctttgctcctaattaacttgaattctaattaattgcaagttctcccctctgccttggtttcttctcctgtaaagtgggaataatagccacactttcctcctaagaggattgcatgagtaatgtatgcaaagcacttagaagagtggttggcaggtagtcagcataactgttagcagctgccactgctgttggcgatgatggcatcatcatcgccattattgtgaaggagaggggaagggagtcaccaaggtcccgttccttggggatataaatccaagagccctgaagtgaccctcagttagctttgacacagcctcactgggctgtggtctacaggagtgaccaagacggagggaacagtacaaggccatcctccccaccaccctcactgagctcatacagcagcccttggagtttggggctgaggcttcctatgcatctgccccagtacctcccttccagcactgatgtaggcactgaccagcttgcagcatgaacttccagagactaattcccatcatttatcagttcctgttgcagacattaaggccattgtcactgggaaagattgtccccacatgaaagagaaaagtgctctgaaacagaacaaggtgagtagagaggccagtttgagtagctggcccagtgatacttggagagtgccattggtggtggttttttccaggtgcattcttggcatcttcccctctctattcctgaatgttttattaagaattttgaacatacacaaaaatagatggaacctctgtatacacatcacccagactcagcaaccatggccagttctgcccatccacttgtttctctcctttatcgctttgaagaaagtcccaagtatcacactgtttcatctgtaaatatttagtgtacatcgtatagtatataacattgccaccagtccattagcacacataacaggaaatgaaagtagttatttcagatcaaatattccactgatggtgactttctaccaattgtcttataaatgtcataatttctctacagatatataaatgtttatatggatacacacacacacacacacacacacacacacacacacacacacccatacccatcttgtctaaaccagagtctaagactggtcttttaagtttcttaattcataagttcccccgcccccccatcccccaccatcttttcctttgcagtttattagctgaagaaccagattgcttgtttggtagtttcctagcatctgaattttgctgattgtttccccgtggtacagtttaacttgttcctctgtcccagatctgtacattggaagagggatctagaggtttgatccagttcaggtttaacttttttcctggccagtgtcatcagtggtattatgttctatcaagaggcacataacgtctggtggtctctccttttgtgataattagcagactgttgaagctcagtgcctcattccatcagtcaactaaggtttgcaaactcatgatattttgatgcagtcattgcttttcatttatgagctgaaccatgaaacttgcccttatctactattggtttcccagtggtacagtttatataggaaacgagaataaatgctgattcttcttttatgtacttactttcaaaataatgagttagttccttggtatcatgcaacagtgaccaattttgtgtgtgtgtgtgttttgttttgttttttaattgttaagacattcctatgccaaatacagcacgatagaagttgttagtcatcttggtaatataaaaacttttaggataacttacagtcatggatcgtgaccttccagggttctgagtgttgaaaatgacttttttccaatcttaaaaatatcacaacatctttgatgtgacttgggcagggagtgggtaagttaaggttgatttatgctgggcctcatctccagccacacttgtggccgcctaggagcattgatgacattcatctgaatcagcatgtttggtgatgatgccgagtcactaggactttggccaagatcttgatgtgcagaccccaggctgttccatcgctctaatttaaaccctttctccttcaggaggtgttggaattggccttctccatcctgtatgaccctgatgagaccttaaacttcatcgcacctaataaatatgaggtgagcagtgtggcgctgccttagacaacagagctatttctgtaactcttcagttggtggcaggaatgagcaaaacaggaaagtcccctgtggtgggtggctgcagtgtatattgaagcctaggaaggctttgagaagaaggtggcatttcaataggatgggaatgtctcaaaggaggagctgtggttggggggcacccagatgaagcagcaggtatcattacataatgctggacctgaggttcctccaggcgcattgggtggctgccaaggatctgtcacactctggattgtttatctgtgagctgggctctccacattactcttcagcagcagccataggttgtcattacaaagataaggtcaactaggaatgagtcatttacctgggactgggaaaattctccccttttcagtttctctgtggtcagctacccaagagaacttgacagatccttcctcctaggggctcctggtcacatgttgtaatggatccagtgtggactttgaagccagatggaactggtccttctgacaagggccctgtagttccatctgcagcactggaagatactagatattaaatgagtgattgcatttgagaccctatgtgcctggtgagctctgagagccatcactgggaactagaggtgggacttctggcagaggagacacttgggcagggcctgagctgccgctagtggaatttggttgagaggaaatgaagaacaagcaagtggggaaccaggtgagcaacggtgtggaaaaaggaaaatggcagcagaggaagcaggaagagtcagggagcggtgggatcagaaggcttcctggtcaccccctcttagcatgagacccaccagttccatttctttagtatttactctttaatatgtattgactggattatttttaattttgttttcgggggggcggggcacaaaattgagatcccacagtgacttctgtttgtgtcttgcttcttttcacctaatacatatttcccttctctcgcttctgattttgggtaacttcaggtagatgatgccccagtactcagatctcattttgctgtattcgtttattgcatttttaggttctccttcatattattgtaaggagttgtaatataaaaccccttataaaaaccagatctcttgagaaagtgaaggatcacctcctaatttatctttgctatcattccaaatcagttttgcctatactgattagttccaaaaggaactgttgtgagccccatcagaaaagagaccttggcaggatctcctgctgaccaggggtcacgatgtgacattttgcaacttgctccccacagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaa

SEQ ID NO: 6351 - DNA, 14886 bp, Homo sapiens
ccggcctcgcacttccggtggggagattccggcctggagctcccagggccgaggtgagtgggtgtgcggccggcctcccggcgcactcccagaggctggggggccggggctggagaagggaagcgggctccccacccgggatctgcgcgggttgacatggggcacgccacgcccctgcccctccccgggcctcagtttcgccgtctgtggagggggcaggggtctccaagcgccctcctgcaaggcacctgccggacgccggctcatctggtatttcctgagcacctgcgacgtcctgggtgcgggacccgggccggaatcggacacggccctgccctctgaggggctgcttcccgcggtgggattggggcgggcagtaaacacgtgagcaaacaaggaaacgtcagaggtgggagtgccacgaggattgggaggggtggggcattggagaaagtattcagccaagcggaggtctgcggaagggagctgaaggcaggaagagcagcaagtaaagaaaaacacaggtttgatgtgtttgacacgtggcagggggccgctgtggcgggtgctgggaccagtggcagaagaatgaggttacagaggccttccttgtggaccaggctgaggagctgggcttagccttagggcatgatctgtttcgtgtgccatctctctggctgctttatagattccaggccttaggggcgaaagaggaaacagggagaccagttagaccagtggcagtcagcaggtgaaagataattgtggcttagactgtggtagtgggaatggagaggaagagaagtagaggggtcaagaagtgtattgaaagtggaactgacagggcaggatttgagaaatgacagaaataagtggtcaaagatgacttcatcatagatttttggttttggcttaagtaaccaagtgtattatgctggcatttactaaatgactttgggatagattgggagcgtgagaaataattacgaaatcttcttagggcatcttaagttttagatatttggagtgcagctaccaaataggcagttagatatatgagtctgatacagaaaaggtcagggctgatgtaaagaatttagaaatcattggcaagtggattgggtaggatgagattatgtagggtaagatttaagagagaagagaagccaggttccaagctttaggcacccaatttttatagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaaggtaagaatagagactaagccggcccggcacggtggctcacgcctgtaatcccagaactttgggaggccaaggcgggcagatcacctgaggccgggagttcgagaccagcctgaccaacatggagaaaccctgtctccactaaaaatacaaaattagccgggcatggtggcacatgcctgtattcccagctcctcgggagcctgaggcgggagaatcacttgaacccgtgaggcggagtttgcggtgagccgagatcacgccattgcactccagccttgaaactccatctcaaaacaacaacaacaacaaaaagaatagagactaagccttcgaaggggcagcagggaggagggtgtggtgactcattggagcagtggagatgggctgaagtgagagcagggggtgaaggagttggactggcagtgcggggtcctctggggaagtttcactgttaaggggaccaggaggggagtaagcctctaccatgagccagcatttaatgctgtacctgatgccactttacagttggagaaactgagtccagaggtcaagtaacttagggtcacacagtagtgagtagggacaccaggatttgattctcagtgtctaactccaaagcccacactcttaagcactaaaccatgctgcccaagttacagttaggaagatggagggaagcaggtgtgccagtgatgcaccagccagccttaccttgatgtgactgctgcccccagctaagctgctctctgtggaaagtggggcagaatatggactttccttcctgagcaaatgagatttcaaaaagagttgtttactcctttaaatcttgtttcccttataaaataagggtggggaccttttcagtttcacgtctgtgtctccagtggtgggcctacaggagtgcttgataaatgctcattaagtgcctagatgatctccagggacccttctagctgagatttggctttgtgtttgggcataggtgaccttctgaatcccaataagaaaataagttaaatttgagacagtgcttcttgtaggcggggtagccatagggacttattggaggcaggggaactgggccaggtctgtgaaggaaggtcagcatttgaacagtggagggagggtgttgcggtgttgcagtgctgcagcaggaaatgcagcaaaagcaggagctgcaagaagttggttaacagaagagtgaacagacttccctggcttggaagccacaggaggagccatgagggaagagtgctcagaagaaagctctgttagtgccagcatgtcctgtgagtgcctgtcacaggacagggtcagcagtggttctcaacagggagcaggtttgatcctcaggtgacatatggcagtgtctagagacatttcttgggtatcacaacttgggatggggggaaggatgtgacaggtgtctggtgggtatgggccagggatgttgctaaacatcctgccatgtagaggatgggtcttctcacaaagaattatctgtccccaaacagcagtaacgcccaggttgagaaaccctggcgtagaggaaacagtgtgggttttgagatctgtagacgtatgtttgaggcccatgcgccctctttgttggaggagcctgatggtggtggttgcaggagaagtagagagaaccgtgtaggagactcctgcagtcatttggggagaggatggtggctgagatggtagtggtggagttcaggacatgtgctcatatttgggatatttctgaagatagagctgacggtatttattgattgaatgtgggctaaggggaagagaggaatcagatgagcctaaggcttttggcctgagcaactaggagagtagtggagccatttgctgggatgggaagtaggaagaggagcaggcttggatgaaatgggggtgtggaaaacacgagtcagtttcagacactctagatgtgagtgagatgcctgatattagatatctaagggaagaagaggttaggtaggcattggatattcttctggagttcacatgaatcagagccggggcatatattgggaagacatcagcttacagaaggcatttgaaggaatgagaatgcattaggtcaggtaggagtctcaactcattggatctgacacctcttttttattacaaatattttgtaacagtcccttttattaccctaaaatgaaacatatgattaataaaaactgcctacacataattttttaaaaatcaacaaatgcagccgggcgcggtggctcacgcctgtaatcccagcactttgggaggcaaggcgggcggatcacctgaggttgggagttcaagaccagcctgaccaacatggagaaaccccatctctactaaaaatataaaaaattagccgggtgtggtggtgcatgcctgtaatcagtcccagctactagggagcctgaggcaggagaatcgcttgaacctgggaggcggagcttgtggtgagccgagattataccattgcactccagcctgggcaacaggagcgaaacttcgtctcaaaaaaaaaataaaataaaatataaataaccatgccctataacataaaaggaaagtaattgatagtaaaacaaaatatgtttcaatatgtaagtttctgggcacaatagtgctggaagttgcagtgaagctgtcccttctgtgtggaccctctaggagtgtgatggccacagacacagactgacacagccgtgttgtgtcgcacctcgaaaaccactagtgccattgctgtagatgatgtggtttttccagaatggacacttttggtgccattttgagaccaattttgaccattttcagtctcccttcattgtacataggcgtcttattcttggaagtgttagttcacagcagaaccatggaaacactgcactgtgtttacatgtaaacagagttacattctaggttcagataattataagctaatctttcacctatatggatgtcaaagtcgtgcgggatgcagagcagtaattggctatgtggactgccccttctttatccctgcttactgaacgccaggagcatatccccaaaataccgccacaggtttccaaagctcctctgaagacaactgtagccccagagattcatttggacacagccagctccctgtttgccccggggaggggaaatagtaacaagagttccagagtgcagaatggaatgtaactgctcccttcagaaatgttggggtgggagatggagaatgtgtctgatcgtgaagcctaggaaggcttcgagaagaaggtggcgtttcaataggatgggaatgtctcaaaggaggatctgtggttgaggggggcacccagatgaagcagcaggtatcatcacataacactggacctgaggctcctccaggcacagacaggtctacccggcatgctccgggcactcatcagggttggctggattgacagggaggctgggagtggtttcatttggcaataccgtaaggcaggctctgcttccagggagtagtggttacagcctggtcttacagtgttccagccgttagagtgttggtttccttctccatttttaacccctaaagaccagaccagtcccctgaaaatcgcatgcctgctctctgtcagtcatcaaaccagacggagaacttaaagtacaccagctgtgcgtaaggccagtgtggtcttactggtccctatctttgtgccgctcgtagcctctcaggggacagacattactcaaatcacaccctgcacaagtgctatgaaagagaagtaggagagccgtgaaagcaacatgtatctcaggggactgattcaggggatggggtggggttccctgaagaagtgacctctgagctgaagataggtaggattgatgaaggactgaagggtgggtgcagtgttcgttcatttccttcagacaacgggaagaaagctggtgtgtttggggagctgaaaggcgcccagtggggccaggtcctggagagcctgtggctgagactgggaagaccagcagggccagatgaggccatgggagccgaaagaagggtgctggtctttatcagaaaagcactggaagctgctgaagggttttaagcagtggcctgacatgatcagtttgtgttttaaaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaaggtaccaggaggccttgctggggcggggtgctgggatgaaggtggccagagccatggctacggtgcccttcatgtttaacaggaaggcacaagcttcaaccagtctaactggaagccagtcacggctgggctggaacagggccctccaagcctgccgtgccagggttccccttcagtgtttggatccagggaaaccaaggagagcggggggtgtgaagggatgagctggggaaactggggctcaagcagcagctatttaccccactagagaagtatttcaatattttaataagtgatacaacgtagtgggccgcagtggctctcacttgggcataggccgtgaggaaggctgggcaggtagctcacaggtgtgttgaaatggtggagacagcaccaggctaggattgagtctcttggctgccacctgtcttcgtgacctaagagtctgtcattccaagcgatgataccgtaactaagggccctacacacatagcaaggtcctcatgaaccaccgaatgagccccactccagcagaggggcgaagaggaagagggagccggtggggggcaggctgtctaaaccaagccggggtgtctgctttgggctccatacagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacaggtaggtgggggacctcagtgagggcagagcaggaagaggggctggggaaccataggatgagaacaagagagacacccgcatgtctggaagccaagtccctcccctcttcctgcactgttcctcctctgccctcttgacctggcctcccaccacccacgctgctgcctcttgtgcactgcgtgccttcccactgccccaccacacacccacaaaaccccccctgcacctgcggccccgcagctccctctcctgccagcagacaccgagcctggagtgcagccctcaggcctggagataagtggtgagcaggcagggtccctgccctcgcagggctgtgacacggacatggagggcactacggagcccagggaggggaccaacccaaggccggggcccatggctggtagaggaagatttcctaggccaggtgccaagtaggcagagccctgaaggatgcgtgggactggttggccctgggaggaggggccctcgtggcccgagggagatttagtgccagctgtggggtctggaagggaactcaaagtgtttcaggatactgagaacccggtgctggccagaggaagtgggaaaaatgagaactgagagggtgggcaggggtcatgtcctggaggccggattccccgtggaggagtttgtgttccatcctgagggaaaagggtttccagtaagggatcaaccagatcaggttaatacctccgctcagggggctcgccggagtgtttgtggaaaccataccggcccagccagttggaatgggccccagccctaatgctagagcagcccccgacctttgggggccagatattaaccctttagttgctggtggaaaagaaggcccaagggccccacaggaggcaccgggatggttcagaagtgggggacactcaggtgcctcagggtaccagcccaccccagcagagtgtggacctcccaagctgtcctgtgggtgcctgtgtcttcacagctctggcgacggcgcttgacgtgggcttgtccaactggagcttcctgtatgtcaccgtctcgctgtgagtactggccatgccctgctgcctcccttcaggctgaagctgtctgtctgtccagcggggtgtctgcacacccggctgctaggccagccactccaccactctgggaccagcccttgctctctcagcctctccctggcacccagcagctctccgggaagtcgccagcctcttccgtaagcccagcgcagaggagatgctgtgcccacctgccaggcagcgtggggaagccagggagctctcccagaaccccatcatcagagcaggggaaggcaggctgcaaggccacagacaggtggccactggtgggtggtacacgcagccgcagcagagccctatgtggcctgggggctacacaagagtttcttcttccctctgatgttttgcttcagagagcactgttcctgccttcttgtcctcctacttctcatccttccttcccgctcctgggctctgccgagggttaggtaaagaacaggactcagggagctcaacgtcagacctgtaacctcttctctctggtgataaccagaggcctcttagtcagagattccttctgattaaaggtcgcttatcactcagatgacagcccagctctgtttggtcatttcgctcagtgatttgtgctcctgctcctttctcggtgatgggtctgagccctgagctccagcagtgcattgtgggtaattttgcttccaggtacacaatgaccaaatcctcagctgtcctcttcatcttgatcttctctctgatcttcaagctggaggagctggtgaggccccagcgtctcttgtgtccttcctgcccccacagatgctaagaataaagtgggagtctgagcagtggcttgtcctgctgtgtgacagaggagacaagcccagtccaggtggcagtagatccctttctgagaagggacctagacatgggcaatactcagaatatttagaaaccagtgtggcagggtaatgaccaaaggtgaaagcactgcaggatgagggtcccagcagagctgggtctaggaagcaccctgctgtgggaggcagtagccctgtgtgttaggcccagggaggaggtgggaccacttgggggcctaggacagccgtcagtgtggcagagcaagcagggctgttggcataccagctgaccgtcagccctacatgctgacattggtgggcaaggactgtccaggaccccctgggatggagctgaagggtggaaggatttcttgccccaggggcagccaagatggctgctgaccccaggctccaaatgtgatgaacccttgaccctcaagacccccgagttagctgccactgctccccatcctaccagcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggtgagcacgtgccactcatcctccagagagaggaaccccggcacaggcagggcggaggcagggcagggccggaccagacctgatggtgcctgtcccccgccctgcaggcctccagaatcccatcgacaccatgttccacctgcagccactcatgttcctggggctcttccctctctttgctgtatttgaaggtacgttgggccttccctctcaagggcacctcagtgcagcagaccacagatcctcgccctgagcccaacacagtggtagctgcagagattattgagatcaaagatgcagtccctcccctggaagcgcatggtttggggtccagcatgataaacgctacagagaaagcacatataaaattcagggaacagtaacagtaagtgtgcacagagccctgaaagtgcaccagggctgttctgatctttttaaacataggaactcatttcatccttccaaaaacctggtgtggcagtactattattatcccccattttgcaggtagaacaaaatgaggcccagagaagtaaagataacttgcccaaggtcccatagctcgtaaatgagccagaatttgaagccagcagcctggctccaagtggtccagccctactcttaaccaccctatcttgcctctaaggaatggggaatcagggattgttccaagatgctggagtaatcaggcaagtcagaaaggcttcccaggccgtggtttggagggtgagtgggattttggcaggctgcagggagcaaggcatctcggaagtaggaataggaggttcagccatgtccaggaatataacctggggatgtgtgttcaaggagtgtgggccacgcaggatcagcagagggtgggcttccagagctgggggctgaagaccaggagccagcacacaggagcctggggacatggtcagttgttcctccactgtcgtcctccagggatgaggagagccctggagaactgtgtaggctgggaggtgtgacgccaccttcctttctttgatgttttgggattagcctttgtcccctttctgtttatccttcctcccagagtcccgtctgtaatgccctcagggtcattacagaaaattctgtcccacatccatttaagtttcaagcagtgaagcgtcttgaacctccccaagaaaattattctgaagccccgttgtccaggaaacttctgttcagggcctcgttttttttccttctttaaaatctctccccactccttcattatgcccccttgtaccaaacgccacactctccctcccctcccgtgtgtttacaccatgccccatctctgcaaaacctcatctgaaagcccctggtagtcgtcacttggcaaagctgcatggatttagctcctttaatcttttctggtaaattaatcccccaagcgccttcattacttatgctgctcttccccgaattcccttcaatttgccgacgcctttgcagttctgctgagcccagcaccaaacaagatgtcctacactgtgaggctgttttgcctggggggactgtcactcggcatttctttggtgcttccctccaaaaatctcaaaatactcgtccagcttccagctaccacagttgtctcttgtgcccagttctgggccccccttcaccctgtgctaatacaccacgaggactttcgtgtgggagggacgccgggagtcattcttccagatggacagtgttggagggaccatgactcctccgaaagtctaagctgaatttggggtagggggtgtgcatgcctgtgtttctggagcaaggggccatgtgtttgcattttctttttgggaaatgttcatcaagtgataccacgggttggagaaataccagtctggtcccaggcctctcattttatcagtaaggaaactgaggtccagaaaggggacacatctcagcccaagtcccacagctctgtactagcaagacctagattaaaatgaacgtttgtagggatagaattttgtccctgtttgtaggtgaactggctgaaatgtagaccaaggagttccctgagtgggctggggcactgttggtccttcgtcacttggtagccgccctaccttctttagcccagtagttaccacagctccaaagaccccatgaagtcagcagccatgagcccctccccacagaccagtaagggaatactgtccaaaggtgcagggcacttccatccgtctttccatgcagggccacccccctctacttcaccccagaggctcagacgagccctccccatcattccgctaggatccccatcatcccactaggatctccatcatcccgctaggatctccttcatcccactgggatctccttcatcccgctaggatcccatcatcatcccactaggatccccatcattccactaggatcccatcgtcatcccgctaggatcccatcgtcatcccgctaggatcccatcgtcatcccgctaggatcccatcatcatcccgctaggatcccatcatcccgctaggatccccatcatcccgctaggatcccatcatcctgctaggatccccatcatcccgctagggtcccatcatcccgctaggatccgcatcatcctgctaggatctggcttgtattgcccccaggcgctctggcagccatcactgcttccctggtttccccaggtctcaggccatctgtgtgggatcactttataccttccatgctttttctctgggctgcagacagttagcaggtctcagtaagaactcactactacagtggaagatcttgtgtggttggcattgggctggccaaggcagcccaggacccggcctcccactctctctccctgttgctttcaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggtacagactcgggcgtgatgccagtcctgtcttagagagggagcccccaggggtttctcaccagcagcttcagtcccagctcctgcaccccagggccctgcagagaagagaaggaagtgccccattaggtgccaggcactttgctgagtgctgtgctggcccctccttctgccttgaccacagccctgtgagagggtatgatcactcccatcccacagacagggacacagatggagagccgcccctccccaagggcacagcaggggcctcaaagccagctctgactctgctaggcctggaatgcattcacattttaccttgactgccaactctggcactgggcagtggcctggagccacaggttgaacagcccctatccagactcatcaggaaagagttccgtgattgactggcggtgtcctccaaggccatggccagggctagtgagaccctgagaaagcacccctgtggccagccttgctgtacctctgcctcgcaggcctgtccttccctctcatacctcttctcacttctccttctccctcccacacatttcaacagtcctccctgttcaggggcagggagggacttttctctttggccaggcacacaccagtgttgaagcagtgttgcctaaacccagaaatgcaggcctgtccaagggtcttctggtggccagccgcatgctgaggcatggctgtggttcttggatgaacggccttgccagtcctgtttggagtctctgtttatagagagccccgggaccagttgtgtcttcagtccggggtaacacagcattctcacacataggctcagggctctcttctgtggctgccttctggggcagccgtcctttatccttgtggataaggcgcgatctggacaccctggtccccagcctgggatctggtttgcctcttttattcctgacagaattccatgacaagcacctcctttgttgcatctcacaaaaggaggctggcgggacagcgccgcaagccggccgggtcccctgacctctctgcctgcctgggcccaggatttcagtaagatcttgatctgcccacctgagtgtacctagtgcccccaccttccaccctcctggtcaagcagccaaatctgcctgttgatcatgctccctcctgcttctctgcccccaggaagtctgcactttgctgttggcagctcatctgctgggcgatcagatcagcctcctgaactggctgggcttcgccctctgcctctcgggaatatccctccacgttgccctcaaagccctgcattccagaggtaacccagagtcccttccagaagcctctgttttctgttcttctccctgtgactcttagtgattctgatgcaggaagtgtgcccggtggctctgctgccgtcactcctctaggaagatgtgggggtcatctccagagtgggtgggtggggcctgggtgactcagcacacatgcaaatcagagcaaaccaagaaaaccacgactgggcctgtaactgtggtctctctctatcccaaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagca

SEQ ID NO: 6352 - DNA, 418 bp, Homo sapiens
tcaggatgatttattttcctttattttggagagaagtgggggagggggtcagaggtacttgcaaagccttgtccttataagaggggcccttgtgtgaggatatccttacctctctccacttgagttgtcagccgcccttgcccttggcagtagggacgaaaatagcatttcctgtcccagttatcttccccattttctgatgtcgtcccacacagaggaggctttgcattgtgtcctttgaggggaaaggggtggcatcgatgagtggggaggaagcaagagagcatgtagctgggccctgctgatgctgggatcttcctaggatgactgcagaaagaagtagcctggctcctccagctaaccactcaaccaagaaaaggctgtctattcttatctgtctcggagcatatgcttctct

SEQ ID NO: 6353 - DNA, 6801 bp, Homo sapiens
cggcctcgcacttccggtggggagattccggcctggagctcccagggccgaggtgagtgggtgtgcggccggcctcccggcgcactcccagaggctggggggccggggctggagaagggaagcgggctccccacccgggatctgcgcgggttgacatggggcacgccacgcccctgcccctccccgggcctcagtttcgccgtctgtggagggggcaggggtctccaagcgccctcctgcaaggcacctgccggacgccggctcatctggtatttcctgagcacctgcgacgtcctgggtgcgggacccgggccggaatcggacacggccctgccctctgagaggctgcttcccgcggtgggattggggcgggcagtaaacacgtgagcaaacaaggaaacgtcagaggtgggagtgccacgaggattgggaggggtggggcattggagaaagtattcagccaagcggaggtctgcggaagggagctgaaggcaggaagagcagcaagtaaagaaaaacacaggtttgatgtgtttgacacgtggcagggggccgctgtggcgggtgctgggaccagtggcagaagaatgaggttacagaggccttccttgtggaccaggctgaggagctgggcttagccttagggcatgatctgtttcgtgtgccatctctctggctgctttatagattccaggccttaggggcgaaagaggaaacagggagaccagttagaccagtggcagtcagcaggtgaaagataattgtggcttagactgtggtagtgggaatggagaggaagagaagtagaggggtcaagaagtgtattgaaagtggaactgacagggcaggatttgagaaatgacagaaataagtggtcaaagatgacttcatcatagatttttggttttggcttaagtaaccaagtgtattatgctggcatttactaaatgactttgggatagattgggagcgtgagaaataattacgaaatcttcttagggcatcttaagttttagatatttggagtgcagctaccaaataggcagttagatatatgagtctgatacagaaaaggtcagggctgatgtaaagaatttagaaatcattggcaagtggattgggtaggatgagattatgtagggtaagatttaagagagaagagaagccaggttccaagctttaggcacccaatttttatagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaaggtaagaatagagactaagccggcccggcacggtggctcacgcctgtaatcccagaactttgggaggccaaggcgggcagatcacctgaggtcgggagttcgagaccagcctgaccaacatggagaaaccctgtctccactaaaaatacaaaattagccgggcatggtggcacatgcctgtattcccagctcctcgggagcctgaggcgggagaatcacttgaacccgtgaggcggagtttgcagtgagccgagatcacgccattgcactccagccttgaaactccatctcaaaacaacaacaacaacaaaaagaatagagactaagccttcgaaggggcagcagggaggagggtgtggtgactcattggagcagtggagatgggctgaagtgagagcagggggtgaaggagttggactggcagtgcggggtcctctggggaagtttcactgttaaggggaccaggaggggagtaagcctctaccatgagccagcatttaatgctgtacctgatgccactttacagttggagaaactgagtccagaggtcaagtaacttagggtcacacagtagtgagtagggacaccaggatttgattctcagtgtctaactccaaagcccacactcttaagcactaaaccatgctgcccaagttacagttaggaagatggagggaagcaggtgtgccagtgatgcaccagccagccttaccttgatgtgactgctgcccccagctaagctgctctctgtggaaagtggggcagaatatggactttccttcctgagcaaatgagatttcaaaaagagttgtttactcctttaaatcttgtttcccttataaaataagggtggggaccttttcagtttcacgtctgtgtctccagtggtgggcctacaggagtgcttgataaatgctcattaagtgcctagatgatctccagggacccttctagctgagatttggctttgtgtttgggcataggtgaccttctgaatcccaataagaaaatgagttaaatttgagacagtgcttcttgtaggcggggtagccatagggacttattggaggcaggggaactgggccaggtctgtgaaggaaggtcagcatttgaacagtggagggagggtgttgcggtgttgcagtgctgcagcaggaaatgcagcaaaagcaggagctgcaagaagttggttaacagaagagtgaacagacttccctggcttggaagccacaggaggagccatgagggaagagtgctcagaagaaagctctgttagtgccagcatgtcctgtgagtgcctgtcacaggacagggtcagcagtggttctcaacagggagcaggtttgatcctcaggtgacatatggcagtgtctagagacatttcttgggtatcacaacttgggatggggggaaggatgtgacaggtgtctggtgggtatgggccagggatgttgctaaacatcctgccatgtagaggatgggtcttctcacaaagaattatctgtccccaaacagcagtaacgcccaggttgagaaaccctggcgtagaggaaacagtgtgggttttgagatctgtagacgtatgtttgaggcccatgcgccctctttgttggaggagcctgatggtggtggttgcaggagaagtagagagaaccgtgtaggagactcctgcagtcatttggggagaggatggtggctgagatggtagtggtggagttcaggacatgtgctcatatttgggatatttctgaagatagagctgacggtatttattgattgaatgtgggctaaggggaagagaggaatcagatgagcctaaggcttttggcctgagcaactaggagagtagtggagccatttgctgggatgggaagtaggaagaggagcaggcttggatgaaatgggggtgtggaaaacacgagtcagtttcagacactctagatgtgagtgagatgcctgatattagatatctaagggaagaagaggttaggtaggcattggatattcttctggagttcacatgaatcagagccggggcatatattgggaagacatcagcttacagaaggcatttgaaggaatgagaatgcattaggtcaggtaggagtctcaactcattggatctgacacctcttttttattacaaatattttgtaacagtcccttttattaccctaaaatgaaacatatgattaataaaaactgcctacacataattttttaaaaatcaacaaatgcagccgggcgcggtggctcacgcctgtaatcccagcactttgggaggcaaggcgggcggatcacctgaggttgggagttcaagaccagcctgaccaacatggagaaaccccatctctactaaaaatataaaaaattagccgggtgtggtggtgcatgcctgtaatcagtcccagctactagggagcctgaggcaggagaatcgcttgaacctgggaggcggagcttgtggtgagccgagattataccattgcactccagcctgggcaacaggagcgaaacttcgtctcaaaaaaaaataaaataaaatataaataaccatgccctataacataaaaggaaagtaattgatagtaaaacaaaatatgtttcaatatgtaagtttctgggcacaatagtgctggaagttgcagtgaagctgtcccttctgtgtggaccctctaggagtgtgatggccacagacacagactgacacagccgtgttgtgtcgcacctcgaaaaccactagtgccattgctgtagatgatgtggtttttccagaatggacacttttggtgccattttgagaccaattttgaccattttcagtctcccttcattgtacataggcgtcttattcttggaagtgttagttcacagcagaaccatggaaacactgcactgtgtttacatgtaaacagagttacattctaggttcagataattataagctaatctttcacctatatggatgtcaaagtcgtgcgggatgcagagcagtaattggctatgtggactgccccttctttatccctgcttactgaacgccaggagcatatccccaaaataccgccacaggtttccaaagctcctctgaagacaactgtagccccagagattcatttggacacagccagctccctgtttgccccggggaggggaaatagtaacaagagttccagagtgcagaatggaatgtaactgctcccttcagaaatgttggggtgggagatggagaatgtgtctgatcgtgaagcctaggaaggcttcgagaagaaggtggcgtttcaataggatgggaatgtctcaaaggaggatctgtggttgaggggggcacccagatgaagcagcaggtatcatcacataacactggacctgaggctcctccaggcacagacaggtctacccggcatgctccgggcactcatcagggttggctggattgacagggaggctgggagtggtttcatttggcaataccgtaaggcaggctctgcttccagggagtagtggttacagcctggtcttacagtgttccagccgttagagtgttggtttccttctccatttttaacccctaaagaccagaccagtcccctgaaaatcgcatgcctgctctctgtcagtcatcaaaccagacggagaacttaaagtacaccagctgtgcgtaaggccactgtggtcttactggtccctatctttgtgccgctcgtagcctctcaggggacagacattactcaaatcacaccctgcacaagtgctatgaaagagaagtaggagagccgtgaaagcaacatgtatctcaggggactgattcaggggatggggtggggttccctgaagaagtgacctctgagctgaagataggtaggattgatgaaggactgaagggtgggtgcagtgttcgttcatttccttcagacaacgggaagaaagctggtgtgtttggggagctgaaaggcgcccagtggggccaggtcctggagagcctgtggctgagactgggaagaccagcagggccagatgaggccatgggagccgaaagaagggtgctggtctttatcagaaaagcactggaagctgctgaagggttttaagcagtggcctgacatgatcagtttgtgttttaaaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaaggtaccaggaggccttgctggggcggggtgctgggatgaaggtggccagagccatggctacggtgcccttcatgtttaacaggaaggcacaagcttcaaccagtctaactggaagccagtcacggctgggctggaacagggccctccaagcctgccgtgccagggttccccttcagtgtttggatccagggaaaccaaggagagcggggggtgtgaagggatgagctggggaaactggggctcaagcagcagctatttaccccactagagaagtatttcaatattttaataagtgatacaacgtagtgggccgcagtggctctcacttgggcataggccgtgaggaaggctgggcaggtagctcacaggtgtgttgaaatggtggagacagcaccaggctaggattgagtctcttggctgccacctgtcttcgtgacctaagagtctgtcattccaagcgatgataccgtaactaagggccctacacacatagcaaggtcctcatgaaccaccgaatgagccccactccagcagaggggcgaagaggaagagggagccggtggggggcaggctgtctaaaccaagccggggtgtctgctttgggctccatacagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacaggt

SEQ ID NO: 6354 - DNA, 7793 bp, Homo sapiens
gctggggtggtcgttttgaatggatgaggatgacggatcaggaatagagccagcctgggcccatttgtcctgtcactgtctgtgttacatgaggttccttcttctctcactttttccccactctgctactgaaacaggaatctttctcaaatgagtgttttgtatttcttgcccattcgtatagagaagggttgcctggcgcaatttgatcagggcaggagagggatactatgggatgttctagtcgaagtgtatgtatctgcctgttgcttatgattcacagtattcctgctggaagggttcatttttctgaggcttgaggagaagttgcttgtccaggattctgttcttccttgggtccttggattctcacgctgctgtcgtttttcctgttcagtcctaatccagacctctgtggtctgtcacatagcaccctcctccctctctgtgagtctcctgcttggctctgtcatattcctctttttttccttttctagaaagaaaagtcaaaatcgaacagttcagcagcccgagaacctaatggctttccttctgatgcctcagccaattcctctctccttcttgaattccagggtgagttgcatctctgtgtcttccttgcaggagaatgaaaacttggatgaatgcattaataagaagaattggccaggtgcagtgactcacacctgtaacctcagcactttgggagtctgaggcgggcagatcacctgaggtcaggagttcaagacgagcctggccaatatggtgaaacccagtctctactaaaaatacaaaaagttagctgagcgtggtggcgcgtgcctgtaatcccagctactcgggggtctgagacaggagaatcgcttaaacccaggaggtggaggttgcggtgagccgagattgcgccactgcactccagcctgggctgcagagtgagactccgtctcaaaaaaaaaaaaaaagaattctgtgtatcaattcagtgcctgctgtttcgctggtattttgcgaggcacttgacctaaatcttttcatttaaacttcacgataactctgcaagataggtaatggtattctcattttccagttaaggaaactgaggctcagagaggttaagttacgtgtctaaagttacataacttgtaagtgacagactccatgtcaggtcctggttgtccgaatcagaagcttttttttagattgtacttcattttttattttttattttttgtagagacagagtctggctatgttgtccaggctggttgtgaactcctggcctcaagcagtcccccagccttgacctcccaaggtacaagcatgagccactgcacctggcctagactgtatgttttatcatagtcgcttagagtaggctacccaaagccgaagcttctgcttacccactgttaggacatgttctgcctcctaaaccaatcccgccggatcatcaccgtagtcatgatactgccttttacacctacctgctaggtactgtctacgaagcacttttactttactttctcatttttacccatgtatcagcctgtgatataaaccaggcagttattatcatccctatttaaggaaactgatgctcagggaggaacagtgttttgtctaagctcaaaagtgacagttttattcatttggtgacaaaatgctacttccattttagtgtgggtattaaaggtctttataggagtcaagactagcatgagtttatgactttctcttcaaaaccagattggagctaacccagcgtgtagttattccttccccacctctttcccaggccccaccaaggtcaaccatgtgctgttggaaagggaacaccaacgtgtgttcagtagtcagaaggctctgggagacatatgaggctccatttcctcagtctggccaccatctcctccttttcatttagtaaacacttaatgaactcccactgtatgcaggtaccgtgcgttgcactggggagtcaaggacaagtgagccacagagcctgtccacagaggctcatgggaggaagcacgtgtgcgaaatgataaatgcaggcgtgcacaggctatcacaggagagtaagagagggtgggcatttccacctatgcgagccagggaggtagggctccgcggaagaagtgatgtcggggctgtgttgggaggtctgaggctttccaggacaagagaaggcagcctagccaaggaacagctgggcagaagcacccatgcatgacgaagctcttgggttagggtccagtctgcctggagctgaggatgcttgtaggagaacagtaggcactgaggccagagatcagaaaggacttcctatgttgcgataaggccagctcctgcctctcctaagaagtactgggtatggctgggcgtggtggctcatgcctgtaatcccagcactttgggaggctgaggcaggtggattacctgaggtcaggagttcgagaccagcctgaccaacatggtgaaaccccgtctctaataaaaatacaaaattacccaggcgtggtggcgcaagcctgtaatcccagctactcaagaggctgaggcaggagaatcagttgaacccaggaggcagaggttgtggtgagctgagatagcaccattgcactccagcctgggcaacaagagcgaaactcggtctcaaaaaaaaaaaaaaaaaaagtactgggtatgacatttctcccttaggcagcagtggagcgtcgaagggtttagaaaggtctctctggcagtggtttgcagttcagtttaaggtacgtgagactggaggcagggcagtgaggtatgtggctgttgcaggaggccaggctggagatgatgaggcttgaactgaagcagtaggagaggaaggaatgagcacaaatgataccagagcaggagggggaaacactttggtgactggctactgtaggtgcagcggaggaatgcattggtgactcttactttttttctttttttttaattttaatttttattttttgagacggagtctcgccatgtcacccaggctacagtgcaatggcacgatctcagctcactgcaacctccacctcccgggttcaagcgattttcctgcctcagcctcccaagtaactgggattacaggcgcgtgctatcatgcccggctaatttttgtattttcagtagagacggggtttcaccatgttggccaggctggtctcaaacttctgacctcaagtgatccgcccaccttggcctcccaaagtgctgggattacaggcgtgagccactgcactcggcctggtaactcttttttttttttttttttttttttttgagacagagtctcgctctgttgctcaggctggagtgcaatggcgcgatctcggctcactgcaagctctgccttctaggttcatgccattcttctgcctcagcctcctgagtagctggaactacaggtgcccaccaccacagccggctaattttttgtaattttagtagagacggggtttcaccgtgttagccaggatggtctcgatgtcctgaccttgtgatctgcccacctcggcctcccaaagtgctgggattacaggcgtgagccaccgtgcctggcctcggcctggtaactcttaagttttgcaccttgatggtgactttaagccttcaggcagaactcccaggtgctaatccgtcagtccggcagccgaagcctgagctcaccaccttcagacaccaccagcctccttcagatgcccaaggatgcctgacaaatgtcattttctacacatcttatgatgtgagaaggattgagaagtactgaccagagacacagctacatccctcccttccacaagctgcaatcagtggataataaagaagagtttaataagcatatcctgaccttcctaaagtgtaatgttgcataaacataaagattctggctgcctctggtgcttagaatctatgtcgtgtaggccgggcacaatgattattatactcagttgtatccttggctgcctaaagtgatgccaggcccttggctctgtccagagttcctcttgaggaaaatgaccacgctcagctgctgcctttgttctgtttggttttcagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggagggtgagtcgtggttggccgaggatgagtttcctagaagggccttgctttctgctcttgttgtgtctcgtctttagagtaacaggctcgagagagcacctcagagccaggcagcaccaagccctttctcgatagcttaggaatgattatagtttcccctttcacagagggaagggagaaaacaagcattagagttgcgtgccaggctgtgtggaaggaacttgagtatttgacgcctgctataattctctcaaaaatcctgtgaggtggcagctattgtcttcttttacagatgaggaaaatggacattcaaagcttagaaaggttaaattgggctgggcatggtggctcacacctgtaatcccagcactttgggaggtcgaggtgagcgggtcacttgaggccaggagttcaagaccagcctgaccaacatggcaaaaccgtctctactaaaaacataaaaaatttagttgggcgtggtggcatgtgcctgtaatcccagctactccggaggctgaggcagaagaatcacttgaacccaagaagcagaggttacagtgagctgagatcacaccagtgtattcttgcctgggcaacagagtgagactccatctcaaaaaaaaaagacctggcgcggtggctcacacctgtaatcccagcactttgggaggccgaagtgggtggatcacctgaggtcaagagttagagaccagcctgaccaacatggtgaaaccccatctctactaaaaatacaaaaattagccaggcatggtggcgcaagcctgtaatcccagctactcgggaggctgaggcaggagaatcacttaaacccaggaggcagaggttgcagtgagccaagatcgcaccagggcactccagcctggcgacagagctagacttcatctcaaaaaaaaacagagaaaggttaaatcgcttgtctgagatcacatagccagtctagtaactgttggaatgaatgtcactttaagtccttctattttcagcatttatgctgtctgcattacatgctaaatttttttcttttctttttttttttttttttttttttaaagagatagggtcttgctctgttgcccaggctagaatgcagtggctgaatcctagctcactgcagtcttgaactcctggggtcaagtgatcctcttgcctcagactccgtagtagtaggactgtaagcctttgccaccatgcctggctttcttttaattttctgtagaaatggagtctcactatgttgcccaggctggtcttgaactcctgggcttcaagtgatcctcccacctcagcctccagagtagctgggattataggtgtgagccaccatgcccgacccaggtttcttgttataatatggatatatagatgtgtcttaggcccttgttaccttctcctgtgctgtgacctgttaacagccaactacaaaatggaacttgtttctccatgggaaatgccaattgtagttaatatttattgtgttcttactatttggcatgtgctgttcttagctcctgtgttttattacttcatctcgtcctcatagcaactctcagaaaactgggagattgagttagagttgtgatgtttgggctagaggatgacaagatgagctgctttgtcggttccagatatctccagcccagcagagatggccctctgcagtctagccgtattttgcccttccaccattcttggctgtgacctggtccagctgggccctgaatgaatgtttgcttctcaggccagtattctcccctcctcaccaagccacctccacacagctctaaggaagctcccccaggtccaggcctcaggggagccctgccctcaggccgaccctactgccttttcagagccctccctgccctcctcggaagttgctgatgaacctcctaccctcaccaaggaagaaccagttccactagagacacaggtaagcaatcactttgagttttccagttttttgtttttttggtttaaggcagggtctcgctgttgcccagactagagtgcagtggtgcgatcctggctcactacaacctccactgcctcctgggttcaagcaattctcctgtttcagcctcctgagtagctgggattacaggcgcccactaccacacctggctaatttttgtatttttagtagagatggggtttcactatgttggccaggctagtctcgaactcctgagcccaagtgatccacccatctcagcctcccaatgtgctgggattataggtgtgagccactgtgcccggccaggcttcccagtttctaagtcaaaaaaccaggaaagactgtggatgtggggttggatctgcagcgccggaaatgagtcccagggttgtaggcaggggaggatgtttgatcatctgctggaaggagcagagtggacatcccattataattcgggtgggtgggaaggttctggttgggaggggtggccctggcattccatgctctgcctgctcctaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgtcctgtt

SEQ ID NO: 6355 - DNA, 141 bp, Homo sapiens
gagatggagtctcgctctgtcacccaggctcgagtgcagtggcacgatcttggctcactgcaagctctgcctcctgggttcacgccattctcctgcctcagcctcccaagtagctgggactacaggcacccgccaccacgc

SEQ ID NO: 6356 - DNA, 215 bp, Homo sapiens
atctcggctcaccgcaagctccgccacccgggttcacaccattctcctgcctcagcctcccgagtagctgggactacaggcgcctgccaccacgcccagctaattttttgtatttttagtagagacggggtttcactgtgttagccaggatggtctcgatctcctgacctcatgatctgcccgcctcggcctcccaaagtgctgtgattacaggc

SEQ ID NO: 6357 - DNA, 3014 bp, Homo sapiens
ccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcatggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagca

SEQ ID NO: 6358 - DNA, 3014 bp, Homo sapiens; identical to SEQ ID NO: 6357

SEQ ID NO: 6359 - DNA, 700 bp, Homo sapiens
ttaagactcttttgattcctgatttagaatgtattataggtgctttataattgattatgtccccagtgagactcttaagcttttttgagtacaagaacaatgccttatatgtattcatcgcccctgccaatattttacacatagtaggtcttgtcctagaggcagaaccaatttggacagcagttttaacaattcagacaccctgtaacatgttgcttctgtaacaatccatggctttggacttaagcccagtgaaagcacattagtggttatgagtttctccctgtaaggtttttcctctttgtctcctttctattttttggtacgcgagcagcctctgtctctctgtagggaagcaacagacagcttcagtgagtacaaatgttatattcacatgtggaacatagccccagagataatcatatgtaccagtgatccgtcagtagatgctattacccgtgtggttcttttatcaaaggaattaagttctcttgatgtgttaataaacagtacttttttggccagctctggagtggatgaataggtgtttggatgtctgtctagattgacagctttagattgcttttttcctgaaatctggtaattccagatttacagtgaattttctcttaagttgtgttttcaagtgatcacaccgaattggtgggcagcaattctttcttttaccaaaaaagtaaaa

SEQ ID NO: 6360 - DNA, 700 bp, Homo sapiens; identical to SEQ ID NO: 6359

SEQ ID NO: 6361 - DNA, 354 bp, Homo sapiens
aagtattctctttttttgagacagagtctcgatcttgtcacccagactggagtgcagtggcattatctgggctcagtgcaacctccacctcccaggttcaagcagttctcctgcctcagcctgccaagtagctgatattacaggtgtgcgccagtacacccggctaattttgtatttttagcagagtcggggtttcaccatattggccaagctggtcttgaactcctgacctgaggtgatctgcccaccttggcctcccaaagtgctggaattacaggcgtgagccaccacacccagctagaagtattctttaaacagatgggtgcagtagcatttacttcatatcttgcacct

SEQ ID NO: 6362 - DNA, 338 bp, Homo sapiens
atggaagcttctaggtcttctctattactgaggccatcttctgttacttgtcctcctgaaatcccccacccctagtatattgcaagacccatgggagcaatatggtaagggccatactggttttgctcaccactgttgggtataattctacacggagcctcaggaggacatcgaagttgacccacccgggatgccgaggacactgctgagagaaaattgtgcatattatttctcgttttcattgctgaatttccctagtaatctatttatcaaagtttgactcttccttctcctataattggtgattcttttgcacaaaagaaccccattattccatg

SEQ ID NO: 6363 - DNA, 354 bp, Homo sapiens
aagtattctctttttttgagacagagtctcgatcttgtcacccagactggagtgcagtggcattatctgggctcagtgcaacctccacctcccaggttcaagcagttctcctgcctcagcctgccaagtagctgagattacaggtgtgcgccagtacacccggctaattttgtatttttagcagagtcggggtttcaccatattggccaagctggtcttgaactcctgacctgaggtgatctgcccaccttggcctcccaaagtgctggaattacaggcgtgagccaccacacccagctagaagtattctttaaacagatgggtgcagtagcatttacttcatatcttgcacct

SEQ ID NO: 6364 - DNA, 1790 bp, Homo sapiens
ggcaaacctaacctgggatctgacgggatgcgttttgccagctcagatctcttctgctactggaaacttgcattatttacagccattaggagctccctggcttccattccactcatgactagctttacctctttgaccccactgtattattgtctagcccagttcagctgaatctttcaacacaaaatatacagggaaccccttcctggggaacttcctttgttattgaggtcttcgctgatggcttcttccatttgatactcagtctcagtcacagtaggattacggaatcttttgccagagtatcaatctacatgggtgctacacattactgaaaaaaattaggaacatggtgctagttaattcaagtcttcatgtaaaacttcttctatcatagtggacattaaaaaaaatctctctgcaaagtgcattgaccctacctctagtagatgaatgttgaacaagtagcctatctaggaagcaagtgactagcatccatgggcatcccacaggttgtagtccagccccgatcttggtggttgggattgatgttgctgccaagtccctccgtttcatgttcaggctctgcctatgttcctggtgtctggtacctgatttttcaggatgctgacatttacttcttgcccacaacaccatataccctaagtcttgccaacatctttgaatgtcttctgctggtctgtctctcctccgttgttcttttactatgtcccaagtgcatgctttgttcagtatctgcctaagtctcaggatactgattttagctttttactaggtcctgacattcccgtagtttcctcttacctttctggacatgccagacaaactctgaccttaggttctgtgaaaactggtacctgcagaattcctcagtgtttgtttatatgaaagttcattgtgcctcttgattgtgggtgagttgaggaaaaggggtaaagcagtgggcagaggttgcaacatttatttggttataggacacctttgctactggagcatcttgtagggtaatgtagttcagaacatgcatggagaaatgctaccatagaagtagtagtgacatttgggacttgaaaaaaatctaagagcaggtataattccctcaacaacagaagaacatcagtgctttagaatgtttgattttgaactttcttgatgttttctctgccgttctgtagtgttattctaattaaaatctttcctctaaactctgctcttttttttccaattgagcaaattcggcatttattgaggccctactacatgtcatatgctgttctagttgctggaaacacaaatgtgaatatggtaggcctgcccttaaacaatgaattacagtgtaaaatgaaccttttataaagctggtcctatatcaatctaattattttgtttttcttcatttcaggcctaagacagctttattttctttccactccaaataatgaagaatccccttagggcaaagaaggaatttctgagcatgttataaaaaaatagaaaataggataagttgcgtgaagatttaatatttctatacatcaaaacctaccataaacaaaattaaaaggcaaatagtaaacttggaagaacatttgtaacataaaagacaaaagtttaatatcataataaaataagcacatagtagcttttagtaaatcattgctgaatgaatgaatacatatatgaattcaaagcaatgaaaaaatcaccccaggaaaagatgtaaacatttgacataggacaagtcaccaaaaaaaaaaaaaaagaaattc

SEQ ID NO: 6365 - DNA, 106 bp, Homo sapiens
tttttttgtatttttagtagaaacggggtttcactgtattagccaggatggtctccatctcctgaccttgtgatccacctgcctcggcctcccaaaatgctgggat

SEQ ID NO: 6366 - DNA, 410 bp, Homo sapiens
tcatgcagggaatagaacagtgtgttctgtgggcccaaggaatacagagtgaataaataaattgataaatgatatggccaggtgactaagaaccacaaatgtaaatgtctaatacatatttggggaaataatattagcaattaaagacttacaaatagaaccatatgaaataactgttttttacttatgtgattagaaaagctttataaaaaagaggctgtccagtgctttcacaaggtgtgctgaaacaggtagtgctttggagaaagcaatttgatgataggtataggatgtctaaaaattgtttatacaaaccgtgactcagtaattcaacttctggaacttgatcccaagtaaataatcctaaatactgaaaaagcttttccacaaagatagaatatggcattgcc

SEQ ID NO: 6367 - DNA, 3278 bp, Homo sapiens
tttttttacagtatacaggaggatgtgcataggttaaatgcaaatacgccattttctctcagggactcgagcatctgaggattttggtatccacggaggtcctagagccaatcacctgtgaggatactgaggggcaactgtatttcacctttccctcagccttccaggcctctcactttcacaaggtggcatcactgagtttgaggatgcagctccaccttacctcttcagtggctcttctcccacttgcttacaataattgctgtttgcccgcccctctgcctttctctcccttgcttttgtgtctttgtattcccgtcttctgggagaggcttgttgaatgaatggatgataggtacatacacgtgttcaggaaggctcctttttgtctcttctcctcagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaacttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 6368 - DNA, 3270 bp, Homo sapiens
tttttttacagtatacaggaggatgtgcataggttaaatgcaaatacgccattttctctcagggactcgagcatctgaggattttggtatccacggaggtcctagagccaatcacctgtgaggatactgaggggcaactgtatttcacctttccctcagccttccaggcctctcactttcacaaggtggcatcactgagtttgaggatgcagctccaccttacctcttcagtggctcttctcccacttgcttacaataattgctgtttgcccgcccctctgcctttctctcccttgcttttgtgtctttgtattcccgtcttctgggagaggcttgttgaatgaatggatgataggtacatacacgtgttcaggaaggctcctttttgtctcttctcctcagggccgcccaataactccagtatacacggtggctccaaacgttcagagaattcctactgccgggatctacggggccagttacgtgccatttgctgctccagctacagccacgatcgccacactacagaagaacgcggcagccgcggccgccgtgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggagctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctcttttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 6369 - DNA, 339 bp, Homo sapiens
tttgttaaatgaatgttttattttattcagaatctcttttcaatgaagcatctcacagaactagttccatggcaaacactttgggaaatactgaaccacagtcttcccattcatactcctgtttgttctgaaaacatcttatgttgcactttcaagtagacagaaggaagtagcaggggcttttctagagccagtggtggccgtcaacagttcaggcaactttacttagcttgtccttgcccacttcttcctcatttggaaactgctctttatccttcaaaactcagctcgaatatccccgctgctgagacattttctccaacttccccattagttggt

SEQ ID NO: 6370 - DNA, 339 bp, Homo sapiens
tttgttaaatgaatgttttattttattcagaatctcttttcaatgaagcatctcacagaactagttccatggcaaacactttgggaaatactgaaccacagtcttcccattcatactcctgtttgttctgaaaacatcttatgttgcactttcaagtagacagaaggaagtagcaggggcttttctagagccagtggtggccgtcaacagttcaggcagctttacttagcttgtccttgcccacttcttcctcatttggaaactgctctttatccttcaaaactcagctcgaatatccccgctgctgagacattttctccaacttccccattagttggt

SEQ ID NO: 6371 - DNA, 6790 bp, Homo sapiens
cggagacccgcccccgcatgcggaaccgccctctgcgaggcccggtttgggccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtactgggggaggggagagggggcgggattcccgccgggagggatccggcgtagcagggggcggagtcttattccaaccccgcttcgctttccgcatgtcccgctttgcgctcccggccctgggcatcccgctgtttccctctgcgtccgcggccctgcccttttcgggggcacagctgtggtctttccaccccgcgagacagcggggcgagggggcgcgggcggccagtggatagaggctgatgcccccaagcacggacgccagcgtgggggtggaggttcttccagctgccctgagcctgtgcgaagcgggaggtccttccccagttcccacagactgtggggagggaagagacggtggaagcgagcgggttctgggctcctgggtctctggaactaccctctgcccttgccccaacactcaggtagcgggaaggatgaccacgctcacacgacaagacctcaactttggccaaggtagggaggctggacctgcgggcccgggggcgggggcgtctgggccggcgggcttcctcgagcgcgccaccggcttgtgcccccctgcagtggtggccgatgtgctctgcgagttcctggaggtggctgtgcatctcatcctctacgtgcgcgaggtctaccccgtgggcatcttccagaaacgcaagaagtacaacgtgccggtccaggtgaggcacgtcccagaaccacagagtgggtacagggtggacttttaaaaattctttggtcgggcgccgtggctcacgcctgtaatcctagcactttgggaggccgaggcgggcggatcacctgaggtcaggagttcgagaccagcctgacaaacatggtgaaaccccgtctctactaaaaatacaaaaattagccgggcgtggtggccaaggcctgtaatcccagctactcaggaggctgaggcaggagaatcccttgaacccaggaggcggaggttgcagtgagccgaaattgtgccactgcattccagcctgggtgacaagagcgaaactccgtctcaaaaaaaaaaaaaaaaaaaaaaaaaaacctcttccacttcgggccaagccacctcattccgcagggccctgcccatgccttccaatgccttccagttccaaagtggtgatgcctacccacccctcagaagagagttccccttgccagaagttagggaccaggcctgataagagttaccccgggggtggccgggcatggtggctcacacctgtaatcccagcactttgggaggctgaggcgggcgaatcacaaggtcaggagttcaagaaaccagcctgaccaacatgatgagatcctgtctctactaaaaatacaaaaattagcctggtgtggtggtacgcgcctgtaatcccagttactagggaggctgaggcaggagactcgcttgaacccgggatgcagaggttgaagtaagcccagatcgtgccactgcactccagcctgggcgacagagcaagactatgtctccaaaaaaaaaagttaccctgggggcatggtggcactttgaaggagctcgtgaagctggtgaaccttggtgtgaggagggtatttccaaaaacctccaaatcttctccctaccatttatcctaaactcaatgggttaaggctaaaaggcagacaaagcagtgtgcatcgcactgtagctccagtccctagaagtgcctgtctctggaaggcactcaggaaacatgagaataagtggtagaagctcaaaggacatccaggtggtccccgcttcaagtccccacaccaccattgttttctcacttccagtatggtattcaagacattacttgaggtagtcagcactttattttttattttatattttattttattttattttttgagactgagtctcgctctgtcgccctggctggagtgcagtggcgtgatcttggctcactgcaacctccacctcctgggttcaagtgattctcctgcctcagcctcccgagtagctgggattacaggcgtgtgccaccacatctggctaatttttgtatttttagtagagacaaggtttcgccgtgttggccaggctggtctcgatctcctgacctctggtgatccacctgccttggcctcccaaagtgctgggattacaggcgtgagcactttattatgaaacaggttttgtgttagataatgttgcccaactgtgggctaatgtgttttgagtgtgtttaggtaggcctggctaagctatgatgttctgtatgttatgtgtattaactgcattttccgctggcgatatttgattggtttatccaaacataaacccatagtaagttgaaggtcacctttagaggggaaaggaaaaaacaattgacatttactcacttcttctttatgatgaagtgattgaagcccagagaagttaaggaatttgcctgaggccacacagttccttagttcttaacttttgacatctgattacattttcctggatcctttttctggaaaaatgcccaagtgcacaaagatacaactttagggatttttcagactctggaggagtccatggaccccacattaagaacccctaatggtatattaaatgctcatattgggattgagttcttatctttcttttcctttgagatggagtcttgctttgttgcccaagctggagtgcagtggcttgatctcagctcactgcaacctccgcctcccaggttcaagtgattctcctgcctcagcctcccaagtagctgggattacaggtgccacctcacctggctaatttttgtatttttagtagagatggggttttgccattttggccaggctggtctcaaactcctgacctcaggtgatccacccacctcatcctctcaaagtgctgggattagaggagtgagccactgtgcccagcctgagttcttatcttctaacttctttctctatggataagttcacagttcttagcctctggtttttttttttttttttgagatggagtctcgctctgttgcccatgttgcagtgcagtggcgtgatctcggctcactgcaacctccgcctcccgggttcaagcgattcttttgccttagcctgccaagtagctgggactaaggtgcctgccaccatgcccggctaatttttgtatttttagtagagatggggtttcaccatattggccaggctggtctcgaatacctgaccttgtgatccacctgcctcggcctcccaaagtgctgagattataggcgtgagccaccatgcccggccagttcttagcctcttgagggaaagtggggtctcctgggtagggagccctggagagctgctgggcctcggaccgaaggcagatggggccttaggctcctggttgtgttgggtggtttccccatctgtgctttgggcctcacgagccgcatggtattgtgtgcagatgtcctgccacccggagctgaatcagtatatccaggacacgctgcactgcgtcaagccactcctggagaaggtgagggtgcactgggctccccagccatctcaccccatgctcacccccgtccctgtgtgctcacagtccaactctgggatggggtgaagctaggactctgtggggtcttcatggctccaatacccagaagcctgttccctgcactctggagaccatcccaacccaggggcaggccccaaggcatgcgggccatgttcagggtgccttgggcctgggagcccgggttggagctggctctaagtaggggctgccccagagggttcggggttcttctcacatccgtcccctgttctccacgctaaacgttctgtctgagctgagcccctcagggtttcttccccatctagtcctgatctcagacttcctgggaccttccctatggggcccgggcattctctcagcctacaccactcatgctggagggtgccggcttctcaaactcgctatctggcctcttggggacccccagcctagcagctgagcagggctgtgagtgggccgtttctcctccttccttgggcaagggggtggaggcagggtggtgtagtcggggtggggtgcctggctctgcagtgggggttcctctctttgcagaatgatgtggagaaagtggtggtggtgattttggataaagagcaccgcccagtggagaaattcgtctttgagatcacccagcctccactgctgtccatcaggtgggctgcccctgcccctcgcccactagctggcatcaggtgtgtctctggcaacacacccacccctttaaggcggcccttgaataccttggtaaaggcctgggaggagaaagggcaagaagcaccagcatgacaaggggacagcctgtgagcagctgagatgggtccagagagatgacatgagctacccagggtcacctgggtgggggcagagcccaggacacagaagcagttttctgactccccaggcaagtgtccagtcaactcgaagttgacctctggcacatgcgttagttggtcaactgcatgcttccaatggtgaggtcagggcactggaatctggcaccaacctgtccccacggcctgtgtggccttaggcaagccctttcccctcctggcttggtgtcctggttctgggtcctggctgcacattaaaaccacctagggaggcctcctcaggctgcccctacctcccctgtcccctaccccccgccgaattctgactttatctggggtggggctgggcatttcttttaaactcccttgctggtttaattgtgtggaccggatagggagctgggtcctaggcatgcagcactctcacaggcactggagggggtcttgtaccccaggtctgcatccaggcttgatgcctgtggtggaggggagggcgccagtgtgatgggaagacctcctctcactcccagctcagactcgctgttgtctcatgtggagcagctgctccgggccttcatcctgaagatcagcgtgtgcgatgccgtcctggaccacaaccccccaggtgtgtccactccccaccctctcttcccttggcatttccatggttatctcgggttggtctgtgttcccaggtccatgtttggctgttctgagactcatctcttcctaaccctgagagtccacctcctctgggaagcttccctgattgattctacctggcttccatctccctattgactggggcttttcttagcacttgctttgccatctgctctgggggtgctgctgagccagcaagggaagtgggaagaggctgggcccagtggctggcaccagggcggtgggggagcctccaccaacctcttgcctctccaggctgtaccttcacagtcctggtgcacacgagagaagccgccactcgcaacatggagaagatccaggtcatcaaggtgagatgagatgggtctgggtctgggcgcaggctctagaaacgtgatgtcgcagttccaggcgggcaggggcactgcctgtggccagccacccattacattggtgtggcagcgcctggcacccagcaggtcctcaggcctgtccactgctccatctgggcacttggggcagtgaggagcccaggtggagccacctactggggcccccagctcatcctggctcttctgaagtgggggctctccagggaggggtcctagcccaccaggttcagcgttggtgcctggagcctgttcgtcacttgggttctatggacttggcctctgtgggggatgggggcggtcctggggtctgcatcaccaacagcttcctagtgattctgaggctcaggttggaggcccctggtctggagtgggagggacagcaaagtgagggcaggccagggcccagccccgtcacccccctgacctttgtctcctccctaggatttcccctggatcctggcggatgagcaggatgtccacatgcatgacccccggctgataccactaaaaaccatgacgtcggacattttaaaggtgagcttcgtggggacccgggaagctttatttaggggctgcttaacgaagtgaggcccggtgctgaggccttactagagggcttgcgggagagaacgggggagtgcctggtggagggctcctcccatctctactcttctccaccatggctatggccacgaggccccacctgtggtggaggtctgcccaccaggggcttctgtgtcctccagcagggatgccctggctgtcttgctgactgtggctgtttgcttgtgtccgtcagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctgagctg

SEQ ID NO: 6372 - DNA, 18902 bp, Homo sapiens
  misc_feature (4483)..(4483): n equals a,t,g, or c
ttttactgaaaacatttattttttatttatttattattattattattttatgagccagagtctcgctctgtcacccaggctggagtgcagtggcgtgatctcggctcactgcaagctctgccttccgggttcacgccattcttctgcatcagcctcccgagtagctgggactacaggcgcccgccaccacgcccggctaattttttgtatttttagtagagacagggtttcaccgtgttggccaggatggtctctatctcctgacctcgtgatccacctgcctcggtctcccaaagtgctgggattacaggcgtgagccacagtgcccggcctgaaaacatttattacaacaaaacgtcagagctatgtgacagtaagttaccacaagctggtagggttgaaccggggcaggagtcgctggtacagggacctcactgcccaccccatgctcagctcctgcctggaggaacctctggctgacccagacacaggatggacagctgtcagaaaatctggacaacagctcggtagggcgattgggcagcctcctcctgtccatgcttctgcccaggctgagcctcggaggaggcctggttcctggtcatcttggggctgacgacaatgctgctgttggtgactcggggcccataccagcctgcccagtactgggtgtccctgcccccatgctggaagaggatgtagcggacaccccgggggtagtctgagaaggtgtaggagacctgttgggaggaagggagaggaagtgaccaccgggacgggggaggggaaggcaggagccaggtcctctaagagagctgcccaggctggaaggcaacagctccaggccagcaggggcaccctgggccctgaggctgccctttgcttcctgccatcctggccctgggaggagtgggtagagagagcaagtgggtgaggcctcacctctgtccatgtggcattgttccactgttggatggtcacaggtgggggctcgaaggaggccaacacgaagtagtcagccgaggccagctgcactttgagttggtaggtgcagccacagtcggctctggcagcaaacctggtggaggggttgagagccctgtgtccaagccaccgagggctggccccaggggtgggggcaggtgggacctatacattggagctcggagcttcatctcccatcagctgacactgctctgcctgcaaggcccagctggcttcagcgctccctatgccccactgtggcccggggataagctgtctgtccatgctggcctctgttaccccatctgagaagagggacccttttgggcatcctactaaagatatgacctcaaaaatcaaaagacccctccagagaggcctggtctgtccaagccatgtcacctgtacttacaatggaccaggctgtggattcagtgggagagtcaagggggtggcctgtgtaatggggctggcacaaagctcaccctctgctcagcccagccacctctcccccctgcagctctgcatacccctccatcctcaccgctttatcctcagagtggcagccctggggcctgcctagaactggggtcctgcttctgccaccggccaagccagagcctggcacagttctgtgcacagagtaggagctccaaaaagagtcatgggatgaatagggaaaggggcaggggaggcaggtaggtcaggggacctgggggttcccacccagtccagagagggctgaggtcctctgttgcccaagtgcctgtcagtgcacagtggctgggcacagtggctcacacctgtaatcccagcactttgggaggccgaggtgggtggatcacttgaggtcaggagtttgaaaccagcctgaccagcatggtaagacgctgtctgtattaaaaatataaaaaaaaatagccgggtgtagtggtgggcacctgtaatcccagctactcaggatgctgaggcaggagaatcgcttgaacatgggaggcggaggttgcagtgagccaagatcacgccactgcactccagcctgggtgacagagcgagactccgtctcaaaaaaaaaaaaagtgcctgtccatgacagtgcacctgggggcctcagcctcctcacctgcacactggggctactgtgtcctgttgactacgtcacagggtggtggggaggccaggaggtgccgcagggtgtgggtgcagagcaggggcggaggccggggctacctggctccagggcactgctgtgcagagtgggcacttgctatgggttgtctcacgtacatgcagcgcagtaagaggagcatgtagagtgtggggacacaggccatggaccctactcaccagtccttaaccacgatgtccggccggaatgtgtctagtagctcctcccagtagccctcggctacaaggtccaccagctgggacttgaggcacattctggggagcagagttgggggcttgcatacctgggtgtgctctgcatggccccccccctcacccaggccttggcagcccctgtgagcccagggaggtggtttggggacctagggtaccccttggccgctgcgggacaggcactggctggggctgactctggcttttcctccagtgcaggagggagtttgacccacttgtgcctgggcggcatttgatcccagtccaaaggcccattgttccagggcacttttgtaaactcaagttcctagcttacggacagatgcctgtagatagccctggcttatcttaactgcccaatggactcctggcctgcttcagtgatccccacccccactgtccattaacacagcactgagtgatttcaggaagcagtgactctgggcaagttttggggccacctccctcgagcttcgcagagaggacttcccttaggaagactttgcctgagacttggcaaaggtgtcctgaccctctgtcccctccacgcaagcctggtaggttcagtttgccttactcgtaggatgtgacaaaatacttcttgactttggggtcaggaaaatctgtcccgtgggctccagggaggctctccaccttccagcggtccccaccattgaaatcaatttgccatgcaaacatatcctctaggaagaacagaagccaaggtgagaccccctgtgtaaatccaaagtccagccctccccacttagtcccaggagggcgggagggagggtggttggcgttagtgaccttcttgggaggcaggacttgctcatgctcaggtctctgcggctgtggacaccaaagggttaaccagcttgttccttctcaagggcattgtgtggccaaggtaccccaccagcccaagtgtaccccaactgcaccttggagcacccctacaaagcacccctccaacacattcccaactgtcctcaccatatcagctctgatctgactctgtccctcccactcagtcccaaactggcctcactcctaacacgcagctggagaaaagaatgcgtgttaccagaaattctaaaccaaccccttcctcacttccatgttgcggtggaactctgggaaatacccaagtatcagttctcaaaaaattacgagaggcctgtgagagtactgtcctcaaagactaatgtgaagccgggcacggtggcttgcgcctgtaatcccagcactttgggaggccaaggcaggtggattgcttgaacccaggagttcaagaccagcctggggaacatagcgacacccccccccccttttttttttaataagtaaaataattttttaaaaaaggctaacgtgttcatcccaacacagactgcttacttgacccagatggcatcccagatgtccaggagggagaggcccttggttaactacataacccaggttggaggccctagaggatgggtttgtgggtttgtcggtgggtcatgggaaccaagattcccatagggctcagatggcctctgcccagggcaagagtgccaagtggaagaacaggtaccctttgggctgggcgctgtggtaacattcatgggtgggcctccattaggtgggcctggtgggtgcaggggagcaatcaccctcttcacactgaacttagaggaccttagaagacaatggcgcttctctactggcgctgcccaggcaatcaccagggcacttttttttttttttttgagacggagtcttgctctgttgcccaggctggagtgcagtggcgcaatcttggctcactgcaagctccgcctcccaggttcacgctattctcctgcctcagcctcccaagtagctgggactacaggtgcctgccaccacgcccagctaatttttttacatttttagtagagatggggtttcaccttgttggccaggatggtctcgatctcctgacctcgtcatccgcccgcctcagcctcccaaagtgttgggattacaggcgtgagccaccgcccccggcggtgtggtggctcacgcctgtaatcccagcactttgggaggccgaggcaggcagatcacngaggtcaggaattcgagaccagcctggccaacatggcaaaacctcatctctactaaaagtacaaaaattagctgggcatggtggtgggcgcctgtaatcccaactacttgtgtgtgtgtgtgtgtgtgtgtgtatgtatatgtatatatgtatacacatatatgtatacatatgtatatatacgtatatatgtgtacatatatacatgtgtatatgtatacacgtgtatatatgtatacatgtgtatatacgtatatgtatacatatgtgtgtgtgtgtatatgtgaaggtgtcactgtggatgctatagtgtggcaaacaaggtccatttggcccctggagcttgaagtttgtagcagaaaaaaataaggaaattctgaaaaaaaaattttttttttttttttgagactaaaagtttcactcttgtcacccaggctggagtgcaatggagccatctcggctcaccgcaacctctgcctcccaggttcaagtgattctcctgcctcagcctcccaagtagctgggaattgtaggcgtgggccagcatgcccaactttgtgtgtttttagtagagacagggctttgccattttgaccaggctggtctctaactcctgagctcaggtgatccgcccatctcggcctcccaaagtgccgggattacaggcgtgagccaccgcgccttgtgaaaagtgttacagggcatgaaatgggggtgctatgctagaggtggagagggctgtttttagattgggagcacagggcaggtctctgaactgagacctgaagaatgagaaggaaccaaggaagtgaggtgggtgtttagggttagagaatattccaggtagtgtgggaattgcaagtgccaaggcccaaggatgagaaggaacgagcctggtggcagcctccaccctgcccccatgccaccttcagcacacgggttgcgcaggaggttcctatgcaggctccgtaggaagtagaagattttccagtcggccacgggctggtcccagtccttggtgatgaagccctctcgcaggcacttgcgtttccagagggtcatgaggtcgatgaggtcccgccagaggctgcagaccaggcggcagttcagcagcagctggcgggcgggcacgtgcgtgaacagctccagcaggatgttctcgggcagctcgttaatgctgtccagggctgctttggagtggggagcatccatggcctgtgggggcaacagcagttatgagcctgaccagggaggtgggccctcaggtccccagggaaccaggccagggactcctctccaaccctgcattagccaggtgtggtggcacatgcctggagtcccaggtacttgggaggctgaggcagaggatcccttgagcctgggaattcaaggctacagtgacctatgatcgcgccactgcacccctgcccgggcaaccaagcaagactctggctaaaaaaaaaaaaaaacccacaaaagagcatttctgaggctgagggtccttccagtaaacagtagcccctcagtggaaagagtagtcatgggacacacattcagaagagtgcaatacaaatagtaaagtctttagagacacattttttaaaaggcccctccccaatttaaaaaaaattgcttaattttaaagccagtgggttgtgtggactgtaagattttgtggaggccacacttgtctgcaaagttctgtgagggttttggtgattgttattttaatgctctggattcactgttagaatataaaatctttttttttttttttttgagacagagtcttgctctgtcacccaggctggagtgcagtggtgcaatctcggctcactgcaacctccgcctcctgggttcaagcgattctcctgcctcagcctcccgagtagttgggactataggcgcatgccaccatacccagctaattttctgtatttttagtagagacggggtttcatcgtgttagccaggatggtctcaatctcctgaccccatgatccgcccacctcggcctcccaaagtgctgggattacaggcgtgagccaccgtacccggccagaatataaaatcagttttacatcccagactcattaatgttcatttagtggtgagctagcgctgagaaaccaccttcctatctccagaagcttactttggcctggaagtcacatgtgataaaacaaccccatgggaatcccccacggcacccggctgagctgtctttggtgtcaggccagaatccacttggagatggccggaaaaaaaaaatcagatggagggtggctgagaagactgcctgggtttgaatcctggtctgcagtgaccagttgggaagctgtgaaaaggagggggtaactgtcccgaccctggaagggccaggaggaccaagtgaagcacagagcttcagtcagcattgctgtcagcacaaaccggctctcaacactgtcctccttgtacctctgcactgcgcacgggttctggaaaacttcaagcagtgccacagccctggcctgaatctgttacctgggggcacctggttagtcctcttaaggggatcccaggtacttgccccaggtaggtgggggttggccggcagccagggctctgcactgtcactcaggtgggcctcatctgcttacacatgaggagagaatgttctccacctacaagcagggaaacagaaccttgctggcctctttttttttttcttcccccccaccccgagacagtttcactcttgttgcccaggctggagtgcaatggcgtgatctcggctcactgcaatctccacctcctgggttcaagcaattctccagcctcagcctctcaagtaactgtgattacaggtgcccgccaccacacccagctaatttttgtatttttagtagagacagggtttcaccatgttggccaggctggttttgaactcctgacctcaggtgatccacccgcctcagcctcctgaagtctgggattacaggtgtgagccactgtacccagccttttgctgtggcctcttctgattttccatagaggcttggccaaagcagcagttcatggtcttctgaaggctcccatctcagaaaacaggagggtgggtgcatgctcacttctgcccagggaggaacactttacatggcagagaaaacaggtgaggtacttgtgcctcgtgaaaaatgctttgcaggccgggtgcggtggctcaagcctgtaaccccagccctttgggaggccgaggggtgcggatcacaaggtcagaagttcgagaccagcctggccaacacagtgaaaccccatctctactaaaaatacaaaaaaattagccaggcgtggtggtgtgcacctgtaatctcagctactcaggaggctgaggcaggagaatcgtgtgaacctgggaggcggaggttgtggtgagccgagattgcaccactgcactccagcctgggtgacagtacaaggcaccgtctcaaaaaaaaaaaaaaagaaaagaaaaaaggctttgcaaccttggcaacacagggaggccccgtctctataaatagtgaaaaaattcgccgggcatagtggcgagtgcctatggtcctagctacttgggaggttatggcgtcaggatcttctgagcccaggaggtcaaggctgcagtagctcacaggtgtgagccaccgaacccagcccctcagatttttctaccttacagtccatgaggcctgccgaggtcacactctagggaaagaaggagcctgctggagcagagtgagccatgattgctccatggcactccagcctgggcaacagagcaaaactgtctcaaaaaaaaaaaaaaaaaaaaagagaaaagaaaaatgctttgatggaaaaaaaaaataacaaaaaaacccaatgtggccaagtcttctaagttctgagaagcaactgtaagcatttgaaaaaaaatgtaaaagttgtcaattaaaaatgcttgtagtctaggcaacatagtgagactctgtctctagaaaaaaagaaattaggtcgggtgcacagactcaggcctgtattcccagcacttcggtaggccgaggcgggcggatcacaagatcaggagttcgagaccagcctggccaatatggcgaaaccccgtctctactaaaaatacaaaaattagctgggcgtggtggcggacgcctgtagtcccagctactcgggagggtgaggcaggagaatcacctgaacccgggaagcggaggttgcagtgagccgagatcgtgccactgcactccagcctgggcaacagagtgagaatctgtctcaaaaaaaaaaaaaaaaaaaaaaaaggccgggcgcggtggctcacgcctgtaatcccagcactttgggaggccgaggtgggcggatcacgaggttaggagatcgagaccgtcctggctaacacagtgaaactccatctctactaaaaatacaaaaaattagccgggcttggttgcaggtgcctgtagtcccagctactcgagaagcaggtgcctgtagtcccagctactcgggaggctgaggcaggaggacggcctgaacccgggaggcggagcttgcagtgagctgagatcgcgccactgcactccagcctgggcgacagagcgacactccgtctcaaaaaaaaaaaaaaaaaaaaaaaaaaagaaattagctaggcctggtggcccgtgcctgtagtcccagctatgcaggaggctgaggcaggaggaacgcttgagcccaggaagtcgaggctgcagtgagccgtgatcatgccactgcactccagcctgggtgacagagcaagactctgccataaataaataaataaataaatgctggcagcttctaaaggcactgtctagactctagacgaaataaaagtcactgggctccaagctagaggcatctaggcaccaatagcttcccaccgtggtgaccgaagtctggtctctggcccagtccgcattttcttgcgccccttcccccccccggccctgggcattttgtggtggggaagtccatgccagccctaggaagccctctcacaccgatcggggtccccaactgcccggcccggcgtctcgtgctcgccttctccgcacccaccctcccagcaagctctagtggcattgttacttcaccggtttctcggaaacagaaactgtggctggggcaaggcaagcgccggatctcgcaggcgtgtgggggcctggaggtcccttgacagttctccgaacccggcgccggcctcgggatgtggccggggtggaggcggccgcagagcctccgcctgggtggccccggggccaggcccccagtcgaagtccgggcccagccgcccgcgccccccacccctggccgcccggaccagcgcccgcaggctccgtgaacgcccaggcgccggagaccccggctccccactcgcccgccgcccgtccccccggggacgcgacctgggcgcagcggcggagctccaggtcggcccgagcctacggcctcggcttcgttgtcgctgggccccgccgccgcgtcacgcgctgcgctcggtccccacccccgccccggaccccgctgccgtccctctcggcccggcccctaaccctcgccgcgggaagacgaacctgggatccccagggcccgggccctcgctgcggcctgcgtgtcctgaagctgtctccccctccaggcggcgggcggctcagcacccacacctgcacccgcctcctacgcagggccgaagctcccgaacgcgcggccgctccccggacctccgcactagttccttccttatgcggcccagggctccacccttgacccgcggtcccctccctagaggcaggacctgacacccagtgggctccttctttccctagggcgtgacctccgcaggcttcatagactcaaaggtaaaaaacctgaggtgctaggaggtggctaacgcctgtgatcccagcactttgggaggccgaggtggggaggatcgcttgaggtcaggagttcgagaccagcctggccaacatggcaaaaaccctgtctctactaaatatacaaaaattagccgggcgtggtggcacaggtctataatcccagctcctccggaggctgaggtgggagaatcgcttgaacctgggaggctgcagtgagtggagactgtaccactgcactgcagcctgggcgacagagccagaccttgtctcaaaaaataaaaaacctctgaggttttttatcaggattaagttcatgaatttcttccatcagtcaacaaatatttagcaagcaccttgttcaggcaaccaccaagggttgtgcaggctgtgtactgcacaaggggactggcccaggacacattaattgcagtcagggctacatgttctccgtggaaggccgtccttttgcagtttgccatgggctggtgggtggtgatcctgccctggccaaagcccttatctagctcacccttgactgagatagctaaatgtgaggagtacttattgagcactggattatagtccatgttcacactgctataaagaaatacccgagactgggtgatttataaaaggaaagaggtttaattgacttatagttccatatggctggggaagcctcaagaaacaatcgctgggcgcggtggctcacgcctgtaatctcagcactttgggaggtcgaggtgggtggatcacgaggtcaggagattgagaccaccctggccaacatggtgaaactccatctctactaaaaatacaaacaaaattagccgggcatggtggtgggcgcctgtagtctcagctactccagaggctgaggcaggtgaatggcgcgaacctgggaggcagagcttgcagtgagctgagattgcgccactgcactccagcctgggcgacagagcgagactccatctcaaaaaaaaaaaaaaaaaaaagaaaagaaaagaaaaaaggaacttacaatcatggtggtggaaggtgaaggggaagcaacgaccttcttcacatggcggcaggagggagccggggaaaccgtcacttgtaaaaccatcagatctcgtgagaactcactcactatcatgagaacagcatgggggaaaaccgctcccataatccaatcacttcccaccaggtctctccctaaacacccaggattaccattcaagatgagatgtgggtggggacacaaagcttaaccatatcacgcaccaactgtgtgccaggcaccattctaaatgcttcggcttcatccaatgtccgtaaagctgttggcaaagagtaacaccaggaggcagagcctgggtggcactgctgatctggcacaaggtggactcaagagctgcccagagatgtccacacaccccaaccccagcctgtggctgggcctccagaggaagccagcagtactggacggctgccaggtgagatacctgcagctcactgaggggtctgcccatgaacctgtttctgtgatggcctggttcctgaaatgccaacccctctgtaccttagacagaagccatgccattgtaccatctgcaggtccaggcaggaccacctaaagtctgcctttccttccagaaaccacagggcacaggttagactgggcacaccttttatttggctgcatgcagtagggcgaagtcaggagaacactgctatctttccagcaggacaagaggcaagttccaagggtggttggctgggagacagaggtcttgggaatggcagttctaggggtggggtgggggcttggaatgctctccaagccagagggggccgggcctggatttgggaggtggacaggggattcttcaaaccccctaccatactcatccagggctcatgtgtccagctgtcagagcaggtcccaatcctgctccccatctaccctgggacatcctgtacaggattccctcagtcctctgggaacctaaccccacctggtacccatctagcttctggggctccactgacagtgaggacagtccacacccgacctggaccccaccccaccctgggtctgtccatctcagtcccggcctgagcctctgggccaaagccacctcttctgagcaggcaggcagagcgagagactgggagcagcagacaggggcagagcacggcccatgagcccaccctccacttcccagattggtcagagttacatggtcacctccctgcacctgcaccatcagggcagctgcaagcttgccagttgtcttgcctgtccctgctccgagggtcaaagaacacaggtagaatggtcccaggaggggaagggagagacagatccaggctggcctccaagctcgactttctgaggggcccaggggaacatgctgcacctcccacatctcaggtgctccgtctctgaaaggggcacacgcaggcttccccggccatcattcaggtcaagacctttcggggagagctggcccgaccccagcatgcgagggctgcccacactgagaggctccacaaagaagaggctgctaggggcaagggttagaggtctggggacacctggcctccacctccccttcccaagcccagcccttttctgacagcagttgtttaccagtcagggttcagcagatgggggctcagggggtgtcagggcagcgggggcccgatggtgatgctgctgttggtgaccctcgggccgtaccagccggcccagtaatgagtgtccacgccgccgtgctgaaaccagatgtagcggacgccgggcgggtagttggagaatgtgtgggagacctggcagggcaggtagaggggggagaaaggtcaagggagctgactcaggctgggtgtggcggctcacaccgggaatcccagtactttgggaggctgaggtgggagggttgtttgagcccaggagtttgcaactagtcttgtcgcaaaccagagagtgagataccatctctacaagaaaaaaaaaattagccaggcatggtggtgtgtgcctgtagttctaggcaggctgaggcaggagtacaggctaaagtaggagttcaagactgcagtgagctgtgatcacgtcactgcgctccagcctgggcaacagagtgagaccgtgtctctaaaaaacaaaagaaataaaagatgagccttaacaaaaagggtgggagcagactctgagtgtggcactgcctgaggggggcaggggaacaaggaaggggctgagttcttggtgccagctagaaatcagtggagttctagtttgaactctgtgatttgggacagaccaattcctttctctgtgcttcagtttcctcatctataaaatggagcaaaatcctgctggtctactccacaggattatcattcagcccaaaggaatggaaagaaactgcaagctgccaaaggatgtccaatatactcatcacggggcacatgtattatttaggttaaaattaagtaaaagtgcccggcgcggtggctcatgcctgtaatcccagaactttgggaggctgaggcgggtggatcacctgaggtcgggagatggagaccagcctgaccaacatggagaaaccccgtctctactaaaaatacaaaattagctggcgtggtggcgcatgcctgtaatcccagctactcaggaggctgaggcaggagaatcgtttgaaccgggaggcagaggttgtggtgagctgagatcgcgtcactgcactccaacctgggtgacagagcgagactccgtctcaaaaaagaaaaaaaaattaagtaaaattagatgaaataaaaaattcaggtactcagttgtactaggaactggctcttactaactgttcagtggtcacatgtagctactggctaccttatggatagcatagacacagaccatttctatcactacagaaagttctattggacagggctggggttggcaaacgatggcctgcaggcccactgcctgtttttataaataaagttttactggaacatagccatgtccattcgtttacatattgtctagagctgttttcacacaacagcagagttggagagttgagtaattgtgacagagacaatgtgacctgcaaagcctaaaatattcgtatccgccattttaagaaaacatttgctagggctgggcacagtggctcatgcctgtagttccagcactttgggaggctgaggcagaaggatgacttgaggccaggagtgcgagaccagcctgggcaacaaagcaaaactccatctctacaaaaaaaaattttttttttaattagtggtggtgcacacctgtactcccagctactcaggatgctgaggcaggaggatgacttgagcctaagagtttgagtctgcagtgagctatgaatgcgccagcctgggtgacagagaccctgtccctaaaaatatgttaagtaaattaaaacaaacaaacaaacaaacaaatatttgctgaccccagtctagaaaacagtagtaatcaatactagtaattagtaacagtcagtcaaccttttggaattttttttcttttcttttctttttttgttgagatggagtttcgctcttgttgcccaggctggagtgcaatggcgcgatctcggctcacggcaacctccgcctcctggattcaagcgattcttctgcctcagcctcccaagtagctggcatgtgccaccacgcctgggtaattttgtatttttagtaaagacggggtttctccctgttggtcaggctggtctcgaactcccaacctcaggtgatctgcctacctgggcctcccaaagtgctgggattacaggtgtgagccactacgccctgccaaccttttggaatattttttggccctggctttgccagcatcatttcactgatttctttcagagctctatgagggaaacactatatacccattttacagaaacagcgagtgaagctcagagcattggaagcacaggtgagaaggtgcagagcttggatctgaacctaggccccgtctgaccacagcctcagccttggacgatctgcctctgcccccgtcccccaggcccacgcacctccctccacttggcatcgctcttctgctggatggtcgccgggtctggctggaaggtccccagaggcgcgtgcgcggacgacaggagctgaacgcacagctggtacttggacccgcaatctggcctggctgcgaacctgcagggagagggagggcccatcagggcctcggagattgggggcagggcgggggtggggcgcctgattggcatgccccaccccagaccctcgccccaggcactcaccagtccttgacctcgatgtccggccgtgtggtatccatcagctcctcccaatacccttcggccttgaggtccaccacctgggacttgaggcaggtgctgggggcaggcagaggggtgggaggggctgggctcaccactagggcagtgaggggctaggactgccccttccagggtgggagagaccccagggtaaattgatttgggctttcccctaccccaagtccccggatcttactaatatgaagtaacgaagtatttcttgacctggtcattggggaattccttcctctggtctcgagagagatcctccaccttccactcatcgcctccattcacatccaggctccagaactcgaacccctctgatggaaaagcagagttcacactgaagggaagcccctcagtggccgccttctcccaaatgccccttcctccccactcctctgcctgcatcttggcggctgccctcaagccctgtgctgtgggacgctgcagatcacagtgcccaccgcgtattaggtgcttcctgtgttgcaggcacagggaggtgacttccctgggggccctgagacacatggtgatggaaatgaccagacctcttctgtgatggagaacgctctgatgtgggccagacagacctgggtctagtcccagctctaccagtactcggttgtctgaccttggaccagttgcttttcctctctgacccttggtcgtctcctctgtaaactggagtaagaataggggctgagaagcatttttggcaaagtgccaaaatgttttaggacttgtggcccacatactatctctattgtatagtttttttgttgttgtttcttttcctataaccccttaaaaacacaaatctttttttttgtttttgttttttgagatagggtttcgctcgtcacccaggctggagtgcaatggctcgatctcagctcactgtaacctctgcctcctgggttccagtgattctcctgcttcagcctcccgagtagctgggattacaggtgcatgccaccacacctggttaatgtttgtatttttttgtagagatggtgtttcgccatgttggccaagctggtctcgatctcctgacctcagatgatccacccaccttggcctcccaaagtgctgggattacaggtgtgagccactgcacccagcccagctgccttctgtgatggacaaagctctgatgtgggccagacagacctgggtctagtcccagctctaccagtactcagctgtgtgacctcaggccagttgcttttcctctctgagcctcagttgtctcctctgtaaactggagttaagaataggggctgggaagcttttttggcaaagtgcgaaaatattgtaggaattgtgggccataaactatctctattgtatagttttttgttgtttcttcttcttctttttataacactttaaaaatgtaaaaacaattattagaacaattattaatgcctcagccagatttggctcatgcacagcttggaggagtggttttattatcattttgctccagaatttggtcatgttgtggaaaatgaggttcccatgccatcccagtgtcaacccaacaacacagcaagcaaggatcagtggaagccttgctttacctgttgttgtaacatactgagaagacgactggatctcccattcttccacaagcaaaacccctttggccttctgggaccatgtcagtaggcccaaccctggagcctagaaactaggccaacaaaatatggctctgacttcctggccttgtgtcttgagcagaattagtctcagttggccaacattccctcgcctaggaaaggtcactggggaaataatcttaagagcagaataagaggccgggcgcggtggctcatgcgtgtaatcccagcactttgggaggccaaggcgggcagatcacctgaggccaggagtttgagaccagcctggccaacatggtgaaactgtgtctctattaaaaatacaaaaaattagctgggcgtggtggcgggcaccggtaatcccagctactcgggaggctgaggcaggagaatcgcttgaacccaggaggtggaggttgcagtgagccgagatcgcaccattgcactccagcttgggcaacagagcgagactccatctaaaaaaaaaaaaaaaattagccaggtgtggtggcacatgcctgtaatcccagctacttgggaggctgaacttgggaggtggaggttacagtgagccaagattgtgtcactgtactccagcctgggtgacagagtgaaactccgtctcaaaaaaaaaaaaaaaaaaaaaagagtatagtaagaataagaaacaccactcttggcctcagtttgcccatctgaaaaatgtgtgcactaacagtagctacctctttgggttactgtgagagaagtaaaggtgttaaaccatccaaagtacccggctcatactaagtgctcaatacatgttcctggtgtcatgactgtgtactggaggcatgccagacccggcctgtaccccaccttcagcgcacgggttgtgcaggaggttcctgtgcaggctccgtaagaagtagaagatcttccagtcggccacgggctggtcccagtcctcagtgatgaagccctctcgcaggcacttgcgtttccagagggtcacgaggtcgatgaggtcccgccagaggctgcagaccaggcggcagttcagcagcagctggcgggcgggcacgtgcgtgaacagctccagcaggatgttctcgggcagctcgttgatgttccccacagccatggcttgtggcttctggacaccctcctgtagctgttgaaaagctatgctgcaggcctcatccctgctctgccatttatctcgggagagcatggtgcctctcccagcctgtttccttctctgtaaatggatgccttacctccaggggtcactggggcggtccaaggagcttgggacacatcaggtactttaataaaaggtgagctctgatttttttctctggcctctcacaatagaggtggaaggcactgcccaaggtcaaaaataagggcagagggggaagaagcccggatcttctttgattccagggccagcctttttcagtaggccagtctttaatggggatataatgcgcagccgggcagagcaccccaggcctccggtgcc

SEQ ID NO: 6373 - DNA, 1066 bp, Homo sapiens
tttctggacacgtggcctgtagcagcctggcatctgtggcgcctcgtgtggctgctggcatcggtgaggcatgagctatgagtgtgccagcctcgggcccttggttttgtctgcctctggcatgtttgcattggtggtggagctgacctttgccccttagagagtctcctgtggccttcaacggggaatgggggccagatgatagcgcgggccttgtgctgcgggaaaggctacttcctcagtcagaggtcatctggagggttctcccctgcggttggaagtgttcatgcaaattccagatctgtcctggcccagcttggaggtgggccttcctgactgggccatcccttgcgagcgttctcagcccacactggctccctctgcgcaggcccctacttgtgaaggagctgagccgcactcggtgggctgtcctggggcacccatgttgtgtgttttggttttgtttattttgtatctgcctggtttttccaagtctaatcaggatgtcccctggggtgacattctttgctgagagaagggcacatgcctcggttccctgggctgtagaaagccagtgctcagccttgctttctgccgcagacttggtgcccggagactcgctatcaaagtgcagtggagataatgtccaatgggaggctgaggcaggagaatggcatgaggcagagcttgcagtgagccaagatcgcaccaccgtactccagcctgggcaacagagcgaggctctgtctcaaaaaaaagaaaaaaggaaaaaaatggttatctgcatcctggttaaaatcagtaccaccacgtcccacacgtggtaacatggacttgctggataggacctccttgctccatgggcctggaagcagctgcttcagaaggaaggtggtgcggccggcggcagcggagggcgcgctgtgcagtgacgagatggtgcaggcccgtccacagccctggcccagagaaggagagacctcactgacccctgctgggcctgcctctggccatcttcattttgaaattcggtatcattgtctccagagggaatgagcagctcttt

SEQ ID NO: 6374 - DNA, 692 bp, Homo sapiens
ataaaggtgaaagtagctctctagtagcctgtgacagggaggatcatcagacaggtgtttacttccttcctggattacttttccaggagacacccagatgtggcaatagctcttggggttttgggctgacgtacaggagctgaagctgtgatgtcgcgtgtccgtgtccttaggacagtgttaagtggggagctgcccccatcctgcattctcagcagatagcaggcatgtttgccagccggttggttaaacaagctctgaaaacataaacattgatggttttggtggtttcatgtgttgtcgtgtgacgtaagcagatgctaccacagcagagccagaggtgagcaagacgtagggcagagaatcccactcacagtaacacaggaactaaaacagctttttaaaatgtgtttgcaggccaggcatggcggctcaagcttataaccccagcactctgggaggccagggtgggaggatcacttgaggccagaaattcgagaccagcctgggcaacatagggagacctcaaatcaatgtttaatgacctgggtgtgggtggtgcacacctgcagtcctggctactcaagaggctgaggtgggaggatcccttcagcctggaagctcaaggctgcagtgattatgccaccacactccagcccacatgggtaacagagcaagaccctgtctctaaa

SEQ ID NO: 6375 - DNA, 643 bp, Homo sapiens
tcacgagagggggcacagtcgtgcagcgggaggagcgagagtcggccactgtttgggtgccatgggtgtcctgggtagagttgagggcctcccccgggaaggataatgctgagccccaataggaaacactgccctgagctatctgatggccagccctctgtccatgggggagccatttcttttccttatctctaagctaatacccctctttcctgaggttctctcttactgcctaagctgtttggctctgggagttactggctagcttgtccccgtcgggatctcatccccatcggtatctctggcagggcttcttgaccagctcccccctggacctgcggctggagacggagttgtgccgctctctccgtcctagtttgccttttgaggcttacccactcctccacctgggctgttttaaaatgattagagcagaacctttcaatcaattctatcaaatgcatctgtagagctaagggggcggtcccttatgtgaaacctaatctttatagctaggccgatgggtgtgctcaccgccgaggcacgtcattacgatgctctttggctagtcattgtcattagaaatgtaaacactgattggggaccttcccgcaggagctgtctgggctgcctgctgtctcca

SEQ ID NO: 6376 - DNA, 1118 bp, Homo sapiens
gactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtggacaagaagatgcagaagaaaatgaagaaagctcataaaaagatgcacaagcaccaaaagcaccacaagtaccacaagcatgacaagcattcctcctcttcctcctcctcttccagcagtgattctgactgaatacaggccctggacccttccctcaagtcccaccagttctgctctcccatcaagcttcagatgccacgttgtactgggggaatgtagcccttgtgctccccaccccctacctccacctgagcctcaccctgctgttgagccctgagtggctaggggaaataggaagaggattgccatggcctggccatcttgttgctgcttggagagatcatatagctaatgaattaggcaggggagctattttttgaagatgatgaactaaatgttgaagacaagtttgagatctgtaaaatgtgattttttacttccacttataatacttgtgattggggaggtttgtggaaattcaattatgatgaaaaacctctatcttttttgtaatgttggcatacttgggggatttagtggcaaatacattccccagcaggccttttgttggttgcactaactgcaaggttgctgggaagtagagtccatttggttgatgagctttgactgcggttttggaaccttacctctcctccttagcccaatatgctgtctcgggtcctattcaaataaagttatttctcctggtctaaaaaaaaaaaaaaaaaaaaaaagaataa

SEQ ID NO: 6377 - DNA, 415 bp, Homo sapiens
ttgaggaggaattatttaattattcaggtgcaccgacccagtcagattaacatccaaaggactgagccctgaacaaagagtcaagctaccttttaagcatttcgtggggctgggggagatctgtgcagggggaagcatatcacagaagtgagaaacaaagacagtcattcaattgagacatgcattatatcatttttttttcaaggaacagcatgttttacgacttgagattatctgtctagtgatcttacagctgcacagctagagaaacagagtcttcacaatgcctgggaaagggagagataaggctcactagccatagaaaaacaggcagttaattttaaaggactccagctctttctcttcctcagggggaattgggttttcttacatacaactaagttttgcttacaca

SEQ ID NO: 6378 - DNA, 101 bp, Homo sapiens
tagagatgggggtttcaccgtgttagccaggatggtcttgatctcctgaccttgtgatccacccgcctcggcctcccaaagtgctgggattacaggcgtga

SEQ ID NO: 6379 - DNA, 13191 bp, Homo sapiens
catttcattatctatctcttctgagcctgttgtatctggagcagagctgggcaggaggtggtaagcagaggctctggggcctcctagaccctttgcagagggaaccggagatgtcttccaagtccccaagtctggcaccacctcgtctcaatctcactttcccctccaggtctagcagacttggcctccatccacagggccttcttagcgcatgccctcttcgcacttactcccacttccctccccatccctcgatcctctgtccagaggtcccaagggcctgttcagaccctgaactctgcccagcagcccctcactctgtcctctaccagggcgccttccctggggctcctgctcatcctgcagtgcccctcccctcccaacccctgtgggggtgtcccatcactttccccagcacccacttcccacaggccttccctcctcccctgcctgctgacccggcagctcccgacagcacggccttgtttcccagggaacaatgcatctgtgtcacggacaacaatgtcctttcatgtcaggcgcactggccccggtgcacgccgggacgtggcacaaagggtgctttgtgcagctcagggatgtgagttcctggctttgccatgttggtgctgccgacccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtaccagggatcctgccacctctgccaccctgaccacgggatggggacaaaccaggctgctcatcagaatcctctggaggagggttgttaaaaatacaggccttacctgaataggtagacatcgggaaggggcgagccctggaatcaggaaaccactatcagagggaggcctggctccgctgttggcctcagtttccccatcaagttcagagagggggccctgacagtctccagggtttggcaagcacctgcagtgggttcacgtcatgctgattgcatgccctctcttctcttgtggtcccctgacagcagccccacgagctgtggtatctttgattagtcccagcttcaaatgggagggagttaaggcacagacgttaagtcatttgcctgaagtcacagacagagctggcacctgaccaccagccagttgacttcttggcccagctcctaactcttccccaagtgacacgtggtagcctggcccccagtggattatcagtgaaaatgatggctgctgagggccccgggggcaggtttccagtggacagggcagccccacccccaggcagctgcctcgttggccttttgggaacagaaatgtctgggtgtccgtcaccagcacacctctcttcctctgtttccacacctttcacctggccgggaaaacaggctgtcctaacagcgcctctgcaaggggacccagggagagcctatggtatctggagcagagctgggcaggaggtggtgagcaggggctctggggcctcctagaccctttgcagagggaaccggagatgccagaaagggtccaggctgattgtcttgggagctggagcctttcagcctcagtcaggctgaaaagcacaggcacagtagccctgtgcacctcaggccagatcaagggagcctgggggccaggtagccttgggttcaagggaagctcccccacatcctgtctgcaaggtcttgggagtcacttcccctctctgagtcttggttccctcatcaacagccttgggctagctaggatgctttcatggccgagtgaataagccatagaaagcctcaacctagtggtcaccctttctttttttttttttttttttttgagacagagtctcgctgtcacccaggctggagtgcagtggcacaatctcagctcactgcaagctccacctcccaggttcatgccattctcttgcctcagcctcccgagtagctgggactacaggtgcccgccaccacgcccggctaatttttgtatttttagtagagatggggtttcaccgtgttagccaggatggtctcgagcccctgacctcgtgatctgcccgccttggcctcccaaagtgctgggattacaggcgtgagccacggcacccggccgaaagcctcaacggagtggtcaccctttcataagtggtgacgtcaggatctgtgctcctcttttccacttgctcatctctgcctgtcactccatctcagcctagattttagggcccaaatcttgccacatttgggctgttgttagtttgcaatggcttcatgctttttcatcagactttcaccaaaccctgcccaccacctgctgtgccaggccccatgagccctcttccctctcctgcctgctgggttgagctctgtggtccttacacagggccggggtgagtgtgtggcttcaccatggagaagctcattgtctaggcctgtagctgatggcagtccgctcactctgccaggcgcagggctgagcccaggcctcaccttgctatgccctcccctctggtctgccaggcaggccttggttccatctctgtcctccacacagggaaactgggctcagagaggttagtggctttgccagagcccccaagccaggagggggcagagagacaggattggaatccaagcccttctgaggccagagccgaaaggctgcagggggccctgcgcctgggcaggctgtgggtggtcagggcatagctgattgctcccctcgccacaggtcaccattggtatgttcctgctctctggagatccctgcttcaagacgtgagtgctggcacaggcctagggagcggatgggagcccagtcccgggcactaggggtggaggaacagggactctgggtgtcctctgttttcatctggtcctgaagcagggcaccctagtcacacctgtctgtcttcccaaggccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcaggtacagttcctcatctgtccgcccctcccctgctagcggcccgaggggtttacctccatgtcatgcccaggtccccagggagacgctgactgaggggagagtgatggtgggagggtgtttgcatgctcctgctgggctgatgagacctgatcaccttgtgcgtgctggctgtggtgctgggccctgagatcacagctgtgccttggactgagactgatgtggcctccccatcctcaaggccctgcagtctagcagaagaaacaggcctcaatcaagccatagataaatgcatgtctacctgcaaacaggataaaagctggggaagacaggcccagaaggtgggatccatctggggccagggaaggcttccctgaggatgtagtatctgagctgcattcagggggtgaggcacagtatacctggcagagggacgtgctgggagctcttgctctcccacatactctatgactttgactggccagtttgcgtctctctgtctcagtgttctttggaaaatgggattggtaatagcaattacatcccaggtcactttggggattaactgtccacatgtgggcacctgcccagcacatggtaagcacttagtgggcactctgttttttgtttatgtttttttagacagagtcttgctctgtcgctaggctggagtgcagtggcgcaatctcacctcactgcaacctctgcctcccaggttcaagcatttctcctgcctcagcctcccgagtagctgggactacaggcgagcgccaccatgcccagatataccttttttttttttttttttttgtatttttagtagagactggatttcaccatatcagccaggatggttgccaggatggtctcagtctcctgacctcgtgatctgtctgccttggcttcccaaagtgctgggattacaggcgtgagccaccgcgcccggctgggcactctgtttttattaaattatcactggtactaatgttatgaaaaatgtgaacgagccccaacccccagaggagatggtgtggcaattaggaggagggggtgttgccaggacaggaggctctggcctgcccccaagtgtttgctgggccccctcaaccctaagcagggcccccagaggtatgagccttggactgcctccaggctgattagtgaacaaggtgtcacgtgacaaccctgatttgtcccacagaatcagttagagcacaggcctcatgtggcccagcagatgcttgccgagtgattctgcctctgggaactgagagcagtgagagaccctctgacctcaagggcccagcttccctccactcccttttccactgcagacccagctagctgaggcccagaacagaaagctgggggcttcccagcacaattactctctccagcccctggatggggttccccagaagagagatgtgtctggggactaggccaccccagcgcaggtggtgccttcgtgtgaagtagaagaggcccctcccccaggcagggtgagacttgagtgcccacttgcctctggagctggcctccccccatatgcagagaacctgttggggacttgaaaagccacatagttatggatgggcacacaggccagcctggggtgtcacaggccagcctggggtgtgttgggcgggaaggcaggtggatactcagagccctgggtaggtcccacctagtcccttttgcctcctgctggggagtgccaggaaagtctgttttgaagttgggcttatgggtgacttgggacaggactgtgggcctgtccctttgggccagaccgctcgccctcaccatgtcccttccactccaactccgctgacccaggccccttccagcctcggggcctctgccgatgctgttctctgtgcctggaaagcccttgccctcttgaggccttagctggctccctccagcaatgtgtcctggaggtctgccattaaggccgtctccttggagaagcctcccctgtccccagactgggccagacccccagtaagcactgctccctgctgtgcacctctcactgcggttgtgggtagtggaggcagtttttgttcagcgttcttcttcctcgctgacctgtggtgggcaccccacccaagtgtgccctctgtggaatgaagggacctgggttcggagggtgacctatggctcaggctggttgctgctcctctgaacctgtttttcagtctgttaaatggcgccctgccatgggaggctctgtgagggcacgttgtgaagggcgacagtgagcagcactgggtgacccctgtcacctcaccccctgccccttcctgccttccagggctgccagaggaacccgaccagaacctgtccagccctgaggaggtgttccactctggccactcccgcaactccagctatgccagccagcagtccaagatctccggtgagtggctgcctggccctgcccccgtggcctcctccttcctcgggatcccccattgtgatgctcccctgcgtcgcccctgacaggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggtgaggcctactgcttggtgccccctggagaacagacctctcccggtggtgccttgaacctccgcttctttacctataacacagggaccgtaaggtccccacctcagagggttgggtggtgacgattccactagctgatggccctgaagggtgcagccatgcccggcgtgcagcaggttctgttcatggctgctcttgcggttttgtggatcagacaagagcacgatctgctaggtggccttaggaagctgacttacctgctcattgcctggcatcctcgtctataaaatcggctcatgatggcagctgcaccctattgtgcatgtgaggtttcagtgaagtacagcacggagcgcacagggacattctgagcgccgctgcggctgactggcattattgtcgtcgttctgtgcttgtacctgttactgccctgaccgttgtgacttgtccccccacgacctgacccaggcggaagaaggactcggtggagagccacccgacctgggtggacgacacgcggatcgatgcggatgccatcgtggagaagatcgtgcagagccaggatttcacagatggcagcaacaccgagggtgagccgtgctgggctggtgggggcgaggccacctgctccaagggctggccctgccgcgctcagcctccatcctctcctgtgtccccacagacagcaacctccggctgttcgtgagccgcgatggctctgccacgctgagcggcatccagcttgccaccaggtagggcaggcttagggaggggtcgtcggggcggctggggcttgggggtgagagcagagtccccacagtccactcacctggccttgaacgccaaatcttgtcgccacagtgtgaccctgggcctgtcatgtctctgaacctccctttccccatctgtcaggctgtgtggacaccaccacctcacctgggagcctggggcagtgagggcacggacaggttcggtggtttcccacagttcacaaggtcacctccagcaatgcctggtgcagggctcagcacatggcaggggcctcacacgcatttatttagaaccctcccttctacttcctcccagctccagggactcgggaagaatggtggtggtgatgcctcatgggtttactgaacaaatctttccctagcaccagctaggcactaggccctaagtgaaggcctggttcaatgcaggctgctgcctacacagcatccacagatggcaggggtagatgggaccaaagttgcgggaacgacagtttatagagtgctgcgtcacagacattcatttggagcatgttgactatgtgcctggctctccatgtgctttggctaaccaaatgaatgagcgagtgagcgaatgagcttcccacaggcgggctgctgagggcaggtggggagcccgcctaacatccacatccccagggaagaggcgtggccaggccgctgcgcagaggctaccctctcaagctgctctgctgactcctgctggccacggcctggaatggcagctatcacctcccagtagcctcctgggctgctctcgggtgggggtgagggggcggtgagcaagaaggaaactgaggggctggcttccttatgggtttgtaaacacacccctccctggccccctctgaaaatgaggaagcatcttggggaaagaaaccaatctggttgggagcgagatcacagcagagctacatgctgagccccgagagtccccgactccagggctgggcctgggctcggcagggaaaggagctgaccaggtttcctgacttcccactgccctcttggtcaccctcacatccctctgagcctcagtttcttcacctgtcaagtggggcaggatgcagtgactccctgccgaggtgaccgtgaggatggggtggcacagccagatgtgcccggaagggctctgcaggccccacagactctgatgcttactatctgtgtcactgtgggcaagggacttaccatcgctggggcacggttttagcccctttgcaacacagggctggttaacagtacctgcttgtgaaacacctccagaggcctggtccagtggagcgctcaggaaatggggtatcgagggggacatgctgacctgtctctcacctgcagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttcttttgctgttttgtttttaccttgttactttatcatattgactttagggtcaaaggcaacatcagaagaagtcagatatgtatagtgacattccaggggtggggaaggtgtagggatccagggttctcccggtcttggccacaggcacaatcatcaccttcatcgttccagattcctggggagaaaactgagaagatcgttacctgccagcctcatacggagcaaaagctctgtcctcagggccaagttctaaccactgctctgtagaccttctctgcaatcaagtggcctctaaggagcatgcctgaggacaaataactgcgcctcagtttcctcacctgcagatggggttatcaaataacacgagtgtgcagcctgacctgtaggaggtgtgagtgtgttcccaaactaaagccccaggctgccatcatttacaggcttggcttgccccgggcccctcacccccgtttctgaccatcccaagtctctctgggacaggcaagtcactctggttctttaataagcttggaggtgttgggaagcttcagtggtactggccaggccaggaggaatcaggccaccagggctccatctctatcctgggatagcattcaccccactcctcctcagggctgaccccgactcatggcccctttaaaccctgaaggccgattctgccccttcctctgttatatgcacaactgaggaaggaggtaaaagtgggctcctaggtgagcccaaagtctcctgagagataagggaaaagaattggactgtaggtttaaaaaagttgctcttggccgggcacagtggctcacgcctataatcccagcactttgggaggctgaggcaggaggcagatcacctgaagtcaccctgaccaacatggagaaaccctatctctactaaaaatagaaaaattagctgggcgtggtggtgagtgcctgtaatcgcagctactcaggaggctgaggtaggagaatcgcttgaacccaggaggtggaggttgcaatgagccaaaatcgcgccattgcactccagcctgagtgacagagcgagactccgtctcaaaaaaaaaaaaaaaaaaaaaagttgctcttgtcagctttgggagggcagactccatagttggagatgggcttccaaccaaccaaggagataaatgccagagggagcgaaccatgccaggctcaaagcacatctctccccaaactccccaggtggggacagcaggccaaaggcctccacataacccctcagggaggcctggagtccagatgctgtactccagtatctaaacaatcactcaatcttaaagctgacaggttcaaagctcttactttgggccgagcgcagtggcttacgcctgtaatccaggcactttcggaggctgaggtgggtggatcacctgaggtcaggagtttgagaccaacctagccaacatggtgaaaacccatctctactaaaaatacaaaaattagctgggcgtgttgacacgtgcctgtaatcccagctactcggtaggctgaggcagaagaatcgcttgaacccaggaggcagaggttgcagtgagctgagatcatgccactgcactccagcctgggtgacagagtgagactcccgtcttgggaaaaaaaaaaaaaaacaaaaaaacctctttctttgggccaagcctccactgagtgccagggatacagcagcaacctcagaccctaccctcggggctgacagggctggatcaacaattgcatcagtgaattaaaaggcacaggaggctgggcaccgtggctcacgcctgtaaacttttggaggccgagttgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgcccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcac

SEQ ID NO: 6380 - DNA, 1316 bp, Homo sapiens
cggaaccggatgtggcttgcggctcgggtggctgagcgcgcggggaaatggtgagattggcaccgtgtgccggagataggggcgtctgggggtggggtcccgggtctgctcaggagctggggcatgggcacttggaacggggattgctctcccgcccccactattgtacggacgacaacgcggaggcctagcattctctcccagcctagaaactgatccctagtcagccctctaccatctgttgaatgggaagcttagaccgtgatcgggccgcgacgccccgcttccattagtgcgccgaaatagagggtcacttcgtcagctgagacctcccttttctccaggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtggg

SEQ ID NO: 6381 - DNA, 309 bp, Homo sapiens
ttcttttcttttctttttttttttttttttgagatggagtctcgctgtcgcccaggctggagtgcagtggcgcgatctcggctcactacaagctccgcctcccgggttcacgccattctcctgcctcagcctcctgagtagctgggactacaggtgcccgccacctcgcccggctaattttttttgtatttttagtagagacggggtttcaccgtgttcgccaggatggtctcgatctcctgacctcgtgatccgcctgccttggcctcccaaagtgctgggattacaggcgtgccaccgcgcccggcc

SEQ ID NO: 6382 - DNA, 5959 bp, Homo sapiens
tttaaaagtaaacaaatctacttttattcagaaatgatgctttttaagtaagggtaggaaatcttcattttctttaataactaactctttttccctcttcctaatttaattcaatttttacagaccccctattgataaagatgtaagatctgctattcattgtctttcttatacatagaagtaaaatcacagaaataattattattttatgggaggataaaacatttatttaaatggaaacactaatctttattttcatcatgctgaagtgtgtggttacaatttccaataaaacactatatataataagcaaaataagttagtacattgtaaacttatgcacagtttcatcaattaacagtttaagaacaaacaagccatttaagactttggagctacatttagtaaaaaattgcaaacactcaaatcttatcaaccccaagtaagacagtaaagagctattcaagacttcttcaaaccaattacacaaatacatgtttatttttggttacagtcccctgctatgcacaagaccattggaatgctggaacaattacacattttaaaacggcaaaaagcaaagcaaggagataacatgccagccttagagaagctgtcttgaaagtgcaaactgcgttttctcttcctgaaccactaggataagaacgggtacctcagacgacacggcagggtcatgagcatgctttctataccccactggtgggacatttactggaaccaggtctccatgcctttgaagatacctccggttttaaacagtgaacaggcttcaactaaatatagtgcaaatcaaataccaaggagcaaaacgacagaatagagactgtcacagatgattgacttcctgtttctctacctggcacaacccacatgggacacattggcacacggtaacaacaacttctatttaggttttgatacggaaggcggtgcggcggagcgaatgcagggcaaccacgcaacagcccctgagcaaggccccgatgttatacacaggatccgttccccctctctgagtactgaatgcccacagaaccgtggggaccacgggggcagccacagccaggagatccaccaggaagctgctgctccagtactgcctcacgacgcccccgcgagccagtgggatgacaccatccaacctctcttccacgcaggctgcaaaatccagctctctcatgaggcggtttgcatgaacttctgcatccacattggcgtagggggtctccacgggagacaaaaggatggctgagtttggatttcttggagttaaatcaaccactaaggcagagagggactctgggaagctctccatcgagtctggttcagactcatcaggggacgccaagctcgagggacaggggtcctggagcttctgcagcacactctgaatgagctctgagatggctgggctgtagggcaccacgtcggtctgaacggctcgctccaccaccacactgccctcctcctgacccatgactatgggcagcagctccaggacgttagccccaggggtggaatgcacaagctccaggtcaccagattctgtggtggtggctgtcactatctcatcgaacaaatctgtgctgttggctatgctatctcctaccagtagctccctgtcagccccttcccccgtgacctgctcttccagagataacccatctgccattgtgtcaagaggggggttgagggttaagctcttctctggggaatcacatggaaagtctaggcacagttcgtccctcagagagccactgtgtgccatctccatgctctgaaggagagactccagcttcttgttttggatgtttatgtccacaaaatatttctgaatgcctttatctttatcagccaagctgctccgcatggtttcgatgacctgtttgagctgtttaatctctttcctggcttctttgagtgccaactgggcctctacccggtgacactcctcctcaatccagtcctctcgcatgcgggccagctgggacttaagctccacgatttcactttccctagagtgccaagacaagcatggttaattaaaaaaaaaaaaaaaaaaaaaaaaaactttcaactgggcaacaggcagttcaggcagttctggcacagagccaagagctcatactcttccacttgaaatacagatgtgaaatcagttttcaatgcagggaactcaagagaacacagaaaaacttgagaaaacactccagcctaaactgaaagaagcagtacattttctctttggcggagattagctgtgaactttctctttacttgtaaaatggctaaagtaataatagtaatcagaatcagaatcaaaatagctaccacaattttttttgagtactcattatgggtcggatattgcactgtgttacaagtcttatcttctactcaatccttaatatttgaaactttattattagaacatcttagcatctgttagcctgtttttatctccatatcctaccctttccaaatgtctatagtttgtggaaggccagttcacttttaattacctaagacagaaggtagactgataagttttagccttgctaaattgttcatatggtattccaatgataaacatttttgaaataataaaatgctacacgtggcagggactttacatgatgacaagctgcttattctgtctcctctcaggtaggataatattgaattcatcctacactaaggagaatctatcctatttttcagatccttcacaggacaaccctatttcaagatctttgtatataaattctttcttatatataattttttcatattcagtccttacattctcagtggatatgaagatagggtagtcaggatcctcatatatatgaagagacatcaatattgctcatttaagtttaggctagaatattttcccaagttttgctgcattcccattccttcctcgagtgctccaatcctcccatggactctgcaaatcacagaccaaacacttccagacataaggtctgactcaccccagaggggagtttgggtctcaagtctatttcagacagatgatgagccagattaattcggaagatgaaaaatttcccttcctcgcagtctgcacccttacctgcccacagttttagcaaccaaggtattgagttttctttatatctttgtggcagcagaagaggaggtttgggctgatcaggtagcccagactcttagagaatgcacatgccaccctcaccctgagctcacagctaccctggtcagagctttcctggtctgttccaaaatgttccaggggaaaatgatcaagcagaaaaactggcctgctgcccagatgtcaaaagtcttctccctcagataagatctcttaagcatgggctttttttttttttcagccttaacacttggccaagaacaatgagccccttccttcggcacagaaatagcatgcaggaatcacaatgcacacagatatccattcatgcacggatataaacacggcttaattggtccacggttgtgacccattctgctggaagtatgggattgttcccgcacgtgtttttgccatttaaaaatagtcatgcacacacctgattatttcacatcaaagctgtatacactgcaaaacaacaacaacaaaaaacgacaacaacaacgaaaaacaaaggttcccctctaacctacgggcctccctgaactcctgaaacagccatatcacacagagttatgaaatgactcttttcagaggctgactttaaaaatttgaccaaaattgaatacaatcattttttcttttctatctttctatagtttgggttcatatttcattttatggagaaagaagttgtcctacaccccaccgttcaaggaaggcagattcacctttcatggagtcggcgctcagattccttcagcttggttttgaggtgtctcactgtcacctctttctgctgcagtggagtcaaatactgctctgggtttgggggtctgacaccatgattttcaccgcaagacatgtaccttccagaacgcctgaaacaatccaagtaatgaaatgttactttttgccgtttccttttctataaaaagaagagtaacacagagtgttatcaactgaatgtctgtgtccctccagaattcatatgttgaacttcttaccccaatatgacggtattaggtggtgacgactttgggaattagcccataagggtgaagccttcataaatgggattaatgctcttataaaaggaaccccagagagctttctagctttctttttccaccctgtgaggatacattaagaggtcagcagtctgcagcccagaagacagcccttcccagaaccagaccttgctggcaccctgatctcagacctaaacctacagtatgtagcccatggttctcgaaagatttggaccaacatctagagtactttgttatagccacccacattgacccagacacagctaacagcttgagaaggaatggtagctgtgtgctggggtcttaaacctcaataatgggtgacctcacttcagaaggtgagctgtaatagaattgccgatcttaggactgttaattactttgaagattgaagggggtattggtgtatttatggagagaatagggaccgtggaggaggagaattctctatggcttaggaatgttctcatacaaaataatgcaccattgtccaggtgcctgagctgtcagttcagagtaacatgcagcacagtgggtgagggtcaggggatgggcccgggcagaagagaaggaagccagccagaggacctaactttctgcacagtgtgccactgcctaaagatcctgatggctatttgctgaatgcaagttgttctaaaatcaatccctgctgtgagtatgccagtttggaggaaatggaaagatccttcttctgaagggaagaagtttcttcctctacttaactctccccagtgtgttttgtaagacaggctcaatgttttacaaaacagcccttgctggaatcttggcccctctcaggcctggctgggagctgggaatccctgctgtaagagagctgactgacgagaatagggatgcccagcaggaagaaggccgaaggaggagggcagccagctccttccctgactctggacccagtcccagccactatgctgccagctccctgagcacctgcctgcctccaagatgacctgtgtccatgcccaccatccagtcctcctgtcgtggcctctttggaaatgcagttccttctttctgctccacactccctacaatctcatatgaattaacttgttgcttgctcttcagacctcaattccatttcactttctcagggaggccacccctgatcgctccagactgcgttggacaccctccccacctttcacacacccctgtagcaacaggtgcctacagaatcatcttaagttgtttttgtttgtttgtttgtttgagatggagtcttgctctgttgcccaggctggagttcagtggcgtgatctcggttcactggaacctctgcctcccaggttcaagcaattctcctgcctcagcctcctgctgcctctgtggcattttctctccctattcaggaactgcttagattgctgtgccttgttagaaattgtggcttgcgctctttctgcagcagcccttgaggaatgagccgaatgtgggaaagaaaaatgcagtgtcttgtagaatcaggcaagggatcaagagttgtataacttttttttttcttttttaaagaaaagcttaccaagtaggacaaactaagatgcatgaattaggtgagcaggactcacctcatgatggggctacagtcgcttcctttgtaggagcctgagttgctactgcttggggaagaaggtgcataactgggatggatattgacagggctcagctgattcctgcacagcatggacagaaggtccttttcccgcgg

SEQ ID NO: 6383 - DNA, 755 bp, Homo sapiens
accatatacttaacatgtatccctacggtaacctagtgaggtgactctcactatcgccatcttacagataagaccactgaggcactggctccgggcttctcatccagttggcggcacagaggagtccaaggtcaggttgtctagagtccagctcttctcacgaccctagtccgcctccacagaaccagggacgccggacaaggaggacactgccttcaggacccttctgcggaggtccctcatggtgcagaagttgggagtagaggcagaaacagctgtgaaaattctgatttgtttgtttctctgagccaagctaaagtggataatgaagccaagctggcgattaccttcctgtgcgtgataatggtggtagtggtgatgctgactgcagcaggatgacggtgatgtcagcagcgacaccattggtcttattgatggtggcagtgcccagggtggtgtgggggtaatagcatgagtgggtgctgggatgctgttagtgatcctgctagggccaggttagcttggaggggagagtgatgtccatcactgcagtggtggcaatgctgctagagacctcctgagtagttggactcgggctggcattgctgctgggaccttccctcacccccatcaggaagacccctctgctcctccccaccctcagtgaagggggcagggctcagagccttccgtagaactggctttattgcattccctgttctggacagtgtaagcgatggccctgcctctcgaga

SEQ ID NO: 6384 - DNA, 555 bp, Homo sapiens
aagggttttggcctgagccactggaaggctttactgagatggggaagactatgggagaggcagttttcacagaagatccagagttcaagtccgaacatgtcaaccagaggcacagcggagaatgtggcggtgcatcccaggcgttgggaggtcagcccactacctggccccgaatgcacgcagctcccaagtctccccagctgggcaaagacactctgacttctcctcccatcctctcctgcccccttccctgttggaagttctccctccactctaactgaaattccctctctccttggaccagccccttctgctccccattgaatggccaagtgcccagatacagctgcatttaggaacagggaaggagaagaaaataaggaacccagaagattcctgcctgggtagagtggaaggcagtggggttgttttcctctcctggcaacttaagaagcttgtaccaaaaaataaatgtggagtgagagtaaccccaatctcacttgggtcagagtaatcaaaatgtaattgggtttgtgaataactaatgtttaccct

SEQ ID NO: 6385 - DNA, 1213 bp, Homo sapiens
aaaagattgttttctctttcaaggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcag

SEQ ID NO: 6386 - DNA, 1213 bp, Homo sapiens
aaaagattgttttctctttcaaggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaatggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttccaattctgtattttgtataattgcttattttccataaactaatattagtcag

SEQ ID NO: 6387 - DNA, 807 bp, Homo sapiens
agggttctgtctttctctcctgggacatgtgtctttgacaccctgagccaccatgtaagaagtccagctaccatgaagccgtcatgcagaagagaccatgtagagacatcacacagagatagagggaggcacccaggagccccagctgtttcagactccagatatttggatcatcctgcgcgggtaccagacatgtgaatgaagaagctcgtgagatgactgcagttccagctaccatcggactgcaacatcacgggacaccccaacccagaaccaccccactgaatacttcccaaacaccaacccacatgaaccatgagagataataatgactgttgctgtttcaagccactaaaaaaataaaaatatttttttaaaaagtagaggctactgatggttgaattgaaatgatgtgtctttatggtaggagctcaataaaaatcttagatctcttgttgacagtgcataaaagttaccagtagaggtcatacttgattaatattttcatatcctcttttctgtaagtatatagcttaataattattattcagtatatgaatataagctcagtaaaactgtatcttggattgttacaagtggtctgtttgctaccttctgtgaattaccaactactgtgtaaaaaataagtactggcttagtgaaatatttaccattaaaaccatactgagctgggctgggtcgcatgcacctgtagtcccagctactcggaaggatgaggtgggagaactgcttgagcccaggagtttgaggctagcctaggcaacacagcaagaactcgtctctaag

SEQ ID NO: 6388 - DNA, 807 bp, Homo sapiens
agggttctgtctttctctcctgggacatgtgtctttgacaccctgagccaccatgtaagaagtccagctaccatgaagccgtcatgcagaagagaccatgtagagacatcacacagagatagagggaggcacccaggagccccagctgtttcagactccagatatttggatcatcctgcgcgggtaccagacatgtgaatgaagaagctcgtgagatgactgcagttccagctaccatcggactgcaacatcacgggacaccccaacccagaaccaccccactgaatacttcccaaacaccaacccacatgaaccatgagagataataatgactgttgctgtttcaagccactaaaaaaataaaaatatttttttaaaaagtagaggctactgatggttgaattgaaatgatgtgtctttatggtaggagctcaataaaaatcttagatctcttgttgacagtgcataaaagttaccagtagaggtcatacttgattaatattttcatatcctcttttctgtaagtatatagcttaataattattattcagtatatgaatataagctcagtaaaactgtatcttggattgttacaagtggtctgtttgctaccttctgtgaattaccaactactgtgtaaaaaataagtactggcttagtgaaatatttaccattaaaaccatactgagctgggctgggtcgcatgcacctgtagtcccagctactcgggaggatgaggtgggagaactgcttgagcccaggagtttgaggctagcctaggcaacacagcaagaactcgtctctaag

SEQ ID NO: 6389 - DNA, 129 bp, Homo sapiens
tttttgtatttttagtagagacagggtttcaccatgttagccaggatggtctcgatctcctgacctcatgatctgcccaccttggcctcccaaagtgctgggattacaggcgtgagccaccgcccccgg

SEQ ID NO: 6390 - DNA, 11003 bp, Homo sapiens
gctaggagacctgttctgatgatgtgtgtggtcctcaccacactgccctgcctcaccttttccatagcagtgactgaggtatggaatttttgatttcttctgctacaagattatgagattttataatttcttgttattggaatttgatagagcagcgtgctcaacaaatttcttgacatctatgtaatccaatcttcttccaggttgcaatatatgttatttaaagtactgagatcattgttacctctgtgattgtgaaggaaagtctagtagccaatttttaaaaattaattttgtgtttgtgtgtgagacagtaatgatatttgaacgtttaaaaagtgaaaaatgtgaaagttgatctatatttgtttcttctaccaacctgatgtttttcatgattgtcctcaattgtaaatgaatacaacaagatctaagggaaggaccacttacattttaatacctttgataagatgtccattgataataatttgcatgtgttatttatttgaaaataatactgagtttatgttttgactaaatatagcttcaaaagatcttggatagaaaccagcagggcaggaatatcttaggcagaactttcaggcttgtaagtacttcattatccaagaaggtcagagaagaatgccccactaatcttattgatttgcaaggtgctgtggaagataacttttattttcccaaagcatacttaatttactaaattacttaatttaccttgtgatatttcacttgtatgtgaagcaaatattcattaagtatatattacaggccaggcactgttaggtacagggcataggggacccaggaaatatggccgagtctctcatataattttctgacattagagagaaaaataaacaggcaattagaacaagtatcacaagtgttgtgagacagggcagtaccgagtaatgtatgacattagaaattacatggttgttagaatgcattgtaggtgctgctagaatacatcatagatgctaaattaggacaatgtatgaaggcatagaataattttgggaggttactcacatgtgctttgcttccagtgaactgcaacagggaatatttcaatctagatctgtcttttcccctctcaaagaccttgtaaatcatttggaaggttctcaaaagctgtaaaaatttagtttacaaccttttaagaaacatcactgcggtaaactgatggcatatctggagctcgatagccctttttggctcttttttatgatgtctcttccattgttacatctttttctttcctttcctttttttcttacttaattttcaccgaagtataacacataaacagaaaagtgcacgaaacatacaagtacagtaacaatggaataccacaaagcaaccccctgggtaagcatcgctcaagtcaaggtcaagaaggaaactttggccggctccatgcccacactcctttatttttatttattattttattttatttttgtatcagaaacccattgcttgctcactctttttttatgctcctttcaatgactccctttccctcctttccagaagtcacttctaacttgacttctgatactgcaggctagtttgtctgtttttgaaatttttccaaggagaaatcaaatgatgtctggcttcttttatttaaaatatggttgtgagggtcattcctgtttctgtaaatacctgaagctcattcgttttcagctgtagagtattacattttatgaaaagatcataatttacttatctgttctactcttggtcgccatcttggttgtttccagttttggcaattacagagaatgcggcagtgaacatctgtgaatatgtcttttggtgtgcatgagcaagcatttctgttggttatgtatgcaggagcagaactgatggatcatgagatattgaaatgttaaattgtgagagataaggtcaaacagcttttcaaacagattgtactgatttctatagcatctctatagaactcaccagcagagaaggagcattcaccagcgcttgcgttgtttcttatttttttggagacagagtctttctctgttgcccaggctggagtgcagtggtgcgtgtgatcttggctcactgcaagctccgcctcccaggttcaggcgattctcctgcctcaggctccccatcagctgggattacaggtgcccaccaccactatgggctaatttttgtatttttagtacagacggggtttcactgtgttggccaggctggtctcgaactcctgacctcaggtgatccacccgcctcggcctcccaaaatgctgagattacaggtgtgaggcacccctccaggcatcattgtgtctttttatttcagctcttctggtgggtacgatcctgaatctcactgtacttttaaattacatttctccagtaattaacaatgttgagcatcttttcatcttgcccattttttattgtgttgcttatcttttaaaaacgtatttggaagacttattttcatattcagattatacaagccttttttgattatatgtattgcaaatatctttatgtaacttgtcttcacacttttatatctttttgatgaaaagaagttcttaacttaaaaatagtccagtttattgctttcctttatggatagtgcttgggtcactcacttgtagaagattttgtcattgtgaatctgaatttcaaagtcttaaaatctttcatatatatatatttttgtttgtttgtttgtttgtttgtttgtttttgagatgaagtgttgccctattgcccaggctggactgcagtggtgcaatctctattcactgcaacctccaccttctgggttcaagtgattctcacctctcagcctcctaagtagctgggacgacaggcatgtgccaccacacccggctaatgtttgtatttttaatagagatggggtttcaacatgttggccaggctggtcttgaactcctgacctcaagtgatttacctgccttggacccctgaagtgctgggatttcaggtgtgagtcactgtgcccagcctcctaattatattttgaaagctatattgtttcttcattcttttttagattcacaatacatctggaactgatttttgtatatgttgtacagcagtgagttaatttttttccccacataacattcaatggaccgagcaccattttactaaaaaatccatccttcccacatttctctgctgtgccacctttgttataaatcaagtgtagatatacataattcctatgccaactctacactgtcttagttcttgcagctttatactagttctttatatccagaagagtaaatcttcctagcttattctttttcttccagaatttcctgcctttttaattttcatataaattttattgtcagcctgtccttttccacaaaaagttgcaacagtggttgaagttgcattgaatagtatcatttttccttccttcctccctccctccttccctacctcctttctctctctctctctctctctctctttctctcactctgttgcccaggccagtgcaatggcatgatctcagctcactgcgacctctgcctcctgggttcaagcaattctcctgcctcagtgtcctgagtagctgggaccactggcatgtgccaccatgcctggctaattttttttgtatttttagtaaagatggggtttcaccaagttggccaggctgatctcgaactcctgacctcaggtgatccacctgcctcgtcttcccaaagtgttgggattacaggtgtgaaccactgcaaccagcctacactgtttatttcattctctggcgcattaccctggctaagacctccaggacaatgttgaacagaagtggccatggtggcatctttgtcttattcctgatttcagagggaaaactttcaatatttcatcattaatacaatgctttccatagttttttgttattgtggtttgtttttgtttctgttttttgtggggcagggtcttgctctgtcacccaagctagagtgcagtgtcacagtcactagtcactgcagcctcgacctcctgggctcaagtgatcctcccatctcagcctctcgagtagctcgaaccaaagatgtgtgccaccacacccagctaatttttaaatttttcatagacttgggttctggccttgttgctcaggttggtctcgagctccaggctcaagcaatcctcccacctcagccccgcaaagtgctgggattataggtgtgagccaccacacctggccttgccgtagctttttgtaaacattttaagcagacgaaggaagtgtcccaaagtctagccagaattatctgagttctgtcttcttggaagactctaaatgttcatatttgttcttctagctctttgaggctggattcttagaagctctgctcagcagtagagttggaaggagttaccccttcaatattacagggagcccactactgttttttgcatgtatttaccaaggtctgtctttaactgaaaatatgcttccattgatatgagtccttatgacagctttagaaatgattcaaaaccttgtggcatttaaaacctgatgagttaaaaaccaaccttctagttttttagtaaatgtaattataattaatttagtgctgcattcagactattgaaagcattttgagcaaagaaagcacaataatttaatgcttgtaaatggttttctctaaacaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtaagtgttcttttaaatgtgaatattttttaaagtttgatatatttttcacatttctgccactgtgttatctgacaacatgtttaatgataccttttcttagggctaacattactgatagaagattgcaaatgaagatatctaaacataattatttttaaacctaccttgatagctagatagctgcttttgtttgctattcgcattttagtagtactgataaattaaaaattatcaaatagttaataccaaaaaccttaatgtttattccagcaagaaattatccaagtaaattattatagatgtatatttttctaggaagtctcttaaagcttatgtttaaatggattaataaaaagcttagtttggagacttttactacaggaattaatatgactgtggtagttgtgtcctagataatcatgtgtttttaattgtgaattataaaaatgccaaagatcacactaataaaaccaagatatggctgggtgcagtggctcacacctgtaatcccagcatttttggaggccaggatgggaagatggcatgagctcaggagtttgagaccagcctgagcaacatagcaagacaccatccctataaaaaaataaaatttaaagaaaactcaacaagatgtgtcacatctcctccaaagtgatgagttgaaactaaatacagattggcccttacaaaaagatattttgttaatggaatattttatttatttagtcgtaaattactccagctttcattaaatttcttgcggtagtatctgtgtttaattggcaatatttgtatgctagttactgtgtggctaagattttgtcatgttgtgcatttgaaatgggtaaggtttgtcaggttgttttctgatggggtgaatggagtcaactgagtgagcctcaggagacagcttcagagtgacggggtcaccactggggctcgtcagtcatttatgggtcagatatcagtaccttccagtcactcttgctgctcagatggaaagcaaaactgaggtggaggccactaggaagttggagaatctgagcctgtcactttgtacttcatcctcgggtgggagatgacggtctgttatggctaacataacacaggtgacatgtaggtggataagatggcagccggggccatctgttgagtggaaagcacacccaagtcacatctgccctccagagtcaagcgtatttgtcttaaactcaggagagttgggaatctccaaatcctttgctacatctctagattccttaaaaatgcaaatctatttttaaatataatttttttttcaatttgagctggggtcttgctatgttgcctaggctgacctagagttcttgagctcaggagatcctcctgcatcagcctcctgagtagctgggattctagctgtgcacggctgcacccagcgttaaattggatggtttctgatgactctgtattttccatattaatataaatttcctgtccaagttaaaaggtctttttaaaaaagaaagacacgtgtatctttttgggaataagttaataacattttatttttgttagtgatgagttgtttttttgttttgttttgttttgtttttgagacggagtcttgctctggaatgcagcggcatgacctctgctcgctgcaacctctgcctcctgggtttaagcaattctcctgcctcagcctcccgagtagctgggattgcaggcatgtgccaccatgcgtggctaatttttgtatttttagtagagacagggtttcatcatgttggccaggctggtctcgaactcctgacctcaggtgatccacccacctgggcctcccaaagtgctgggattacaggtgtgagccaccgtggctggccattagttgggtttttaaaggggaatttccttgcatccataacttcaataatgacactgagaattgaaataagacatctaaagaagaagtagatctgggggagaagactctagcacaatttgtacaactgcttctcacttgaagagcctccttcttgagctgttctccgtccaaatttaggaagattagtgtctggtttgatagttccaccgtttaataaattcacacttaaaaaaactagcagtcacttgaaatgcctttgtaaatatgaatcatacatgcttttaatttgtatgcaaagaccttgaacccaaattgtctcctacactcattttaacatgaaattaatgatataaattatgtaaattttgaatccatgaggttttctcatttattacttggaacatgaattaatatatgaatacattaacatgtaaatcttaaatacataaatctgaacctaagcaaatataccataaatatggtttcactacaggtgatacttgcaagtaaaaaaaattgactagaggcgggggatgaacaagatctagaataatttggctccctttaggaaatgtgggaaaagtgaatatgttctttgctctttccagatagtctgaaatgcatacatgtctgtcagctagcagcagtttggactttatgctagatgaaaccaacataatctacaacgttttgatttatggacactctcacagcatcctaaccatcttcattccaagctacaaaacttttatctttgtgtagcttttctttttccaaaattttaaataagttattctgctgacaaaatatgcttatgcttaaagcagtcttcaccggaccaaggaatcctttctactaacttcgtattaccagtggaaatctctcagtatcaagtaattatcatgcaacagcttctaagtgcatcgtttcatggaggtagagcagtgcatgggagcatttttctgacgcgtggatctctgtagcacggcagtctcacagatgtacgtggtacctaggaatgccaatccccagtcccgtgcagaaataacaagaatacaaaggatagcctgtgggtacaaatgagcgcaccttaatgcttccatttgaattttgctaactgaatcccatgtattaacgctcatttagcattgcaaccatacctgtttctaggacattaccatttttacggagagatagataggttgccagctctcactccaggcccagctccctggcaatcatgaccttgaaccacctagaagcaaagtgagcccccatctaaggtcttgtgattgctgctgctgctctgggcaatttcagctttgtaggcagagtgacccatcttggtggggtacacactggtttgaggctcaacagtaaagaagaggactttcatctcctcttcttcactgtcttttttctgctcccatttaattaattagttaattaattaattttttgagacagagtcttgatcctcctgcctcagcctcccaagtagctgggaatacaggagggcaccaccatgcctggctaatttttgtatttttagtagagatggggtttcaccctgttggccaggctggtcttgaactcctgacctcaagtgatctgcttgccacagcttcccaaagcactgggtttataggcatgagccaccgtgtccacctgctgctgctgttttaaaccagacccacagtgggtctcctgtgcccttatttgttggtccagacccctgactaccttgctgcatctgctttgcactcagcttttcactctcacgtgcaaacccctcagcatgctattttctaccactcctgctcggctctgctctaaatgctgttggtgctgctgttgcttgtgtctgggatattggtggatgttttgctggtgctttagactgacttcctttcttctgctagtgggaatattggcttcctgccaccgagttctagttttctaaagaggtttcaggcagagcactataataactgtttttttcttggaaacaacagccttttagcccttagagtgtatatgtaccaacaaattggctgggcttcagtgatttcaggtagtggccattctactcccctggaaaccaccatttcccctcccacttatagaactcgtggctgaatgtggcagagccagactcctttgaggcagcttttctccatgggggtctcatagatcctcaaatcaggcttagctatattgcctgaacctcaatccttgccatcgttagagtcctctccttgtcactacctagattccttaacccccatcaaaaccagtgggtgcaaacagacctatgaaagtgtccatgattagagagagagttttcagtcctaccttcaagactcatttgaataggacttgcagcccaggccagacatgctgttacaaagtgctacaatagattttaatagctaaagtactatggtgccacagatgaaggaaaacttcattttatctaaggtgatgaaggtaagagaagactaaagggaagatcttgggtttgcaggagtttgtaggtagacatggtaaagaaagctttctacatagaagaaaggttgggcctccaagaactaaggcgtgtatgtagcaaatggccatgtttgggaagtgaaaatgaagcagtgttgttgtctggggtagatacccaaggttcgtcatcttgtgccaagaagattaaggacatggacacacacaaggagtgagtttaggagcggaggtttaatagacaaaagaaagaaaggagagcagctctctctctttcgagacagaggggctcctaaatgggaattccagccatgacagagtgcaccgggttttatagacaggctttaggaggtggtgtctgatttacatagggctcagagattggttggactgggtgtgatgtttacatagcacccagaaaaggctggtcaccccaccgtaatcttattatgcaaatggactttccacttggctggtgccatgttgcctgctcctcactgtacatgcagctggcaaagagaagggaagatggagccaccattttgaccatgcctagtcccaggtggccttttcctattggcacagctgccagcattcacctgtacacgcttccagcttgcttgtctgtgtctgcagctcgattttacaggctgctgtttgttagaaaatgatttgggagtgcttttcattaaaaggaaaaccttaccaaggactcccgtaccctcatatctgcctaaataatttcttcttaactcctatatcaaaattaagcttggttggatttcacaccttgaatcaacaaacctggtgctgggaggcaagtttccttcttaaaactgactactgttcatcaaattgtcatttcagaaacctacaatgttacttcaagagtgactaaaaatttgcatgcagcccggcgtggtggctcacgcctgtaatcccagcactttgtggggctgaggttgggggtgggggggatcacctgaggtcaggagtttgagaccagcctggccaacatggtgaaaccccgtttctactaaaaatataaaaattggttggccgtggtggcatgcgcctgtaataccagctactggggaggctgaggcagaagaatcgcttgaacccaggaggcggagattgcagtgagctgagatggtaccactgcactccagcctgggtgatagaacatacctctgtctcaaaaaaaaaaaaaaaaaaaaaggaaagaaaatttgcatgcgtgtgtgtgttgtatgtgtgtgtttgggagaagggagagcttcatcatgatcaacaatatttttgtgtgtttaagagttgatgttttatgtgagatttcatttgggggaaaaaaaagcttcctctgctaaatgtttaaaaatcattaacctagggcttcattcagcattgtaaccgcacctgtttctaggacactaccatttctatgaagagatagataggttgccaactctctctccaggcccagctccctggcaatcatgactgcaccacctagaggcaaagtgagcccccatctaaggtcttgtgactactgctgctgctctgggcagtttcagctttgtaggcagagtgacccgtcttggtggggtacaaactggcttgaggctcaacacctttgaaaaacagataaaccttttaacatgccatgttgaattttttctttccaatgttgcatttttccaaaagaacacatactcattttaaaaagttataaaatagagataaacaaaaaagaaaagg

SEQ ID NO: 6391 - DNA, 279 bp, Homo sapiens
gagacagagtctcgctctgtcgcccaggctggagtgcagtggcacagtcttggctcactgcaagctctgcctcccgggttcacgccgttctcctgcctcagcctcctgagtagctgggactacaggtgctcgccaccacgcccggctaatattttgtatttttagtagagacagggtttcaccatgttagccaggatggtctcgatctcctgacctcgtgatccacctgccttggcctcccaaaatgctgggattacaggcgtgagccaccgtgcccgg

SEQ ID NO: 6392 - DNA, 7482 bp, Homo sapiens
  misc_feature (4768)..(4768): n equals a,t,g, or c
ggctgcccttgagatggagttgctgcctctttggctctgcctgggttttcacttcctgaccgtgggctggaggaacagaagcggaacagccacagcagcctcccaaggagtctgcaagttggtgagtttcccttgaaccctgatctgtcggctgctcctgtcctgacaaggcttggtccatttggaaagctgacagattgtccatcaggaagggcagagaatgaaggagcctgcatcactctgtgcctgcctagcacaggggcatgtgcagctgccctttaaccacaggattttaagatgcttcctgggaagagccaggcagtccctgccccgccgttctcacgcctgctgaggataggaggcatccgagaccagcctagggcatcctcccggaacaagaacaacttgttaaaaatctggatgattcaggccgggtgcagtggctcaggcctgtaatcccagcactttaggaggccgaggcaggcagatcacttgagcccaggagttggagactagcctgggcaacatgatgaaaccacatctctacaaaatacaagaatcagtcaggtgcggtggcacacacctatagtcccagctacttgggaggctgagatgtgagggtggcttgagcccaggaagtggaggttgcagtgagctgagatcatgcccctgcactccaacctaggtgatggggccagaccttgtctttaaaaaaaaaaaaaaaaaagccaggcgcggtggctcacgcctgtcatcccagtacttagggaggccaagtccggcggatcacctgaggtcaggagttcgagactagcctggccaacatggtgaaaccccgtctctactaaaaatacaaaaattagctgggcgtggtggtgcatgcctgtaattccagctacttgggaagctgaaggaggagaatcgcttgaacccgggagacggaggttgcagtgagccgagatcacacccctgcactccatcctgggcgacagagtgagactctctcaaaaaaagaaaaaaacaaaacaaaacaaaaaactggatgactgagctgcaccgatggtatgagaatctccgggtgaggtgcttgagagctggagaagcctgcctcggagtttgtggacgagttgaccgctaaggcttacacagctgcggggaggacttgctgccatgccactctgcagagcggcagcccggaccacgctcaggctaagaagacccggagcgtggatacccaagcctcctctagggctttcagcctagatgtgaaaatagacttgggtccaaactgagaaatttccagtaattttccccttcatctatataacaatgatatcaaaagtctgctcaagaaacacatatttaggccaggtgcatggctcacgcctgtcatcccagcactttgggaggccgaggcgggcagatcacaaggtcaagaggtcgagaccagcctggccaacatagtaaaaacccgtctctactaaaaatacaaaaattacccaggcatggtggcacatgcttgtagtcccagctactcgggaggctgaggaagattgcttgaacctgggaggcagaggttgcagtgagctgacatcgtgccactgcactccagcctgggtgacagagtgatactccatctcaaaaaagaaaaaaaaaatgaaacacatatttaataaacatttcttgagccatattatatactaggcgttgggaagacaaattggatgtcagggctaacacttacattcaagtatgtattcttaaagcatagctgtcatggtttttaacctcttttagtaggaacctataaccactgtgctagagtctattccaatatgacatagaggttacaagctagactggcctggtttaaacccagccccacccttagctggtgacattggggtcactctaggtcatagtttctccatctgtagaatatatacgtaataataatatctaccaataacatcatgctgtgttgactgatgattaaatgggttaatacatgtaaagcactcaggacagtgcctggtaggtagtcagtgctacgcgttttatccgttatcactcatattattattaatctctgctatgtttgacctccagcattctcttacagaggcaataaaggattaactacacagtagttattcaggggttaccaggcacaggaagaggagagataaatgaacagcctttcagagttcaggcaaggccctctgcttgacactttctggcccagtgggcaggagtagagaattggctgccaggaagcccaaagagtgggtttcctgtggctcttccgagttgaggactgagaattggagagtctgggtgccctccactggccctcatcacattatccatttgaccttattagaaagtggacgttggccaggtgcggtggctcccgcctgtaatctcagcactttgggaggccgaagcaggcagatcacctgaggtcaggagtttgagaccagcctgaccaacatggtgaaagcccgtctctactaaaaatacaaaaattagccaggcatggtgacgggcacctgtgatctcagctactcaggaggctgaggcaggcgaatcgcttgaaccagggaggccgaggttgcagtgagctgagatcgcgccactgcactccagcctgggcgacagagcaagactccgtatcaaaaaaaaaaaaaagaaaaagaaagtggacatggtaagcttttctgggatggccatatggtccttctacatcacttcagcggggccacagggaattgcagaggtgtgacccacgactgcagcagctgtggtggaacagcaccccatagcgtgaagaaagcccctgaccacaacattctccagtgagtccacacgcagggaggagcgcaacacccactcacataaagacacacacctggccgggcgcggtggctcacacctgtaatcccagcacttggggaggccaaggcaggtggatcacccgaggtcagggtggccaacatggcaaaactctgcctctactaaaaatacaaaattagcccggtgtggtggtgtgagtctgtaatcccagctacgtgggaggctaaggcagcagaatcgcttgaacccggcaggcagaggttgcagcaagcagagatggcgccattgcactccagcctggacgacaagagtgagactctgtctcaaaaaaaaaaaaaaaagataaaaattctcttccagagtactttgtaattataatgcaatcccaatcaaaataccaaagagggaagggggatgtggaaagaacttggcaaatcctttctaacgttcgtctggaaattagagaaacccaaatgctcaacaataggagatgattaattagatcatcctaataattatagctcacatttattaagcacagtaaatgtgtttcacctcaacagtcacacttgatcctgaaaaaaaacgctatgcgaaaatgacgagtataatttcggttttacaggcagggtaatggaggtctctttcggttccgtaaccatccaaaggtcacccatttgatcaaaagcagagccacgaagcattggccctggaactcttgctctcagccactgtgctattcatgagatgaatgcatatgcttcctaaaaagattatgatcacatttatttgtactgccaaggcaataagtccgtcatactttattgacagggggagaaaaataggttactgaacagtttgcacagtatggtcttatttttgttttttagacaaaggtaggtaatatcttacgaaagatccagaaagacatggaacagaaggtgactggtgtttctctgagagagaggcggaggtgacagaagagttgaggtttccatatgtcaatacagtatcaatgtttaattattggaaggttttattttaattatcagataaagaacccgaggggccaagaaattccactgctagtggtggtagagccgagattcagattgagtctgtcctccaaacctgtgcttcttctaacctctctctcgggattttcctcttctgttgccgtgctgcacttgccctctgggattgaacccacaattgtaggcaaccactgcccttgtattactgataaacttgtgcaaacgaatgccattgctcctctatcttatcacttaaaacttctttctggccgggcacggtggctcacgcctgtaatcccagcacttttgggaggccgaggcaggcagatcacctgaagtcaggagttcgagaccagcctggtcaacatggtgaaaccccgtctctactaaaaatacaaaaaaagttagctgggcgtggtggcatgtgcctgtaatcccagctactcgggaggctgaaacaggagaattgctcgaacccaggaggcagagattgcagtgagctgagatcacaccattgcactccagcctgggtgacagggtaagacttcatctcaaaaaaacaaaaaacaaaaaaaccatttttgtcctagacacctaaataacatcctatggctgatggttgtttttgccaattttgcaaagcgtggggtgaattaaagtatcctgcacgtgtgctttctgcagtgcgaccagggtggcctcgtccctcccgcctccttattatgcatgatcagagtagagccctgtttaggaaaagcactgaactgggcattcagagccctgggctccagtcccggcacagccactggctcttcacttctcccctccagacccactttacttccctgtacaattcaggatggtgaaagctctcaagnccttttttttttttttttttttttgagacggagtcttgctctgtcgcccaggctggagtgcagtggtgcagtggtgcagtctcggctcactgcaatctctgcctcctgggttcaagcaattctctgcctcagcctccggagtagctgggattacaggtgtccaccaccacacccggctagttttttgtatttcctgtagagacaggacctcaccatgttggccaggctggttttgaactcctgacctcaagtgatccacctgcctcggcctcccaaagtgctgggattacaggcatgaaccaccgtgcccggccttgtctatcctatttttaaaatgaacatctctagagccatccccggcggttgcagggacagtctgataagtgaactaagtttctatgcataaatgcttgcctctgggcctcctcgctgctgaccggtgtggttttggccgcaggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatcctcattatcttggtaaaatatttattaagtgactttttcagaaataaaaggcaacgtgtctcataaatattttttaaattaaatgca

SEQ ID NO: 6393 - DNA, 463 bp, Homo sapiens
tgtagtaaggggagttggcctggcctgaagtgaaagctggcttacccggtttcattgagctcttcaattagtctgtttgcactggtgagcattcaaatctgatcaagaaggtaaaatgagctttcaagatccctaaatgcatttgaagaaaggaaagaggaggcccctgagtggctggagcgagcaggtggggtgagctggtgccgctggcccaggagaagatgggagggcagacactgggcctccggtaggtgtcaaggaatgggcagatggaatgctggggccagctcttgcctctgggtctgcagaatgcagagctgggggcatgcactgggcgtcaggtccccagcagggcagcagtgagtgcagcctcgctgctgggagaaactgccctgctcactcatcggagctcggggagcgaggcggggctgctcttagccctgccactaagttcatccacaac

SEQ ID NO: 6394 - DNA, 1880 bp, Homo sapiens
aaaaaaaggcggtgggggaaattatctccacaaaacaaaaagtccggcaataagcaataagctgtccagggctgatacagggcatgatgaggtcatcacagatccaggttctttctgttttttgctctgcattcgtagcctgtggctttgtcattccctcatctggaaatggcggctgcagccccaggcacaatggcccgttgaggaagaagggggacgatgtgcagtgtcaggttattttatcaggaaagttcaaagcttctcagaaatcttctgttggaattctacctgggtgtcataggccagaacacaacccaaataaccaggaaaaatgtgaaagtgagaaaatagatcgtccacccctaacaatggaggcagcaagtgagaggggattgggaatgtgtgttgatttcctcaacagtgtttgacataaccactttctagctttataatcttaggcaagtaactcaacttcccagttcctcttctgtaaaatggggataacacctgaaaaggttgttacaagattcactgaaatagtttctatgctcagtcagtaatcagcattcaatcaatatgagctctaacatgatgcttgacagttatgcaacgaacagttcatgaagagctttgtaagccatattgataattttgtctttatccttagcacagtgagaaggtattaaaggattttatgcagggaagtgacatgatcatatttgtgttttcaaaagagccctcaggctgggtgtggtaacttgcgcctgtaatcccagcactctgggaggccatggcaggcggtgggcggatcgcttgagcccaggagttccggaccagcatgggcaacttggggaaaccccacctctaaaaaaaaaatgccaaaaaaattttagctgggtgtggtggcactcgcctgtagtcccagctgctcgggaggctgaggtgagagaatcacctgagcctgggagaggctgtagtcagctgtgattgcgccatgcactccagcctgggtgacacagtgagaccctgtctcaaaaaataaataaaaaataaaaaaaggagccctcaatttatcctctgcctctgacaaatatattccattttgttacattgcaaaaatttcagcacattgctttgcttacccatctttgctctggaacgacttttaattcttcttttggcaatcttggttgttttgagatgtgtgaaattagaatcatatgcaggtgtttgagttcttttgattttgctttttaaaagagttttttttttgttttgttttgttttgtttttagaatggggcaatgtaaagccagaatatcaacgtccttttgtcaagattttcaaacctatttggctgatagtgcacttacaagaataggtaaaaaagatcccaaagattttacttcacttacttgaactactagccctactattaagagccacatcaagctttacatgttcataaaaaaaaaaaaaaagagctgcaacattcctttcgcactcccactcgcccatgaggttcttccacttccttcctatggctttttttagaagcgagtgtgtttttctcacgtccggcaacaaaggatgttttgtgctactactgaggtttgtgtgtgtgacttactttagaactctttctagaaaatgcgattactatttgcataggtctggtagaactttgtattgagtgaaagtctccgatgactgtttttgtttttgtgtagatttgccactgcttaacatcaaatcactttcccctgtgtgttttaaaatacctctaataggacctgtcaaaattctcccagaagtctcacaaattcttacctttaaagaaagtgtaagtgataccttcagtgtattgtatttattcttat

SEQ ID NO: 6395 - DNA, 1470 bp, Homo sapiens
aaaaaaaggcggtggggggaaattatctccacaaaacaaaaagtccgacaataagcaataagctgtccagggctgatacagggcatgatgaggtcatcacagatccaggttctttctgtcttctgctctgcattcgtagcctgtggctttgtcattccctcatctggaaatggcggctgcagccccaggcacaatggcccgttgaggaagaagggggacgatgtgcagtgtcaggttattttatcaggaaagttcaaagcttctcagaaatcttctgttggaattctacctgggtgtcataggccagaacacaacccaaataaccaggaaaaatgtgaaagtgagaaaatagatcgtccacccctaacaatggaggcagcaagtgagaggggattgggaatgtgtgttgatttcctcaacagtgtttgacataaccactttctagctttataatcttaggcaagtaactcaacttcccagttcctcttctgtaaaatggggataacacctgaaaaggttgttacaagattcactgaaatagtttctatgctcagtcagtaatcagcattcaatcaatatgagctctaacatgatgcttgacagttatgcaacgaacagttcatgaagagctttgtaagccatattgataattttgtctttatccttagcacagtgagaaggtattaaaggattttatgcagggaagtgacatgatcatatttgtgttttcaaaagagccctcaggctgggtgtggtaacttgcgcctgtaatcccagcactctgggaggccatggcaggcggtgggcggatcgcttgagcccaggagttccggaccagcatgggcaacttggggaaaccccacctctaaaaaaaaaatgccaaaaaaattttagctgggtgtggtggcactcgcctgtagtcccagctgctcgggaggctgaggtgagagaatcacctgagcctgggagaggctgtagtcagctgtgattgcgccatgcactccagcctgggtgacacagtgagaccctgtctcaaaaaataaattaaaaataaaaaaaggagccctccatttatcctctgcctctgacaaatatattccattttgttacattgcaaaaatttcagcacattgctttgcttacccatctttgctctggaacgacttttaattcttcttttggcaatcttggttgttttgagatgtgtgaaattagaatcatatgcaggtgtttgagttcttttgattttgctttttaaaagagttttttttttgtttggtttggtttgttttaagaatggggcaatgtaaagccagaatatcaacgtcctttggtcaagattttcaaacctattgggctgatagtacacttacaagaataggtaaaaaagatcccaaagattttacttcacttacttgaactactagccctactattaagagccacagcaagcttacatgttcaaaaaaa

SEQ ID NO: 6396 - DNA, 3332 bp, Homo sapiens
aaaaaaaggcggtggggggaaattatctccacaaaacaaaaagtccgacaataagcaataagctgtccagggctgatacagggcatgatgaggtcatcacagatccaggttctttctgtcttctgctctgcattcgtagcctgtggctttgtcattccctcatctggaaatggcggctgcagccccaggcacaatggcccgttgaggaagaagggggacgatgtgcagtgtcaggttattttatcaggaaagttcaaagcttctcagaaatcttctgttggaattctacctgggtgtcataggccagaacacaacccaaataaccaggaaaaatgtgaaagtgagaaaatagatcgtccacccctaacaatggaggcagcaagtgagaggggattgggaatgtgtgttgatttcctcaacagtgtttgacataaccactttctagctttataatcttaggcaagtaactcaacttcccagttcctcttctgtaaaatggggataacacctgaaaaggttgttacaagattcactgaaatagtttctatgctcagtcagtaatcagcattcaatcaatatgagctctaacatgatgcttgacagttatgcaacgaacagttcatgaagagctttgtaagccatattgataattttgtctttatccttagcacagtgagaaggtattaaaggattttatgcagggaagtgacatgatcatatttgtgttttcaaaagagccctcaggctgggtgtggtaacttgcgcctgtaatcccagcactctgggaggccatggcaggcggtgggcggatcgcttgagcccaggagttccggaccagcatgggcaacttggggaaaccccacctctaaaaaaaaaatgccaaaaaaattttagctgggtgtggtggcactcgcctgtagtcccagctgctcgggaggctgaggtgagagaatcacctgagcctgggagaggctgtagtcagctgtgattgcgccatgcactccagcctgggtgacacagtgagaccctgtctcaaaaaataaataaaaaataaaaaaaggagccctcaatttatcctctgcctctgacaaatatattccattttgttacattgcaaaaatttcagcacattgctttgcttacccatctttgctctggaacgacttttaattcttcttttggcaatcttggttgttttgagatgtgtgaaattagaatcatatgcaggtgtttgagttcttttgattttgctttttaaaagagttttttttttgttttgttttgttttgtttttagaatggggcaatgtaagccagatatcaacgtcctttggtcagattttcaaacctattgggctgatagtacacttacaagaataggtaaaaaagatcccaaagattttacttcacttacttgaactactagccctactattaagagccacagcaagcttacatgttcaaaaaaaaaaaaaaaagagctgcaacattcctttcgcactcccactcgcccctgaggttcttccacttccttcctatggctttttttagaagcgagtgtgtttttctcacgtccggcaacaaaggatgttttgtgctactactgaggtttgtgtgtgtgacttactttagaactctttctagaaaatgcgattactatttgcataggtctggtagaactttgtattgagtgaaagtctccgatgactgtttttgtttttgtgtagatttgccactgcttaacatcaaatcactttcccctgtgtgttttaaaatacctctaataggacctgtcaaaattctcccagaagtctcacaaattcttacctttaaagaaagtgtaagtgataccttcagtgtattgtatttattcttatatacctttgcaaagacttctcatcacttccttaaatatgtctgatagtgccataatgagaaggggacatggtaattaaccatcaactttggttttcatggagaaaatctatctggagcagtcacagtatcctatgctggagctatcagatgccttgacattagatgtttccatctaattgtaattctctgagcaaggagacaaggtgggataaacagaattctcagatggctgagaattataccctaaatcctgggagagaatttacctttccattgtcagataatatgaatcatttaaaacatgtgctggaacagctttgccttttcttgaggaaaatggggtttctctctcaaagagaaagataaatgcgcctcagaagattttagtggtcgatctctgtcagtgtactaccagcaaaaatcccagcaatcaatattacaaagaggcagcactcacttgagtacagaagtaacaacattagctgcttcgtaaacaagatggcatgggagatattctgttttgagtaaatgacaagtcctacagtctagataggaagatttctcctccatatggattttgtgatttcgtcttgtgttgagtaaggaaggggagcttggattccaagatcaatttaatgtctatattccttggcattgtcatgttagagcagcacatctcagatggctttcaatagttattttagcattgattttcctctactagagtaaatcaaaagatgatttagaaaatcaaagtcagttttccttggagttttctcagaataaagggaagctgtggtgttgaagggtttttttggctcctatttacatatgatgcaaaatcaatctgtgtgaatctctttcctctgttgagctctactataggctctactatatgcagagccttgggtatttctgtgcgagggggattatgcaaaagaattttaaggcatgccacttgactttgtgaaaccaagtatttgtttaaagagacacgatattatagtgggaggctgttttgtgagaacccacactttcatgtcagcaccctgagatgggatcccattacgccctttaaccaggcaagggactttatgcagttcttcgtcaggaaaatggagacaattaaactgcttttctcataggttgttgtgtaaaaggcagcaagatgtggctgtgtaagaacatgactgaagccagactgcttatgcttaaaacctaggtgagctgtttacacctgatatgaccttggacaagtctcatctaacttctcttgcctcaggtgcctcatctgaagatagcagtgatgttagtgtctgcctcctgcctcataagcctgtcatgttgagaccatcctggccaacatggtgaaaccccgtctctactaaacatacaaaaattagccaggcatggtgacacgcgcctgtagtcccagctacttgggaggctgaggca

SEQ ID NO: 6397 - DNA, 3482 bp, Homo sapiens
gcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgcggccccttcgcccgtgcagagccgccgtctgggccgcagcggggggcgcatggggggggaaccggaccgccgtggggggcgcgggagaagcccctgggcctccggagatgggggacaccccacgccagttcggaggcgcgaggccgcgctcgggaggcgcgctccgggggtgccgctctcggggcgggggcaaccggcggggtctttgtctgagccgggctcttgccaatggggatcgcagggtgggcgcggcggagcccccgccaggcccggtgggggctggggcgccattgcgcgtgcgcgctggtcctttgggcgctaactgcgtgcgcgctgggaattggcgctaattgcgcgtgcgcgctgggactcaaggcgctaactgcgcgtgcgttctggggcccggggtgccgcggcctgggctggggcgaaggcgggctcggccggaaggggtggggtcgccgcggctcccgggcgcttgcgcgcacttcctgcccgagccgctggccgcccgagggtgtggccgctgcgtgcgcgcgcgccgacccggcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcgggggcgacctcggctcacagcgcgcccggctattctcgcagctcaccatggatgatgatatcgccgcgctcgtcgtcgacaacggctccggcatgtgcaaggccggcttcgcgggcgacgatgccccccgggccgtcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggtgcacagtaggtctgaacagactccccatcccaagaccccagcacacttagccgtgttctttgcactttctgcatgtcccccgtctggcctggctgtccccagtggcttccccagtgtgacatggtgtatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcggctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtgactttgtgg

SEQ ID NO: 6398 - DNA, 1820 bp, Homo sapiens
gccgagactgcatccgccttgcgagcacagagcctcgccttcgctgctccactgccagtccacacctgccaccagctcaccatggatgatgatatcaccgcgctcgtcattgacaacggctccggcatgtgcaaggccagcttcacgggcgacaatgccgcccgggcagtcttcccctccatcgttgggcaccccaggcaccagggcgtgatggtgggcatgggtcagaaggattcctatgtgggcgacgaggcccagagcaagagaggcatcctcaccctgaagtaccccattgagcacggcattgtcaccaactgggacgacatggagaagatctggcaccacaccttctacaatgagctgcgcgtggctcccgaggagcaacccatgctgctgtttgaggcccccctgaaccccagggccaactgcaagaagatgacccagatcatatttgagaccttcaacaccccagccatgtacttggccatccagactatgctgtccctgtacgcctctggccgtaccactggcatcgtgttggactccagtgatggggtcacccacactgtgcccatctacgaggggtatgccctccccaacgccatcctgcttctggacctggctggccgggacctgactacctcatgaagatcctcaccgagcgccgctacagcttcatcaccacgcggagcgggaaatcatgcgtaacatcaaggagaagctgtgctacctcgtcctggacttcgagcaggagatggctaccgcggcttccagctcctccctggagaagagctaccagctgcccaacagccaggtcatcaccattggcaacgagtggttctgctgccccgaggcgctcttccagccttccttcctgggcatggagtcctgtggcatccacgaaactaccttcaactccatcatgaagtgtgacttggacatccgcaaagacctgtacaccagcacagtgctgtctggtggcaccactatgtaccctggcattgctgacaggatgcagaaggagattaccgccctggcgcccagcaggacgaagatcaagatcattgctcctcctgagcgcaagtactctgtgtggattggaggctccatcctggcctcgctgtccaccttccagcagatgtggatcagcaagcaggagtatgaggagtctggccctccatcgttcaccgcaaatgcttctaggcggactgtgacttagttgtgttacaccttttcttgacaaaacctaacttgtgcaggaaacaagataagattggcatggctttatttgtttttttgttttgttttgtttttttggttttttttggcttgactcaggatttaaaaactggaacagtgaaggtgacagcagtcggttggagcgagcatcccccaaagttctacagtgtggccgaggactttgattgtacattgttcttttttttaatagtcattccaaatatcatgggatgcattgttacaggaagtcccttgccatcctaaaagccaccccacttctgtctaaggagaatggcccagtcgtctaccgagtccacacaggggaggtgatagcattgctttcgtgtaaattatggaatgcaaaatttttttaatcttcgccttaatactttcttattttttttattttgaatgatgagccttcgtgcccccccccccttttttgtcccccagcttgagatgtatgaaggcttttggtgtccctgggagtgggtgaaggcagccagggcttacctgtgcactgacttgagaccagttgaataaaagtgcacacacacacacataaaaagatctacattcca

SEQ ID NO: 6399 - DNA, 1820 bp, Homo sapiens; identical to SEQ ID NO: 6398

SEQ ID NO: 6400 - DNA, 1823 bp, Homo sapiens
accgccgagactgcatccgccttgcgagcacagagcctcgccttcgctgctccactgccagtccacacctgccaccagctcaccatggatgatgatatcaccgcgctcgtcatcgacaacggctccggcatgtacaaggccggcttcacgggcgacaatgccacccgggcagtcttcccctccatcgttgggcaccccaggcaccagggcgtgatggtgggcatgggtcagaaggattcctatgtgggcgacgaggcccagagcaagagaggcatcctcaccctgaagtaccccattgagcacggcattgtcaccaactgggacgacatggagaagatctggcaccacaccttctacaatgagctgcgcgtggctcccgaggagcaacccatgctgctgtttgaggcccccctgaaccccagggccaactgcaagaagatgacccagatcatatttgagaccttcaacaccccagccatgtacttggccatccagactatgctgtccctgtacgcctctggccgtaccactggcatcgtgttggactccagtgatggggtcacccacactgtgcccatctacgaggggtatgacctccccaacgccatcctgcgtctggacctggctggccgggacctgactacctcatgaagatcctcaccgagcgccgctacagcttcatcaccacgcggagcgggaaatcatgcgtaacatcaaggagaagctgtgctacctcgtcctggacttcgagcaggagatggctaccgcggcttccagctcctccctggagaagagctaccagctgcccaacagccaggtcatcaccattggcaacgagtggttctgctgccccgaggagctcttccagccttccttcctgggcatggagtcctgtggcatccacgaaactaccttcaactccatcatgaagtgtgacttggacatccgcaaagacctgtacaccagcacagtgctgtctggcggcaccactatgtaccctggcattgctgacaggatgcagaaggagattaccgccctggcgcccagcaggatgaagatcaagatcattgctcctcctgagcgcaagtactctgtgtggattggaggctccatcctggcctcgctgtccaccttccagcagatgtggatcagcaagcaggagtatgaggagtctggccctccatcgttcaccgcaaatgcttctaggtggactgtgacttagttgtgttacaccttttcttgacaaaacctaacttgtgcaggaaacaagataagattggcatggcttaatttgtttttttgttttgttttgtttttttggttttttttggcttgactcaggatttaaaaactggaacagtgaaggtgacagcagtcggttggagcgagcatcccccaaagttctacagtgtggccgaggactttgattgtacattgttcttttttttaatagtcattccaaatatcatgggatgcattgttacaggaagtcccttgccatcctaaaagccaccccacttctgtctaaggagaatggcccagtcgtctaccgagtccacacaggggaggtgatagcattgctttcgtgtaaattatggaatgcaaaatttttttaatcttcgccttaatactttcttattttttttattttgaatgatgagccttcgtgcccccccccccttttttgtcccccagcttgagatgtatgaaggcttttggtgtccctgggagtgggtgaaggcagccagggcttacctgtgcactgacttgagaccagttgaataaaagtgcacacacacacacataaaaagatctacattcca

SEQ ID NO: 6401 - DNA, 2558 bp, Homo sapiens
  misc_feature (1424)..(1424): n equals a,t,g, or c
agcgcgcccgactattctcgcagatcaccatggatgatgatatcgccgcgctcgtcgtcgacaacggctccggcatgtacaagagccggttcgcgggcgacgatcgtccccggaccgtattcccatccatcgtggggcgccccaggcaccagctagaggagctggctggttggtacatccccgggagcgggcgggaggcaagggcgctttctctgcacaggagccttccgggtttccgggggtgcggtgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggacaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggcgcacagtaggtctgaacagactccccatcccaagaccccagcacacttagccgtgttctttgcactttctgcatgtcccccgtctggcctggctgtccccagtggcttccccagtgtgacatggtgcatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcntcgctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcagctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggccaagtgtgactttgtgg

SEQ ID NO: 6402 - DNA, 216 bp, Homo sapiens
gggggccacggcgcgcgcccccagcccccgggcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttt

SEQ ID NO: 6403 - DNA, 231 bp, Homo sapiens
ggtctctgttcctgcttattggggagttcctggcctggcccttctatgtctccccaggtaccccagtttttctgggttcacccagagtgcagatgcttgaggaggtgggaagggactatttgggggtgtctggctcaggtgccatgcctcactggggctggttggcacctgcatttcctgggagtggggctgtctcagggtagctgggcacggtgttcccttgagtggggg

SEQ ID NO: 6404 - DNA, 231 bp, Homo sapiens; identical to SEQ ID NO: 6403

SEQ ID NO: 6405 - DNA, 968 bp, Homo sapiens
tcccctaattcccagagcccctggggagaccatgggctgcaggagagcagatgagactgtggctgggtgtccagagctgctgcctgctccggcaccttcatggaatggcattggcctcaagtcctcgctgcctcttactggctgtgtgaccttgggcaggccaggtagcctcagcttcctagagaatgtatgtaatgggcttggcatacagaatatggcacatagtaggtactcaactattattattctgtatttaatagctaattggctggcatttgctcagcactctgcatacattgggccattgcgaggtctctcgcctgcatcttagtttgctaattaggtgcttatctgggaccttcctggagcaggcattctctgctccattctctcctctgtacgcgtgacagccccaacccttgttcccccagcaggagcaaaaggggttgggtatgatgacctccagctcaatgtctaaggatctctgggtttcagtttccccctcggccagctcctcctgcccctaccagccacctcccaagctggggatttcactggcccacctttgttccctgcagaatcctagagtcctccagcccttccctctctggccttcacactccacatcctcagcccagcacaggagccaattttgcaaagaggtaaagagacctcaccactgctgcaccagtctgtccatttcctagcaggcaactggcacttgtttggttttataaattaaggtttcgattcttggccaggcgcgatgcctcacacctgtaatcccagcactttgggaggccaagggtggtggattacctgaggttaggagttcaagatcagctctgccaacatggtgaaaccccatctctactaaaaatacaaaaattaaccgggcatggtggctcatgcctgtaatcccagctactcaggaggctgaggcacaagaatcatttgaacccaggagg

SEQ ID NO: 6406 - DNA, 255 bp, Homo sapiens
ctttgggaggctgaggcaggaggatcacgaggtcaggagatcaagaccatcctggctaacacagtgaaaccctgtctctactaaaaaatacaaaaaattagccgggcgtggttgcgggcgcctgtagtcccagctactcgggaggctgaggcagaagaatggcatgaacctgggaggcagaggttgcagtgagccgagatcacgccactgcactccagcctgggccacagagcaagactctgtctcaaaaaaaaa

SEQ ID NO: 6407 - DNA, 4481 bp, Homo sapiens
gcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgta

SEQ ID NO: 6408 - DNA, 4481 bp, Homo sapiens
gcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcatgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcgaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgta

SEQ ID NO: 6409 - DNA, 4481 bp, Homo sapiens; identical to SEQ ID NO: 6408

SEQ ID NO: 6410 - DNA, 363 bp, Homo sapiens
gtcccatcaaggtgcctgcacatctgggctctccgggagcagccatggcagcacccgggaagaaacgctgatgtggctgctctgcatgctcagatgacttcatcgggaagcctgggtgcattttacgctgggtgccaaatctcgagtaactgaggaattcccagagccttctgaaacacagagctgcaataaggctgctccatccaggttagctccatcctaggccaagggctttatgaggactgcacatattctgtgggttttataggagacagctaggtcaagacccctcagagaaagctgctttgtccggtgctcagctttgcacaggcccgtattcatatctcattgttgtttgcagga

SEQ ID NO: 6411 - DNA, 363 bp, Homo sapiens; identical to SEQ ID NO: 6410

SEQ ID NO: 6412 - DNA, 363 bp, Homo sapiens; identical to SEQ ID NO: 6410

SEQ ID NO: 6413 - DNA, 9507 bp, Homo sapiens
ggcggtcccaggcaggcccagaagctgggcagcctctgccgggttccgggaaaaggagctcctgctgccactgctcttccggagcctgcagcatggggcccctgccgcgcaccgtggagctcttctatgacgtgctgtccccctactcctggctgggcttcgaggtgacgctgggaggggtcgcctcggcagtgtctggggagtgagggcggagggaagagtgagcgcagggctccgggacagaggtctcgtgtaactcctggcgccgcccaaggggttaaggcaagcagggagagctccggggctgaaggtcactttgtgcttttaaacggaatagagtcgctggctccaacccgagcctttatatcccgactgcagtttcccacggtggtggaaagaggggcggctccaaacattcagggagaaatgcagaacacggccacctcttagcccaacgatggcagttttggggaaaactggccacaggagcgaagatcctggaatagatttctagtagtgaggagagttttgccaatttcaaaccaaacaatgtagggtgtccgcataacccctgctctgcacttagcgcctcccttccctttccctcggctctttcacttttccatcttgcacactggcaatcgttcttgacctctgcccgcagatcctgtgccggtatcagaatatctggaacatcaacctgcagttgcggcccagcctcataacagggatcatgaaagacagtggtaggaagggagggtcggggcaggggtgatctcagtggcccaagagagccgaccccagcgggtccttatattggcactggcagccagaaagctgccctctgccccgtctctactaaaaatacaaaattagccgggcgtggtagtgcatgcctgtataccacagctactcgggaggctgaggcgggagaatcgcttgaacccaggaggcggaggttgcggtgagctgagatcgcaccattgcactccagcctgggcaacaagagcgaaacaacaagagaaaaaaaaggaagctgccctctgcccaaaacccacgtcgaggtccccaaacctgggacccttaggtcttttctcacttagcgtgcccaaccttctcctggcaggaaacaagcctccaggtctgcttccccgcaaaggactatacatggcaaatgacttaaagctcctgagacaccatctccagattcccatccacttccccaaggatttcttgtctgtgatgcttgaaaaaggtgaagagagtgggatgtagacagggtatccagtgaaaaacacagaagtcggagattgagggattgataggatggaggggctgcgggagactaaagcaagtgaagcctgccttgggaaacctcaggatcagccttgagcgagctgaaggttgccgggcatgaaagggaagaagagcaggcaaataggtcatgggaaccttgggtgagaggctgagggcggaggagctctgggggatgtcagaagcaaggaagagctagtcctccaccaggaaagcagcaagaggagccctgcctctgggtgcctctgccccacaggaagtttgtctgccatgcgtttcctcaccgccgtgaacttggagcatccagagatgctggagaaagcgtcccgggagctgtggatgcgcgtctggtcaagggtgagtgtggggctctgggaatcctctgggaggaccttggatgactttctgaccttccccaggcacgttttcagggtcatgatcctgcccccgcccgggacttctactgtcctcccagtcacacccctctccccgcaccgccttcctgctgtcttctcttcttcccagaatgaagacatcaccgagccgcagagcatcctggcggtgagtgtcctggctccaccccaactgcactcatagagaatctgagaacagttggcgtttgggggtaaagaagacaataggtctcttattgcatggaaaaggttataattactggggaagaaaggatgtctgtgattcagggcacaaactactgaaaagttggaactaaggatcctcaaaaggatatctcaaggttgaaaggggaagtgcaaaagggacaatatatgggaagaatttatttgctgaaagatgtcagtgagagaaagatgctcagtgttggaacccctggatggggagggatatagtattcacaagtctccacaaactccaacacaaacctcaccaacacatccagagtggaaggcaggagacttgttccaagaggctttaaaaagacgaaaagagataactaatgccagggttatataggagcctgagtgagaacaaatggaaatagctcaaaacattgaccagtgagccatggatgggggtataaaagtaagtttgtcttcaggattaaattaggaaattcaaaacagtattattcctctggtttacaaaaaaaaatagttgagacctattcaaatttaatatataaagtggcaaatcacacaaaagttaaacgtataaggaatggcaaatatatcttctacagtctatactcctgcaaagtacatgtgtaatttttagcttgcttttttacttcatatttaatcattttccatgctttttttttttttttttttttttttgagacacggtctggctctgtcgcccaggctggagtgcagtggtgtgacctcgacccactgtaccctttgcctcctggactcaagcaatcttcccacctcagtctcctgagtagctgggactacaggcacacactaccatgtctggctaacttttttattttttgtagagaaggggtttcactgtgttgcccaggctggtctcaaactcctgtgctcaagagatctgtctgcctccacctcccaaagtgctgtgtttacaggaatgagccactgtgcccagcctccatggaattcttaactctgaaagtatagttctttgtttctatagaggttccactgagtggacttatttttgttttgcttaaccatttttctgtggttaaacattttgtgtaggacataattctctaatttaaccaagtcaaagatagtgtctcattaggacaggctacatgaattcctgggtcccacttctgatctaggaagtcaagttgcagtggttgtcaatcttggctgtgaattaaaatcacctggagcaccttggcgctaaccctttcccctggaattgtgatgtaattgttcttgttcttttttttccttccttcctttttttttttttttttttttttttgagacagtgtcttgctttgtcacccaggctggggtgcagtggcatgatcatggctcactgcagactcaacctcttgggctcaagtgatctcgcatctcagccttacgagtagctgggacttcaagcatgtgccaccatgcctaattttttaaaaattttttgtagagatgggggtttcactttgctgcccaggctggtctcgaactcctgggctgaagcaatctcctgcctcagtctcccaaagtgctagaattacaggcatgagccacagtgcttggatctagttctaagggatgacctcacgtggagattttttaaagctcctcaggagtttcagatgggcagccaaagttaagaaccatctatcccaaactataccaacaaaccacaaactgaagcctttatctttgtcttgaagccaggtaggtggctgcagccatgtgccttgttacaaagttctcaggaagttccactggaattacagcctagctcttgattcaaaaaaagcatgagatacttaggaactgtgagaggtaggaaggaaagagccctggacttgaattctagagacctggattctagtgttggctctgctaccaacatgctctgtaactctgagcaagtaatgtatcacctctggattcaggctcttcatttgtgaaataaagaggtctatctagctgctctctaagatgtccgctggtgttaatttctgtgattgactctgtgccatctaccttttctccttttccacccatctcaagatttgggataaaggaaatagttcctcttggcaaggacagatctccacttgtgggtgggtaagggcattgccagcaaaacttgggggcagaaaataaaaagaccagagttttcctctgagatccccatccaatatcatgcagacacagttgtattccctactatattcccttaggctgcagagaaggctggtatgtctgcagaacaagcccagggacttctggaaaagatcgcaacgccaaaggtgaagaaccagctcaaggagaccactgaggcagcctgcagatacggagtgagcagctctttatgtgtgttcccagcacccatcctgaagatggagacttgagaatctctaagtttgagtccttatgctcctgtacaaaagccccctttccaagtgttctcctcagtgctcttaaacaaccctcatcttcttccttcttttccttgggctcagggaaaggaagggaaggagatgcacagtgagagaaaagagagcatcttagaaacaggaaggcacctggggccacagagcctcttagacctctttgcttctgtgaactcagaaaagtactgactcaaaggtttcaacccctgcctaatacctgctcctttgccttcctccttgcattgtaactgctttctccaggcctttgggctgcccatcaccgtggcccatgtggatggccaaacccacatgttatttggctctgaccggatggagctgctggcgcacctgctgggtaagtaagttaaagaatcaaccctgagccaggtgcagtggctcacgcctgtaatcccagcactttggtaggctgaggcgagcagagcacgagttcaggagattaagaccatcctggccaacatggtgaaaccccgtctctactaaaaatataaaaattagctgggactacagctgcctcagtgggaggctgaggcaggagaatcacttgaacctgggaggcggaggttgcagtgagccgagatcgcgccactgcactccagcctgggtgacaaagcaagactccgtctcaaaaaataaaaagattcaaccctgagctgcctttgaccccagctccacacccactatatcagttgaccagaaggaggggctcagagcaaaaaaatattcttggcacttccagtaacaaagcgttatgcagtcagtgctgttcaaggttgagtgggcaggggctgtcttcaaccccataaaagaaaaggaagccttctataccttgaagccaagcaaaagtctttctagaaaacccctgggaccttgtgggaccaactcctgctgccagaacacctgagaacagtgtgcagagtctgttgttttcttcatccaggagagaagtggatgggccctatacctccagccgtgaatgccagactttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaacatttctgtgtctgtatctgccctggtatattctcattcctggggtcacatcctgcctactctaggggtaggtgaaggagagctgtttcagtatttccagccagaccagccatgcagcccaccttgagcagcttgtgcggtggaagaagtgagaatagtcccccgttctctcacacagaaactcccctggtctctctatcagcaacagaaaaccaagccagatggactttgcaactaatcaagtttgggatttactgtcttctgaccaaccacagtgactgagatggggctgggaccagaagcccagtgggagtgaacagccgagggaaccagagtctggctgagcttgtggccagatatttaaactgggtccagccacacctgcaaaaccagggcaaggcagtaccgggaaactggctggagttgctgcggtttggggaagttgcacaccctttcatagatacctcccttaaccctcagtgcagattctgagaaaactccaaggcttctctgcctaacctagtataacccctgttccctactacatacatataacttttccattcccccagtaattgacccaaagtccctgcctctagctgtgcccattgtgcaatgatcagaatcccttgtttcaatagtattttgacttctttaagaatactctgtatttggaagctgaaacctcacttggatccattgttgggaaccaagtacggagccttacatagcccggaggagtttcaggagcaatgccactttcccttccatccctccctctgggtctggctcttcccatagtccattttccccttttatctcccattaatttctgtcttcctctctcaccttttccatgtctctagcatcctccaggatttaaaatcatctttacccaacttatctgtgaagtaatggcaaaagaacatctccaaattaagtactccttttcttcaaaggagtttcatgggatgtacagctagtataaaataaaaatatgggaagatgtccaatcttaaaaaccataagggcaaattaagacaaaactaagctgcccagagcagggtgagtggaaccagttttatgaataaagatgcttgtctcagcactatatgtggatatcaaaaattgtgaacaacttgaacacctatcaggaggagaatactttaatcaattatggcacattcaggagataatgttttacagtcatcaaaaattgtatatgagggccagcacggtggctcacacctgtaatcccagcactttgggaggccaaggcaggcggatcacctgaggtcaggagttcgagaccagactggctaacatggtaaaaccctgtttctactaaaaatacaaaaaagtaaccgggtgtggtggcacgtgcctgtaatcccagctactcgggaggctgaggcaggagaatcgcttgaacccgggaggcagaggttgtggtgagctgagattgcactattgcactccagcttgggcaacaagagcgaaactctgtctcaaaaaaaaattgtatttctgaagaattgttaagaacattggaaattcttgagatataatattgattggaaaaagatgaaactatatggtatgatctcaatatgtcctgatgaataaaaacataatacagaggacattattctgagataaaatacatcaaaatctttccattttatttgtatacttttacaatttttgattttttaaaatgtattctgatacacaaaataataaaaatgaaaaataaaaaatttggccgggcgcagtggctcatgcctgtaatcccagcactttgggagactgaggcaggtggatcacttgaggtcagcagtttgagaccagcctgaccatcatggtgaaaccccatctctactaaaaatacaaaaattaagctgtgtgtgatggtgcacacctgcaatcccaggtactcaggaggcttatgcgggagaatcgcttgaacctgggaggcggaggttgcagtgagccgagatcgggtcactgcactccagcctgggcgacagagtgagattccatctcaaaaaaaaaaaattgtagattcacattgcagtacaactgtgcatcttgcccattgatttctaaatgtattaactacttaaattaatcctgaatcttttcccaggcttaagtgggataatgttttattgtagatgcatatttcctggctctacccagtctttctttgaagactttatcatcctattttctgaatccagtggctgactttaatcttctctggaggaactagataatttctagactaatgcttacactcatgatccagattgtaatttctgaactccttcttccaaatagaatcaaaacaagaaaggggaaagcctctcaaagcaactgtgcgttaataatgaaacactctttttttctaatccaaggagggtttcatactttttcttagtttcttgccctcttcccttctgatcaataattgtaataggaaatttgcaattgtgccaatactcagattcaatactgaactactttcttgcattgtaattcaaattccaaggttaacaactagctgtatgtttccaaaacaatcttattgtatatgtattttcttaggtgaagtttccagaaatgattttttttttttgcagagccaaacacacatggtaatttaaaaaaataatgcacgtatgtggtaaaaacagtaaaagcaaggtatcaagtaaaaagtgaagagtcctccctttctcattcccattcctactctctaattttttatatatccattttgtaagctataatacagagattccatatactcttcacatactttccccagtggtaacctcttgcataactataggacaataacacactataggacaaaaatcaagaaattgacattgatacaatccatcaaccttattcagagttcaccagtttaacacatgcttattgtgtgtctgtatttagttctatataattttatcacatgtatgctgatgaccaccaccacagccaagatacaaaacattttcagtgtaaagatttctcatgctacccttttatagccacagctacctccctccctccctgtacttccctaacccttggcagtcactaatctgatctttatgtcttgtcatttcaaaaatgctacataaatggaatcagatttgattgttttcattcagcacaatccctttgagatctatccaaggttttgacatgtatcgagagtttattcctttttattgctgaatagtattaatattctatagtatggatgtaacatagtgtgtttaaacattcgcctgttgaaggacacttgggttgtttccagtttcaggttcttacaaataaagctactctgtgtgttcatgtacaggtttttattttcatttctctgggtaaatgcttaggaacacaaccactgggtcccatggtaagtccatgcttagttttagaagaaactgtcaaggctgggtgcatgatggctcccatctgtaatcccagcactttgggagaacaaggcagaaggatgacttgagcccaggaattcaagaccagccagggcaacatggcgaaaccccatctccaaaaaaagaaaaaagaaaaagccagacatggtgatgtgtgcctgcagtcccagctaattgggaggctacagtgggaggatcccttgagcctgtgaggcggaggttgaagtcagctatgatcacgccactgcactccagcttgggcaacagagccagaccctgtctcaaaaaaacaaaaacaaacaaaaaaaaggaaagaagaaggaaggaagggaaaggaaa

SEQ ID NO: 6414 - DNA, 434 bp, Homo sapiens
gaaactgccatactgttttccagagtagctggtttcacttttccaccagcaacgcatgagtgatccagtttgtccacagcctcaccagcatttagtgttactactgtttcttactttaatcattctgataggtgggtagtgatagctcactgtgatttttaatttgcatctccccaatgactaatgaacatcttttcatgtgctacttgccatctgtacatggtcgtcagtaaaatgtctgttcatgtcttttgcctactttctaactagactcctttgaaaatttctcatattgtttttaacaatagattttaaaagaatttacagagtaagaatacatttttgagacaatggggaaaatgatacggagtgaaaggtgatattaaagaattaatgttaatttcattatgtgataatagctgagtggctgtgca

SEQ ID NO: 6415 - DNA, 15932 bp, Homo sapiens
tccaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcaggtatgtaatgatactgagctacaaatggtgcttctgtgggaatttttgtttcctcaatgaagtatctaataagagaaatgacacctcagtgattttatctctacaggcaacttagctaataactaaagccccagtggaaagctttcagggtgagaccagaaaactaagatttggttgagtctcagtaggcctctagtgctgccccccagccccccagtctggccagtcgcaactatcctcaggcatattgctgaaggaatgatgcttgcttgctgcagataggtcccctttggtgaaaggggggagtagccaagtgagatagtgctacccccgtgcctgagtccagcagttctgcagagccatgctgctgccccacccaaggcctgctgggcagtgtccctgggagtggtaggcagagggacacccagtgctgagtccagggtctggtaccggatagtgggggctagggcagtacatgtggggtatggggtggtgggggttgcaaccctcccaaccaacacccactttctccagacgcatgccccatgtcccgacacaggccagcacacttagctggtttctatctccaccctctctttttcattcccttgacacgtgtgtgttgcttttggtcttactgaagagtcttcccattcatgtatcaatattttgaaactcttagtggatatcttattaaaagagagggggaaaatcacctatgaatctctggtgcaatagagtagcctcagtcttcttgatataagttatttgttaattctagaatcattattagatcatgcttatgtagttggtgttggccctcttagcccctaattgctcctgccataggcagagtagacggcccatcccctattatttctcaaagtgcaaccattagtttccatgaactcctcctttcttgctagatgagcagaggtagctgaaggtgaacctggccctactcctcctgtcacctctctctttctgttagaaatgcatgaggttgacagttgtttcagggaaacatgactcctttcacttcctccagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggtgagtcctgagcagagccccaggcactctcggtggcccttccctctgccctcccacgtacccagtccacacagtctcgatctgccttcaggagtgcagaggacagatgggacagtggccttgacctttgctttggacttactcactttctttttctttcctccctcccccttcccctccatccttgtcataatcatcatcattgtttgttagtgtctgtcttggaaatagttcagagagcttctgtatttagtttgtcatttgtacattcttaatgacaccgcatttgccattgtgatgtttcttaggtgtggacttctatggcactaagtgcatcacattgtgcagccatcacaactgtccatctccagtattttttatcttgcaaaactgaaactgtacccatgaaacaataactctgcattgctccctccctgtaacccctgctcacccctcttctactttctgtgtctataaatctgcctactctggctatcttatgtaagtggaatcacacagtatggttttctttttgtgactggatcatttcagttagcataatgtcttcaatgttcaaaaacattgtagcatgtgtcagcatttccttcccttttattgccgggtaatactccattgtatgtgcagacacttggatgataactttcaccttttggtttgttctaataatgctgctgtgaacattggctgtcccttatttttgagaaagtttgagaaagttaaagatgtcggagaggtcacagaagcatctgtgtttcagttacccagaactaacaactcttaattttgccatatttgcttttttttttttaaatcatctgttcacttctcccttcccaagagaatcactgtttactgtcatgaatttggtctgggtacttttagtccattttaaattttacattcatatatccatcaacaaaatattgactgttagtctttaacttacataaatgaaatcatacttcagtgtagccttctgcatcttgctcttttcactcagtttttttttttttttaattatttattttttttttgagagagagttgctctgttgccccggctggagtgcagtggtgggatctcggctcactgcaacctccgcctctcggttttaagcgattcttgtgcctcagcctcccaagtagctggggttacaggcatgtgccaccatgcccgtctaatttttgtattgttagtagagacggggtttcatcatgttgcccaggctggtctctaactcctggcctcaagtgatctgcccgccttggcctcccaaagtgccgggattacaggcgtgggccactgcgcccggcctactcagcattgttatttttacctttacatctatatgaagatgtagttccattccttttaactgttgttttcaacatagtaaacttttaactttagtaaaaagaaagggtggtgagattgtgcagttcctgtttgtatggcaccttgcatttgtcaagcatgctcatgggtgcccacacgccccgtgagaagggcagggcaggtgtccctgttctcactgtcatctgaagactcagcctcagagaggatgcccgaatcctttgacaccatgcagtcagtagctgagtcttgaaccccgggcttcttcccccagatcccagtgcacttcccacctcatctcctattctcctcatgggctgttctacatgatgaacacaagccatagagaatttccttcagcagcctgcaagctgtactatttcttctctctcccaccagcagtgagaccttaaaagaaagtcttgtctgagagactagtgcagtagcagccatgaaaacctagaggaagtgcccacgtgtacgcgattccactcagcagttctccgcgttttcagttttccctgtcttgtctcgctcagcctttttagacattgttgtcttaatggccccgcataaaatgttcacagcactgataacgttctgtgcatgtgcatctaccacagaagactgaaggtttgcctgatgattccagtgtgggattttaaaaatggaggccgggcgcagtggctcacacctgcaatcccagcactttgggaggccgaagcagacagatcacttgaggtcaggagttcaagaccagctggccaacgtagcaaaaccccatctctactaaaaattcaaaaaccagctgggcgtggtgacgagcgcctgcagttacagccactgggaggctgaggcaggaggcggaggttgcagtgagccgagatcgccactgcactccagcctgggtgacaaagcgagactctgtctcgacaaaaaaaaagggggtacattagttaagaaaaactacaagtgtgtcttttgcttgagggaaaggctaacattagtagaatgatgaaaattattaatggtgttgctgtacagtagcatagtatgcagtcttcaagttgcatttgaaggttatataatagtagggaaatgtccccagtgtaataaatggtgtaaaaaaacaaaagacaatgtatatgtgaaatatgattccaattttatacatatacacacacataaaggagactgtaaagaactttgggaggccgaggcaggtggatcacctgaggtcaggagttcaagatcaccctggccaacatggcaaaaccccatctctactaaaaatacaaaaattagctgggcatggtggtgcacacctgtaatcccacctacttgggaggctgaggcaggagaattggttgaacccgggaggtggaagttgcagtgtgccgagatcacaccattgcactccatcctgggcaacagagtgagactctgtctcaaaaaaaacaaaacaacaacaacaaaaagagattgtaaagaaatatacctaaatgttcataattgtagtataattgcacgattcatgtttaatgtttaattaaaaaatgtgagaatatcagtttaaagtgaaaaatcagtcatgcattaatgatattaataacctatgcattttaataccgaatatacagttgaagtgtactttttgaaacttgtgataatgtgtttcttttaatgcaggagacagtgtttcacaaaatgattttccttctgaagctcccatctccttgaatctttctcataacatctgcaatcccatgtaagttttttattttccagcttttacagtatgttttgtgtactgctttttctaccaattattgtgtttcttctttgtacttggttctgcaggttaaaatatgaaaactttttaaagatgcaggaaagtaaaatctgattttattaattcaggagtggcgcaagtaaacatggttcatgtgggagaggctcaggtatcgctattttttttcagacaggtagccacgttggaaaatacctaagttttgaggccagccgtggtggttcacacttgtaatcctagcactttgggaggccagggtgggaggatctcttgagtccaggagttcaggaccagtctgggtaacataatgaaactccatctctaaaaagaatttcgttttttctttttaaattaggcgtagcggcgcatgcctgtatttccagctactcgctgaggctaaggtgggaggatcccttgatcccaggagatcgaggctgcaatgagctatgatcacaccactacactctagcctgggtaacagagcgagatcctgtctcagaaaagaacaccttatttctgaatatagaaggaggaagcagtagttattataaagatgggaatcatttaccctttgctaggccttgaaataaaactgagcattgataattgaggaaattttgcaagaacctagtagatacatgtttccagttctgccctatgatgatttctgcagcactggacaaaataaacaagtacaatttattgagtgagagacgaggagcgtgggtaagaaggaggagagttcagtgtgagaaatgaacttggtttcttaggtacctccctcttggtaagaggacaaaggatgcagttaagagggtgagtttgtgaggaaggaaacttgactagtgcacaggaaagctcttcatgggtttattgggggtaggttgtcagcaaaggagtaagagttgctgctaactgctagcctaggcacactccccagtcagcctccttcccttgggccacgcatctcccttctgtacttttctgtcatctctgactagggaaggtgaactacctggaaatacagacaggtggctacctgtctgaaaatctacctgacgggtagatttaaaaccacaggttacctcatagttatgttagttaattttttttgttgttggttatgacaagactttgctagatttgggaatttaatattcctcaattcttttctggctgtgtaactttacatcctttatatctgtatgtttcttccccaagaaactcttccccaagacttcaattgagtgaaaactcaatcagacgtggttatacaatatcagtatttcctcgtgcagaaaaaatgagtcgttcctcctttgccctcttccccacaggaccgtgaatagtctcccacaatacgcagagccttcctgtcccagccttcctgccgggcccacaggtgttgaagaagataaaggtgagatgcattcgtcttgctgcagacatcagccaagggttctgtgctgtctgtattcctggctgatgagtttgagaagacagagcaggcggggtgggacagggccatttccccaccagccccttctgcaagccacacgttcatacatcaggaaggcacctactctgtggacgggcatcattggggccccagctgaccttgtgcatcaatagtgagccccctccctacagctgaggcacagatgccctatgtcctggaataatcccaggcccctcacagcagactcctgattcatttagttcaccttccctagtcagagatgacagaaaagtacagaaggtagatgcgtggcccaagggaaggaggctgattggggagtgtgcctaggctgagggtgcagcacctcacctgcttaccactttccctggcctgcttcccttcctccccaactcactttgtgtagaagcctactaattcagcctcagcagccttggggacccgccttgctcaggcatcagtgctgagaccttctgcctgcggggaaggcagttgcctaggtgcatggaagtaggaatgggtgggaaggaaacctctcctgcctgggggctctgatgggaggtgaattccagtcctccctcatttttcttctcttttcctcctcttctgcctctctttgtcttttgttttctgtttgattctagggcttctttcttgcctaacgtgggtcaggaattgtggcaggataaacctgatttttattctctgtgtctttaatacacatacttgcttttggtcatagaatttaacactggatttaaaagctgctctgcacattggagaattttaacccttgaaggtgaaatactttatgtcgttccttggatgaattttggacttgtccagttatcaacagaaatagcgaacctagtgactagtccagtaaaataagtgttttcaattaaaaaaatctaaaattaaataatccatagtttgcaaaggcaagatgtgggggcggtttagatggtactacctttttttctgtgagagaaaggtaggattttaatggtgtggaaaaataaaaactgtcagagcatctacccttcagcatgtgccgttctgctttgctatcagttggagatatacgtgcggtttggtgttctaacccaggtttgtgtgtgtacttcaagtgcctttaccttggccccactgacagagtacatcttgtctgcagtctgttgcctgcaaagctgtgggcccatcacctttgtactccctcacctccctcacagccgtgttttccttcttgcccagctgaaatggcctgatccattgttacagtcatttcctcgactcctctccctttattgcaaagccccagccatggttttgcctagtgccccacctgctcctgtgcaggcaagtgaagctggagagcagcattccccatgccagctgcccctgtggattccccaccacccacttcacatagtgcctgtgtcctcccgccctgcccctctgtcaccacagttccaaagcctcgtgcctcgtttacttgatcttgcttcttgctttactagaagagagagaagtggttacaggccttcagcaagctcccactgccctctccaccagcccaccatgtcatgccattctctgcctctctcctgttgtagcctgaagaattgtcagtgcagcccttctctccaagggtattactgcagatttcccttctgcatcatcagtttttctctaatgggtcattctcatcagcacacaaatctactataatacttcccgtcattaaaaattcaacaatagccaaagctctctcttgactgccttcttcagtggctgctctgtttctctgcccctgtcattaggagactccttagaagaattatgtgagttgcccattcaaattcctctcctccctggaaacccctgtaatctggcttttgccaccattgctcttttgaaaccgtgctgtcggggtccctggtgatttgcacattgctgagtgcttggttaagtcttttcagtccccatattggcctgtgacagacactggacgttctattctggctggtagaccttaggttcctgacccagcttctccccatctccccacctcatgaccctggagccctccagagagcaggccttggtgctgtgcttttctctgtctgtgcacactttcttggtgatctcatccactttcaaaggtctgagtctttctttgacccagacaactaccaaatgtatatgcaggagacattcactctattgtgttgtacttgaagcaaacttgtgcctggccccaaagggagacactcttccttctgagactttgcataacaaatgccctgggaaagataggtcagaataaaggagccagtgttgcttctcataagaagcacagaaacctgaaagacccagggagaattgtctcacaacatacacaccccttatttctatgtagccctggcttctggtagattttcacatgcgtacatcattccataagcaattcttaatcagacctagggaaggtggaaccaatctgctttgtctgtctcatacatttattaacagcggctgtccacaggagcctacgcagcaggatgaggccactttgcagtattgacctcagccatgccctagagtctcagacccaaccagctgaacaaatcccacagaccaccagggtctaccttagagagccagatggctttctctttaagtttctgtgttgatctctccacttggccagaggcattactccaggtacagcaggatgtgttagtgattgcatagactgcaccttggcctgcaaggagaacatctggagccattctgtcatctgtaacaaccacggccagtgagttgaggctgatccaaatgccttccagggaccaggtgctgtcttcagtcacttcagctagtatcagcaaattccataccagccatttctaactggatagctccttcctagtgattactgcccataggatgtgcgtgaaccagttatccttccaggaagcctactgtgtgcccgttgtgtgatgctggaagtgttgccatgtctggggcaatgatgcacccaggcaacaacaatggcagcctgggtgatgcagacctgatcagtatcttgattccagctggccgcagtggagaacatacccttaccaaggacctctatcttgactggctgtaaggtttaatcagaagccaagatccattttcacatttcagagccctggagaacagtgtcttcaatctgcccatctgttgcttcccaagtggcagaccaagcacctaaaccattggcaatagcctgagagttgtttacacctagcagggtttcttcagggcagaattagccagagctgtgagaaccactttgggttctgcccactgatcaaaatggttgtggtccttttcagttctgcatggtgggcattgaggtgggacagctgcagcctcccagtagatgctgtctgatttcagcctgatccagccatcagtgagccaggcccaggcatttaagggagcccttgggaattgagggcccactgagccaacaacttcacttcaggtgcagagtgggggataaagtttccctagaggggtacctgccatttttccacataaagctgaaatataggtggggcaagcccactgcatgagcaccagcctctttgcatgagttcccctgagccccatggggatatttaatcacagaatatctaatatctaatataggggtgactcagacagccctagatggatgccacacacagtgggttgtgctacaggagaagaaccctgagctttgggaccccaaagcttttataataggcaacaagcatgcctgccctttgctccagaaagagacactatatgttccgaggcttttgcttagcaaacatctatgaaaagatagtccaggagaaaggttgccagtgcctctggcagaaatgggagagatccctagagacttgtgtccaagaagtcaactctgctcaaaaccttccagtagcttcaaagtaaatgcctaaattcttcaaggggcccacaggctctgtcttctctgctcccaatccgctctctatagcctcatcccctactcttccactttcccctctccttcctggctacactgatatccttgctgtttgaactccccaggcacaccttgcttcagggcttttgtggtactgtttctgctgcctggaatgtgcttccctgtacccactggactcacttcctcacgtcaatcacgtctttgaggagctgttttctcagtgaggcctttgaccatcctatcttaaatcattgtatttggccaggcgtggtggctcacgcctgtaatcccaacactttgggaggccgaggcagtggatcagttgaggccaggagtttgagagcagcctggtcaacatggtgaaaccctgtctctactaaaaatataaaaattagctgggcatggtggtgtgtgcctatagtcccagttacgcaggaggctgaggcatgagaatcacttgaacctgggaggtagaggttgcagtgaaccaagatgccaccactgcactccagcctgggcaacagagtgagaccatccctccccccacccaaaaaaaaatgctgtatttgccatcatggcacgcacattatctggcatgctacactttgtttgttgtttgtctttgctcacttgaatgtagcttgttcactgctgtatcctcagtatctttaatggggccttgcagaaagtagttcctcaaatatttgttatgtgagtctcatcttgtcatccaggtcaagagacaatcggacactgtctgaagaaacggtcaaaacaatatgctgtatttcagaattatatcctgaaattatattccgaaaggagttagtcagcatgtgtgggtgacattagggagtgttttctggagggaagggcaggtgcaggaagggtaggatgagggccaggtgaggatagggtggactcaggccttgttctcttccgtaggtctttactcacctggagacctgtggcccactccgccagtgtgtgtgacaagcagcttaaactgcaccctggagaacggcgtgccttgtgtgattcaggagtcggccccggttcataataggtacagcttcacttctctgattggtgccttgcttagtctaagggcttgcagttggaatttgagttcagtttcttagggtttccttacaaaaatgaaggctaggcttcttccttggtgtactttagctgtgcgtttccttctgccttttagagttgcactgggactaaaccaggcattgagagaaacatgaaataaaagaaagaaagctggtgacagtgtcgttattttttaaaaacgtctttaaaaaagacgattttttcatatattagaggcagatttgaaaaaaaaacactcataattcctaactgctagcagagcaaagctgttcatttttctgtggcattattcttgaacacgtttaacgttgtatttattcgtttgtttatttattttttagagacagagtcttgctctgtcgcccaggctggagcgcagtggtgcaattatagctcactgcagccttgaactcctgggttcaagcggttctcctgcctcagcctctcaagtaactgggactacaggtgtgtgccaccatgctggtctaatttttaatttttttttttttttttttgtagagacaggatcttgctttgttgcctaggctgctcttgaactcttggtctcaagctatcctcctgccttgacctcccgaagtgttggtattataggcatgagccaatacacctggcccaaatttaaagttttaaaagatcaaataatttgaatattgaaaaatagttacacaatggcagtttctcaaatttgctatttgacattaatatgtcattctattagggagtcttaagaaaatgttagatatttaatcacagaatccatttgatggttttcttggttcagcttattacaacagtatttcctatctcatttctataataagaatctaggttgcaatagggatcaaagtataatgaagtatagtctttatagttatgcttgtctaagatgaatgctggtcttgctctgagtggacgtttttaatggaacatgtttaagtccttcagatgtgcacaaagacacttaaaggtattccagctgttctttcacagtgctgataaagccacggctctctattctgtctctagttagacttaacaagcatagttaaaaacaagtgtgctcctagtccagccgtccatcctgcagatggcatgtcactagtgatcagcatttagtaagcctttgattctgtgacttgagaaagtacatcttttattttccaaaattggggaattcacagtgattaggatgctaggcagtaaaatcattttccattttctttacttgatgtcttgacatcctgtttctgattagaccacttgttttttgtggcagtttcattgattggagtgcaacatgcgaaggccagttttccagcgcatactgtccattggaattgaacgattacaatgcctttccagaaggtaagggctcttcagacaatcccaacgccattattttattcttagaaggtcaaagcaggaagtgtgtggactaagaagaatccttttaacagcgagcagactttgagaatgagcttgcagtagactgccgaatggcttcatgtggatccagttgtgcactgatgccatatataattttatatgaccctcaaaaagccctcaattttgggtgtctgggggcttcaaaaataaccctaatccatttagtccttccagttaggtagaactaggtcatttggatccatgtagatgtaacattgttgggtatccattgggaagccggggctttagctgctcgctcttctttttaggcagtcaagtcccatgtgaaatagaaacattggcctgcttcctattatgtccttaacttctctgcccttgggtggtgctgcagaaggaaggaaagaagcttggaggggaaattgtggaaaattgcagatgcttgggctcaagcatctgtaataataaaaaaatgagagctatgggatatccctggtcaactggaaaatgctctattgtgcactactgttggatcatggtttcttatactagagctgccctttcagggaagggatgtatcattcttatctagattttgatacatgcattgctccatgctaaccacaagggggtgctttgggaatgttatgattgtgagggtctgtgttcattatgttcttaatggtatctaaggagtccttggttttggattgctgtatcagcccagatgatatatgtgtaggtcgctgaggttggcatgacaggtaataaaaacattttaaagactggcaagaaccttgacactatttagatatctagtagtattttaatgtattttgtgtaatagaaagattcccatcaagtgatcaaatagagaaaaacaagccaggaggaagaccttccacattgagggcttcccaggttgtgtgtctgataaaaagttttaatcttgagaatgatgttgcaacgactctcctggtccacacggaccaagtatttatgtctgtaacttgtcagtatagtgagaccttgaaagcttttttgcctgagagtgagaattcagttctcaatgaaaatgtttacctatgatgatattctcccattctttgtagaaaacatgaactatgccaatggcttcccctgtcctgcagatgttcagacagactttattgatcacaactctcagtctacctggaacaccccacccaacatgcctgctgcctggggacatgccagtttcatcagctctccggtcagtgttgcccatcctgtgccgtgaacccctgggcagctctgaattgtttccactgcttccttaatcctggtctcagctagctttagcgttgggtttggaccagccaaagcctggcttgcttcttttagatcacagaagccagggctggccaccctctgaaggaaactgacatgtaataattagatgggtggggtcttgcagacattgacattctggccaccccaaatgaaaaacatccccaaacacaccaagcaatggtcctttgtagataaaattgaacatgggccagccctctgtgtgacacagctgtctttatgtggactcactgatctttacttcaccgatacgagatgaaagtcccaggaaggtcagtgggtggtcagggtcccagagctccctgcctgtgagcacaccctccctgctcagaagcccgatggcttctcctttcacatccgcttgacacttgtttttgtttttttccagataaagggtatttggcctgtgggttcttccccgggttgcaaataagttcatcccattagatgaggatttcacaatcctccctttgagaaaaaatggagttaaagcaacccagatttaaattgagagtagtctaataacttccaagtaacttgatagcattgtagtattcgctgatgtgtattcacctttctaaggcttttttttttcttttaacttatttttccttcctcatttatacttcagccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaatctgggtgctctgttttttttaactcttcataaatcagtggtaaaaacaaagcatccatatgtcagaactttcaaaagtcaagaagtgtgtcaggcatgccgaatgttttaaatctgaacacgggagacgtcttttttttttttttttttttttttttgagacagagtctcgctctgtcgcccaggctagagtgcagtggtgcgatcttggctcactgcaacctctgcctcctgggttcaagcaattctcctgcctcagcctcctgagtagctgggattacaggcgcacgtgtgccaccacgtccagttaatagagattttcagtagagacgaggtttcaccctgttggtcaggctggtctcgaactcctgaacaagggagacttctaagaaggtaggagttgagcaagaaatggctgctatggttttcctcctcctgagcatcacaaccatctggggagctttcaaaaaatgaagttgctcagccgttgagaactgctggaaagcccagcttaacaagttgtttgcttgggtggactctgcttgggggtgcagcggggggttctttccagtcctggtgtgttgctgggatgaagcagagagccctagaactgttctctccatcccacttacggcaagggctgttcctctgtcaggccagtccttgggggcaatgacagcagcaggaacattctggtaagtgtgtggtttccctcccagtgagcaggctaaccctgagtataggaacttaggggaggttaggtggctgatgcatgttttccagaccggtttgtatctgcttgtcattgatcttagaagttcatattatggtggaattatctatttgcatgtgtaaactttgaatatgtttttaacttttaataaaaagttatttttaca

SEQ ID NO: 6416 - DNA, 9303 bp, Homo sapiens
atttgagccttttcttggtgtttctactcctctatgttctgctgcctaaagaataagtgtgtagattcagaagtagtaatgaccaaacctcttgataacagccatagggctcatttattaagcacctgctgcataccaggctccgtgcttgccttcatcctccctcaccttaccagggtgggttttttatccacttttggccctttgctagctggggtcccctcagaccctggtcctataagggactcacacgaggaccccctcaaggcaataaagggaggattaaagagctgagaggtacagagggagcagccagcatcaggctcccaagaagccctcaataaatggcaactggttacagcctctcagccctctagggatgcccaatgctgctggtgtcttgatgacttgacttcttcaagtgacacccttcttactgtgcccataaaatgtttgcatgtggtagggagcaagttaatatttacaaatgcaagtatgcctaatatgtgtttcctgatgactgctataggaggtgcagggtaataattagcaatttggagacacgtttaggactcatctacagggagaaactaccctcatttttctgattctccagtttgtgtgctttcaggacccaggatagatttctgcctgttggggtggcctagatctttgtctcttgtaatgaattaacgatgaagaaatcacccacctttggctttcttagtactcagtgatcattgtttttggacccaacctggcccaactgaagacctagattccaagaaaccttccctcttttcaaatttgggacttggcacagattagacctgctaactaaaaaaaataatgattgataggaaggccaaaggaaatagcatttatctgggaaataaagagttgcaatttgggaaccctgagtcatggtagtcctgaacagtgtcccatagggcaatgcaggaaaagttttgtactggggactttcacaaaatgttgtttttgaaaacagttcattgcctggcagaaatgctaaactgcaaactcgtatgaattggttacttaattaggacactccaggatgagagaaatcaaaatcccatgtaccttgacttcagtccattgttatccaggtctacagcaacatcctgtggcttgacctttagcaggtgtgagtgcaatgctcttacaaacgcttgactccatgttaaagctttagccttaactacttcattttctttcaaaaactgtactggaatatttgtgaaaagaatgaaaaatatggaataaattcataaatacacaaagagagagagctctaggtatatgtcaagtctggattaaagacagatctgtgtttatttttatgaagcatcttctgactttgatccaaagcaaaacttcttccatggccccatttaatccttgttgcacccctgggaagggaaaatgctgctgtcccactttgcagatgaggggctgcatgttccaggccacccctctcatgggctgagcagcctggttgcaggtctcatggtggcgccactttgccattgttccctactttggcttctgtaaacaccctctctgaggttggtgagctctcctggggaaacaggctagcaccagttaatacacagagggagaacaatcagtaactttgttcctgtgcccagattggtggaagtcaccctatgtggagaggaggactttgaactcagacctggacttccctctgggacctttccctacactgtctgacctggggctggtcgtcacctcttccaacctttgcatcctgctctgtaaaatgagaataagaacaccatcctctccacattattagaaggattaaaattaatgtatctgaaggttcttaacagtgtcacacactcatcgttagtgattgtcatctcagtcatgtctcctgtttatcgatgccccttttgtagccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgaggtagaggaccctcacacccagcccaagcccacacctggctgtcaagcccactcccctctccccaggctgttgctccagaggttgaatggcctgtaatctaatccctgactatactgcccgcccgccatgcacctaggtgtgctggtcacttactatcattttattggcagcggtcaggggaccagcaatcacgtgccaagctctgcgctagagagtttcatttatctcaccaagaacaactactattagtgagtacctactatgagccaagtccctatgtgctcggcgatttcactgattttgctacagttcttacattccaactgcatgccaggggttgtgcttgtagatttcactcattcttagcctagtaggagctaccagtccttgagcacctactgtgcaccaggcactgtgcttggtaatttcattcatatgcaaagagcgccctcaatgtcttagcatctgctgcctgcctagcactgtcctggtgatgccctcaccgtggtagtgggagttaagttatggagccctccctgtgatctgtctgtgccagaagatcagagcttctaccctgtgctgtttcagttccacccaccttggaggttactcaacagcccatgagggtggggaaccaggtaaacgtcacctgccaggtgaggaagttctacccccagagcctacagctgacctggtcggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctagaggtcacagtccaccagaaggaccagagctcagatgctacccctggtgaggttactcaaaatttttaaattttgtctttttctctcattttaaaagtaatatccacacttgctgtaaaataagctagaagtctataaatacaaagtaaaattttaatgtcagctccatccccccaaatcccacatgcgaagagtcatgactagtaagaatttgatgcacaagttaatagaacttttgacataaatatatgtttaattttttttttttttgagacggagtctggctctgtcgcccagactggagtgcagtggcgcgatctctgctcaccgcaagctccgcctcccgggttcacgccattctcctgtctcagcctcccgagtagctgggactacaggcgcccgccaccacgcccgactaattttttgtatttttagtagagatggggtttcaccgtgttagccaggatggtctcgatctcctgacctcgtgatccgcccgcctcagcctcccaaagtgctgggattacaggcgtgagccaccgcgcctggcgtacataaatatatatttaaggagcaaagaggcaggcagggggaaccatcttctcatagagtcctttgccttcccttattccttgagagttgttgtgcccgtttctcatcagcccacccttgtgctccctactttttctaacctctgctttgtttctgtttcatccaaacttttccatcctcatttatgacctcatcccagtacaccctgacatctgctgtgtatgtttcagaaagacaaatgtagtttaaaactgtaccaggcctggcggctcacgcctgtaatcccagcactttgggaggccgaggcgggcggatcacgaggtcaggagatcgagaccatcctggttaacacggtgaaaccccatctctactaaaaatacaaaaaaatgagccgggcgtggtggcgggcgcctgtagtcccagctactcgggaggctgaggcaggagaatggtgtgaacccaggaggcggagcttgcagtgagccgagatcatgccactgcactccagcctgggcgacagagcgagactctgtcaaaaaaaaaaaaaaaaactgtaccaggcctgcaggtgaccatgaatggtcacagaacggacctcttctgtgtcctgattgtgatatttgagcaacaataatcacaaacccctctgcaaatttactaagtgcaaatttccattcatccatgatctctgtttttgcttcaaccacccagtaagtctggagttttaaagaaggggaaactaggacttgggaagtcatgggggatgttgttgaagacctcttgcctttagatcgggttattggttcaaactaattaaagtaaatctgggtccctgaggacaaggtcagtatcagcctaaaatgcaaatttgtgctagttagagaaacagtcctcttctgctgggcattgtcccatggacctgaagttggcctgtgttccactccgtatgaccaaaatatgtcttacttccctcttgtgtaataccaggaggagtctcaactccaggagacttttcaaaggcccaggttcctcccacataccttatggtggttagtcttatctgctgggtcagtgctaggtcacggatttttccatgtccctgtctgctggaagagtaaatataggaaatggagggcaaaaaatatcttctataatcagagatgtatggaaggcgtgtgatcatgtccacagctaactcagtcatgcatgtacacgcagttccaaatggaatccatagttgggtgatcttatgactaaagacagcataacaaaaccagtatcattattacagttaatacaatttcaaatttttaatcactaaatttcataaaattattaaaacaattcccttatatcatctaaaatggagtatacattcaaattttcctcaaatttcttttatgactatctttctgtgcactaaatttggttttaattcatatttaaatgctttgcagtatttttctttgaaacacttgggcctcaagaatttttgggggtgttttaaaagtataaattcaatttcctcagtagtttagggttactcatattattcatttcatattgggtgagttccggtaactcgtgccttttgaagaattttgtgtccattttatctaagttgtcatatttttgtgtgtagagttgttcataatatctccttattatctttttggtgtctgaagggttatggcgatatcccctgtttcaacctcatatctaaaatatgccatttctgttttcttcttcatcagccttgctatagtttttttccattttattggtcttttcaaaggaccactttgtttccgtgagtttttaaattgtttttgtgtttccagtttattcattttttgcactcttctttttattaattcctgtctcctgcttgctttgagtttattttgctctactttttctagtttcttgaagtggtgatttaattgacttgaggcttttgctcttttctatgtcattcctttgcctccgtttatggctggggctggtgttgggggatgggtcccaggtgcctggctgcagggctgtccctcagtcctgaggcccctagtcagtctcccttcttcctctcccaccttggaatttctcctattcctgatccttgtgatgtttctagggttcatagttttacttctcagggaggtaaaactgcaccatcaagactggattgcatttgcttttcagttattcatccacccactggcttggaccaggaccagggctggcatttttgggtgctttcggtttgccagatgtagcatctttgctcaggtactaaggctggaaatgcattttaagttgtctaggctggcaggtaaaatgcaagatgccttgtggttacataagtgctgcaccagtggcgtgggagccgggtaagagactgtgcactagggttaggtgagtgttctgttttgactcacggtcattttgcagtttggctttctctcttcaagtaatactgagagccagggttgtgcagaacttactttgttttcattttttatttgatttggggaggatattttatacagataagtagctatgctgctgcaattgtacccagcaactcttaagtcaaccgaagatctttgagtgctttgacccaaatgtccactcccacatctcagggtcccacaacttccccatcagggccctaccccagcatagcaaccgttgaagctgagattcatcctcctctgtgattctgctactcttttaatgatgtccagggcccaaccctctattctttctgccctctagccacaagagataagaaagtgcagtgctgccaagaagtcctcttgctttcacgctgaaccttaactcataatcaatcactcgtagcttctcagcatatttccccaaaaaaaatatgcccagtgatagccatggaacaagttagtccttataactaccatttcccaatttgtttcaaaagcctgatgccaaggaatttcctgcctgtggttacgccatcccagcttactgccagtgaaagttttatcaattgcatcccagccatggtgcccagccccactcactgccagccctgaggtcctcattgcgagctgatgagtattcaggcttcaaatttatattttagagtaagctttacagacaacttaccaaggtcagtttctctgtaaggcagactagagatggatacaggaatgcaggaagcatcctgaagagctgtagggtcagcatgcctcaggaaatggggaggcaggactgtaggaggagcgaggtgctgagctacagtgcaggtagaacaaagacccagctgctcctgcggaggatcccaagggctgagagcgtcatgtagtgttttttaattgaggagagaagcgtggccttcctattttcaattcagccaatctttcttgtgggctgtcccctagaaggaggagtgaacttggaattgggcagtgcagctttcctcaagggagaagaagtcccagagagccacccagctgagaactgccggcctccaacaccccagcagccacagatgctgagttctccatttcttccttaaggacccaccagcaccattttatttatttaaaatatactgtaatatctttaatggcccaaactgctcgcgttaaaaatgttgattttaaaagcctgaactgctcatgttaaaaatgcagcgtccaaacatgtgcttccccgtaactgagtgtgcccaactaacagaaagatttcagatgacacctgcactggggtggaggtggcctaggtgacatctgaggccctcccaagcatgagacccatttccgtgactcaccaggatgttttctagccggaaggtttcattatgtccagtgttccatggctcctccaagttctgagaacacggagtcctccccttacttctggggctaagcagggaacctgcaactctcattgtgaagccatcctcaagccacctgcctacccttttatagtcattaaaatgtccctaggaatttggacttgttttgttccaaaggacatggtctcagggatcaacctaaggaacactagtgatgagcttctttaggtttgaatgcaagtaaccttgtgaccctccctaaaatccatgggcctcagtttccctagcagaatggaatgacaatccctgctcccataggcttgtgagggtcaagtgaggaaccccgttgccacatgtatgaatacctgagtacacaccccctccacctcttccctccaggagaataagctggcaacctgggacaggatgagtgagaatggggagcctctttctgtggcttctgccttgtgctggagtgaagatagcctgggcaggatgcaggttcaaaggtggggcatagatgggcccaggcagcctcagatggggtaagtggaggcccctacaatggcctcccaagtggtctctctcatagcccctcgtcttccctgatttccaggcccggcatcatcccttactgcgctgctcctcatagctgtcctcctgggccccatctacgtcccctggaagcagaagacctgactgtaagtacaaggaagggaggacagaccaagggctgtctcagaagggcaaggccaacaggaaggcccagcccacatgccatgcagcaccagggtccgtggagttaagctccctccgcaccctcggaagtcttggggaaccctttaaaaggctcccaacccacagaaattatgtgggtggtgtacaatgtgggatgcttgaaatgtgttcaaagatgtccacagtgccctaggagtttcatggaggcagtgatgagtgggtggtcccttgcaggctatctgtagattatttgaatgctgggactccatggggtcagagaaatccacattgtaaactaatgttgagaaacccaaatgggaagccctgaaggctgtttgtgctctgaccctctgtgtgtctgagtggaaggaatattggaaagggcatcaggacttggcaggatggctgagcaggcagagttctatcaggactgcctgtccaccagtgacaggtatcccaggagaccagccccgagaacataacagactctcaggaaacatgtcttgaaagatgagcagatgactaagtgtggatgtgttttcctacagctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggtgccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttcc

SEQ ID NO: 6417 - DNA, 391 bp, Homo sapiens
ctgcatggctcccttcatccctccttcaagcctctgctcaatgtcactttattaaaggcacctttggcaaaccaccctgtacataatatcaattctcctgtctaccctggcattctaatttctcttatcttgattaatttttatttagcatttattaccataagcattataacgaatacaggcagccctcgcttttcacagcagtgcaagattgcaagaatgactgtgcagccggaaacccaggaaagcaatctccacatccaatcagaaaaacaatgatcatattgtgacctttacaattttttgtcaaaatataggaaactctcatagtgtcagttacaaatgtagaaggcaataaaaaataataaatgaatatttattagtaccctgt

SEQ ID NO: 6418 - DNA, 1093 bp, Homo sapiens
ctacgcaaataaactagaaaatctagaagaaatggataaattcctgtacacatacaccctcccaagactaaaccaaaaagaaatcgagcccctgaatagaccaataacaagttctgaaattgaggcagtaattaatagcctaccaaccaaaaaaagcccaggaccagatggattcacagccaaattctaccagaggtacaacgaggagctggaaccattccttctgaaactattccaaatactagaaaaagtgggacacctccctgactcattttatgaagccagcatcatcctgatgccaaagcctggcagagacagaacaaaaaaagaaaacatcaggccagtatccctgataaacatcaaagtgaaaatcctcaataaaatactggcaaactgaatcccgcagcacatcaaaaagtttatccaccacaatcaaattggcttcatccctggcatgcaaggcttgttcaacatacgcaaatcaagaaatgtaatccatcacataaacagaaccaatgacaaaagccacatgattatctcaatagatgcagaaaaggccttcaatacaattcaacaccgcttcatgctaaaaattctcaataaattaggtattaacggaacatatctcaaaataaaaagaactatttatgacaaccccacagccagtatcataatgaatgtgcaaaagctggaaacattccccttgaaaaccagcacaagacaaggacgccctctctaaccatttctattcaacatagtattagaagttctgtccagagcaatcaggcaagagaaggaaataaggggtattcaaataagaagagaggaagtcaaattgtctttgtttgcagatgacatgattctatatttagaaagccccatcatctcagctcaaaaactccttaagctgataagaaacttcagcaaagtctcaggatagaaaatcaatgtgcaaaaatcacaagcattcctatacaccaacaatagacaagcagagagccaaatcatgaatgaactcccattcacaattggtacaaagagaataaaatgcctaggaatacaacttacaagggatttgaaggacctcttcaag

SEQ ID NO: 6419 - DNA, 51961 bp, Homo sapiens
tttttgttttctgtttttttattttttgtatatatagagtgaacttagcccacccatgttgatagaacaccctcttagatgtcttgttctgtgtgcccaagtacatgccggaatgtggagaagaaatgggttctctctagtaaaccaggtaagtgttttctaattctatgaagagttttcattccattcttggcttctgtgaaggttgtaattttcagtggacttagtcagtgaaagctgagtatctatattaaaattgtttgaaaagattaatgataaaacaaaaagtttcttaaaacttttattcatagtttgtcaagaaataatggaaaaagtagaaatgaacaacagtggtcatgacttttacttgaaataattttttgggacaaagttggatattaaaaaataaaaacccagattttatctatttaaatcaaattgaattaaaagataaaaggccttttaatatagctgtaaaattgaggttttactttttatagacctcacataggcttggaatgaatttttttttttccaagatcagacaagatctggcacatttggggtggtatagccataaacagattttgtttttctcctgtgtttggtagctcctaaccttcctgagaccacaaccttttactttattcagaaacccagcaagttagctgcaaaatgtgaaccatatcatgaccactgtaatgtgaaaatctgtaattaattaatctttactaagataatgttaattgttagagaaaccacatcacacacatgcacacattcttgtacaaacttgtgcttttggggaaggattagagagagcctgagccaataaaaactatttactcaatataattacttttttttttagatttattactaccataatgtgaaatgcagacgtgagatgtttgacaaggatgtagtaatgcttcaggtaatgaattaaaagcattgaacttaaaggttgtggggaatctttgcttcttgttatttccatagaattcagtcacttgtgatcactcccaaatctacaactccagcctagccctgtctcctcagctccaaactcatatggctaacagcctttagatcatttccatctatatttcctagacacacttcatattaaacgtattcagaataactcctcatgtttcctccataccttcttcctgtcttcacttccctaccttggtgaattgttccacagtctacctagttgctaaagtcatatacctgaaagccatcctttcttcattgtcctctggttctttaactaatgtactaatgttaaacctcttagtttaaaccccttaaactaattttcaggactgcgatacttaactgcattgaagttccctgaatttgccatattctcatacatcttaaactctgcgtatttatttcttttgctccctaagttacccaccccttctttttccatttacgtagctaacttattttcctgcttgtctttgtgtttactttagcattacttcctccaggaagccttccctgacacactaaaacttggctacgtgtcccttttgtgaggaccctagcatggtatttaaccctgccgtagcactcacaaccctggactgtgattactgtttactcttcagcaccctacccccaccccaccaaaccatggcagttatatcttgtttctttttttgtcccttttgccttgcatagtgcttgtcacatagtagttgttctctgatactgctgaatggatttagtcattatagaaaaataaagctggctaggcacagaggctcacacctgtaatcccagccttttgggaggctgaggcgtgtggatcacctgacgtcaggagtttgagtccagcctggccaacatggtgaaaccctgtctctactaaagttacaaaaattagcctggcatggtgtcatgcgcctgtagtcccagctacttgggaggccaagacaggagaatcacttaaacttgggaggcggaggttgcaatgagctgagatcactccactggactccaacctgggcgacagagtgagactccgtctcaaaaaataaataaataaaaataaagtcaagaaatgtatatttcaaaaaaatattagttcagaataaaatctaggtttatttataatttatacaaatggaattaaaagagaattgaaactaatatttaaaagctgtcacttcagtcagtataatgcttgccagaaaaaaataggttaggagatcttgataatagtttaatatgatctgtatttttaaaatactagaaggttacttaatataccacatttccaagtccaaacggtgatcagagaaccccaaaataaaattttggcactgaattcataggaatacaattattttaaagcattagaaggaaagagaactcatagtctgtgttactgtgctgggtgggcttaggtttggggcttgtttgtattttgttttaccaatttagattcctttccacacttgcctgctaccacaagtaaggattgaggttaaatgggttttcatcttttattgggattggtgaaccttttaggattggtaaactgctttctcttgggcaagccaaactatctctcactaattgtttcaatagtggcccctttgaccttcctcttttcctttatctcaaacattaaaaaaaaaaaaaagacaggtgtctccatgatggatccaaatcatttcctgatgatcatgctcagccgctttgaactttatcagattttcagtactccagactatggaaaaagatttagttctgagattacccataaggtaagaacgtgttttatgaaaccacaacacattgctaaagaagcatctttccttctttttggatatgttaatcctctgagattatgcaatatgcatattcttatctctgaactttatcttccctcacttgttataggatgttgttcagcagaacaatactctaatagaagaaatgctatacctcattataatgcttgttggtaagtttaaattgtttgaggcatttaataaattacactgacgtttatagtagcaaatagtttggaatttctggcctgtgtttcctttgttttgagaggatgctcagtcttaggggaagagaattggaatatttctctttttctcccctctggttactgtaatattgagagtaatagcaccgtggtgctttggaagaaggagaaaatacaactactgaagcagaataaactggaagactgtattttgcgaggtggtggtagggggagcgggggacaggagaatttagcaatcaaggaataggatatttaagatctatttactcttgatttatatcttaactatgtttctctccatgggtttgtggtacaaaagtatcttcttgacttcagatacaataattccaagctaaaggagacctgtggctaatagatgtggatttcttcccttattacctatattttcagtcctttactactgttttagaccccctgcagtccatagagcagagaatcctggctactgtcaggagatgataccaatgaagaaagtctccgaagttgatattttatttgccactagatagtaggggaaaggaaggctctctctccttgctgccacaaggagaatggggtaaatgcagtttccttgaccacatttaatcccttcccacatttctgatcccattctttcaaaacagcagaaagagctctctccactacctaaagcctgccctcacgttttgggtctgagacacagaagcatggtcaggagctgctctctccctggcttattgcagaacagtcattactttcccattgctcagacagacttagagaaatataacatgctgcatgaattataagtatatatcacgaaagtattgtgattatgttaaatgtatgtatatgtacttttccatttttgacaggagagagatttagtcctggagttggacaggtaaatgctacagatgaaatcaagcgagagattatccatcagttgagtatcaagcctatggctcatagtgaattggtaaagtctttacctgaagatgtaagtacctacatttctaaaaagaaaaccatagaaacttttccctgcctatcagtctagtatctatagatttacttctgtatacctttctcacaattgtaaaatctattgtcatgggatgtgtataattccggtcactcttattatgaataattagaaaaagagaataggagtagaaaacagaatagtaatagaatcttttacaataaagccttgaggaagataaggacactaaacaaaaagtagcccaaacctcagaactaaggtttgtaccccacagaaagaggtcattatagggtctttagtacaaagttgctatgggtgtggataatgctttgtaacctagtatattgaggaagggagtcagaagtgcctactcacctatactgagtagaataaataatgttttcctaagctttttccttcttggcctccagagagtcttcttaatgacgagcccttgtttcattttagtgaatgcaaaataatagtgaaaaggacattcataggttaaattgcaactgtttttccttccaggggtgataagttccccagcaacctatatttcagccatggggtttttcagaaactcaacccttataattgagaagagactttattttcattgaggcttttcaaaatgtttgccctaatttgaaacatagatcaaaaccttcaaccttaattaacatttatttttctgagatttcaacctatcttatctttgttgcatagtaatacttttaaactttgtattataaatatttcaaacatctatagagattaaaaaatgtagtataacaaacccatcaccagcttcaacagaggccagtctggtttcatctatacccaaccactaacctctgtgccccactgtattatttcctagagaatactatatttaccatttcatctataaataggactatatgtatctaaaacagtgattctcaactgaggacaattttgccccccaggggacatctgtgaatgttactactcagggcaggatgtggaatgctactggtatctagtgggtagaggccagggatactgctaaacatcctacaatacccaggacaaccccctacaacatatctgatctgaatgtcagtagtgctgaggttgaaaaactctgatctagaaaatgaggactcttaaaaaccctatctttatgttatcacacttttaaaaacaataatttatatatatatgtttatatatatatatagagagagagagagagagagagatagagtctggcttggtcacccaggctggagtacaatggcatggtcttggcttactataacctctgcctcccgagttcaagcaattctcatgcctcagcctcccaagtagctgggattacaggcgcacgccaccatgcccggctaatttttgtgtttttagtagagatgggggttctctatgttgtccaggctggtctcgaactcctggcctcaagtgatctgcccacctcagcctcccaaagtgctgggattacaggcataagccaccacacctggccgaatgatgaataattccttaatgtcactaaatatctagtcaagataaaaattacttgtactgctttaatgcaggaagtgaatcccaagttgttcaattaggaagcagttataatttagcctaagctttaaggaacaataaaatttcaaaaagcattttttaagtggtttaagattgtcggccgggcacagtggctcacgcctgtaatcccaacactttgggagaccaaggtgggcggatcaggaagtcaggagtttaagaccagcctggccaacacagttaaaccccatcgctactaaaaaaaaaaaaaaaaaaaaaaaaaaaaattagccaggtgtggtggcaggcgcctgtaatcccagctacttggtaggctgaggcaggagaattgcttggacctggaaggtggaggttgcagtgagccaagatcatgccattgcactccagcctgggtaacaatgtgagactctgtctcaaaaaaataaaaaataaagtgattgtaactgtatttcccaaacattttaaagaattatttattcacagaattcctattaatatcttatcgtgaatgagatatgattggggaagtgctgttgtactgaaaatagacaagaaattagtgcaactattttataaaataccagacgtattttacataaacttttttaaatgttttatatactttgtgttttcatttaattcctttagaaagctcttaccttgattctatatggcagtgactttttaaaaatcataaagttttatctattttatgtatttaaaaataatacatcaatttgaataaacatcagcttgccgagtaagtatgtctagttttgtattaatcattgtatttgctatggaatcctcatctgtaaaaatggagataaggtgtatctaccttaggttgttatgagggtcaatgagataaaacacaatgctaagagtgctagtagttattattaacatgaaacacacttgtgtcctgtacctttaggagaacaaggagactggcatggagagtgtaatcgaagcagttgcccatttcaagtgagtttacttcctattatttcacattcttttttacttttccagtacattcatttttcttagagtgttttctttgatgcaactgagaatgaagttgcagctttcagagattgacagacattttcaaattatagctctgaattagatttctcactgacatttcacttttctgatctcaccctgtactcagcaacgtaaagtgacattgtgagggttttcgtcacattcagaataggtgttcatagctgatggtttcaaatagtaaaaattaacctcagcagtgatctaagtaaatgcattgtaatttcttaaaactgttttgtttccatttgaatgtgctgcctaaattgtgggatagcctctcaatgccaccttctccagtgtccacagtcttcccccagtcaataaactggtttatacccttaaagatattaaagcagtttcttaagcctgttttttctttgcttcctaccccaatgacaatgtattcattttttttaacccactataaatttttgaagatagtgtctttattttttgttggttataaagacaatacttgcttttaggaaaaatacaaagaaaaaatattacctgtaatccaaccactcagatgatttctattatgtttagatgtatatctttctaaattttttttctatacttggaacacatatttataacaaaaaatgggttcatttcgtatttactattctataacctttttaaaaattaaataatggaatgtttccatgtatttgtgtctttgggggggcgggttgttggttttattgggtttttttagtttttacataatatactttgtcagtacatataggcatacttcatcctttttcacttcagcctgggtaacaaagcgagactcaagtgcagtggcacggtcttggctcactgcaacctccgcctcctaggtccaagcaattctcctgcctcagcctcccaagtagctgggattacaggcgcccgccaccacacctggctaatttttgtatttttagtagacatggggtttcaccatgttgaccaggctggtctcaaactcctaacttcagatgatccagcccgcctcggcctctcaaagtgctgagattactggcatgagctatggtgccaggccctttttcacttccttgtagtcatgtactgtaatgtatctaacctcttccctataatacatagcttccagattttctcttataaacaaatattgaaaatccttgtacatacagcattaacaaatgtatctttgactgtgaaagtgtttctttgaggattagctagatcaaaatgaaagcttgtattacattttggtacatacctcctaattgccttcccaaaaaagtcctcgatttacactctgactagaagtgtataaagagtgccctgcaactttgtcaacactttaatatgagcagtctttcagtaccttattttaatttgcgttactctaagtgaagttgagcttcttttcatgtgtttattggccgtttattttttcatactttaatgcatttttctttatggttgtttgtccctatcttattgttccgaaagtattatatattagaaatgtcaattcttatttaatacatcacagtactttcttccagtctcccttgttttttaactttctgtttttaaaactctgtctcaattggcttctgggttttataacttgcttaggaaagttctctaaaccccaatagtgtacctgcttttttctgcttaatagaacaacacggaagtctttacatgtgaaaatagagaaattatcactgttaatggtgttcagttgtttggagatgttgtaatttgttatttcacgttattagactttttaattgttgccactgcagtgtccatcacgttcacttgtctagttaggataaattccaagtgggcatgctaaataaaacagatgcatgtagaactcggatttagactgccaaatcaacccactgaaaatagttgtagcttaacacccaccagcagtatatgagagctctgctttcttgttctaatatccaagactatctctcataaattagtgtatggctttggtaataatattctaaggtcctttctttcacaggaaacctggattaacaggacgaggcatgtatgaactgaaaccagaatgtgccaaagagttcaacttgtatttctatcacttttcaagggcagaacagtccaaggtaattgggaaaattaaaaatgtagcagggaaggattgcattgtttttcttaagagatgaggtttcaccatgttgcccaggctagagtttggtggctattcacaatgccattatagagcattgcaacctcaaactcctgggctcaagcaattctcccacctcagcctcttgagtagatgagattacaggcatgcaccactgtatctggcttgaatttttttttcctaaacaacttttttactgcttttgcagattgaaaaatgatacatttttattgtaggggatttggaaaatataaaatataaagaagaaagtagaaattacttaaaataccctcacctaacattttggagttaccccctagcgttttgtacatatgtatatacgatctatataatacatacctttacgtatatgggtatagttttttaaaacaaattttcaacctgtattataatcagttaatccattttatgcacatttcagaattggtattatttaacactttttcatagagattcatggagcttttctaatcattcctaggtaattaaattttgcctttttggtggggcatgtaatcccagcactttgggaggctgaggcgggcagatcgcttgagctcaggagttcgagatcagcctggccaacatgttgaaatcccatgtctactaaaaatacaaaaattagccaggcatggtgtcatgcacttctcgtcccagctactcaggaggctgagataggaggatcacttgagcccaggaggtcaagactgcagtgagctatgattgcaccactgcattccagcttggatgatgggagtgagaccgtatctcaaaaaaaaaaaaaaaatctgccttttagcagtctcctcttaaaatggtttttcaataaacagcattaaataaaacttaaacataaagcttttatttagtttttgatgaagtcatagagttcaaacttaaataagtttgtacttatttaagtacatgtttcccttctaatttaaagtaatagagaactcgtttggagattcttttagttaaaaaaaaaaattaaccttgatgtatccgtttgggggaggactagaacttaaagatagatatcttttttattttttattttttttgagatagggtctcactctgttacccaggctggagtgcagacctcggctcactagagcccctgcctcccaggttcaagcaattatcctgccccagccttctgagtagctaggattacaggtgtgtgccaccacgcccagccaatttttgtatttttagtagagatggggattctccgcgttggccaggctgctctcgaactcctgacctcaggtgatccacctgtcttggcctcccaaagtgctgggattacaggtgtgagctgccacgccccggcctctgttgtgttattttctgattttagatgttcatccttggccagacacattggctcatgcctgtaatcccagcactttgggaggttgaggtgggcagatcacaaggtcaggagttcaagaccagcctggccaacatagtgaaaccccacctctactaaaaatataaaaattaaccaggtgtggtggtgggcattactaattcccggtccaaataactttattttttattaggcagaagaagcgcaacggaaattgaaaagacaaaatagagaagatacaggtatttttaatctttctgaaaatgtcttgcccatcttttttgcttgttaaacattgttttctgttaactatgatgattgtccttggtggaatgaatatttaaatgtaagctttcctagtgaataacctcctattcagaggaataataaatatgttaacacagaaatagtttgtgctaagtcctctgggttgatgttatctcagatcttaagacctttctaggggaaaagatagactttcttctgtactgctgctactttcgtggctctttttatgcatttgaccttgagaatgtaaaataatagctttaaggtgtgtgttaatgaatattctttgagttaaaactatcaaaagtaacaaagagatagtttctaaagcatgttctgtaaaagaaaccaataataacaactgtattttcagcactcccacctccggtgttgcctccattctgccctctgtttgcaagcctggttaacattttgcagtcagatgtcatgttgtgcatcatgggaacaattctgcaatgggctgtggaacataatggatatgcctggtcagagtccatgctgcaaagggtaggtttgaagacatttattatttatattttagtattttatagtacaagcaaaatattcttgtctgtatctatacacaggaaaactaggccgaaatgtattgtgttttcctaacttgaatatattgttactgcttttgtgtctgacagtaaaaacaagtgccagacagatttttttataccacatggttgttattacctcagtcccactgggcagttgttctctcctagattggtccttgtctttatatatgtagtattctgatattgatataatgtgttatcttttatatatgtttctaatctaattattttccaaaacaaaaattttttttgaatcatccatatccttattttgtagttgaagaaactgacactcatagacttacggtcctatagctagttaagtggcaagtctggaaccttgtttgtgttatttttgtttttgtgtttttgagacaggatctagctttgtcacccaggaagctggagtgcagtggtgcaatcttggctcactgcaacctctgcctcctgggttcaagtgatcccgccacctcagtatcccaagtacctgggattacaggcatgcatcacaacatctgcgtaatttctgtatttttggtagaaacagttttgccatgttccccaggctggtctcaaactcccagactcaagcaatcctcccccctcggcctccccaagtattgggattacatgcgtgagccactatgcccagccccttgtttgtattttactttatagttttaatgtaagccgttcgtacactatctcattgaattcacacaacaccccatgaatagatacaacttttttctcattgttagatgaggaagccaagtttcaatgaggttccattaacttcccatattaatctactaagtgatataacaattattcattaaatagaatgcctactttatgccttattccatgctaagcccttttttttttttttttttttttttttttgagacagttttgctcttgtcacccaggctggagtacaatggtgtgatcttggctcactgcaacttctgcctcccgggttcaagcaattctcctgcctcagcctcccaagtagttgggagtacaggtgcctgtcacgaagcccagctaattttttgtatttttagtagagacagggtttcaccacgttggccaggctagtctcgaactcccagcgtcaggtgatccactcaccttggcctcccaaagtgctaggattacaaggcgtgagccaccgtgcctggccatgctaagcactctgcatacagtatttgtaatcctcagaactctagagggaagctttgtttttccaaggctaaagatgatgacttgggctcagaggcgttcccttagggtatatattaatagcttgaaagcagtaaaaccaggattcagattcaaattttggagccctcctcgggaggctgagtagctatcattctttctttttgtctcactggctaagatgtgtgtattcttataatgccctcctatttatctataagcatatttaaagtgtaaaagcatggagctgtggtgtactagctcactactagtacagctgtactagctgtcgtgtactgtcagcattacatgaacaaaagatttgtgggaaataatggagagaagaggtgtgaacaatatttaccttacatgtacacttgctttatgtcacctagttcttccaagtctctgacaaccacagtcatcccatgtgaagggaaagatacagagacatcacacacatatctccttcaaaatctggggtgtgggcccggcacagtggctcacccctgtaatcctaacactttgggaggccaaggcgggtagatcacttggggtcgggagttcaagaccagcctgtacaacatggtaaaaccccatctctactaaaaataaaaaaattagccaatcgtcatggcacatgcttataatcccagctactcaggagggctcaggagaatcactggaaactgggaggcagaggttgcagtgagccaatattgtgccactgcactctagcctgggcaacagagggagactccgtctcaaaaaacaaaaaaacttgggcatgggataagagcagtaaaaaaacaaataggttgatacagtctctagaagtctggtcaggaatattttgtgagatacactgaagaactataaagtttataaatgataaggcattagagataaaagtttgtctttctcagatgatgaagatttagtccttagagaaattaggtagtgtcatagactggataattacatgggggatacgtttagctttataattacttgaccactaattcttggaaggtttttttaagtctgtagtataggtatagaataaaacttacatattatgtgaattgctggtcacagctggtgtaattttagcttaccctgaggatttgcaattgaaatttcttcctcattgaagtagaaaattttgtttttcttgacaataattgtttgttagaaaataaacctcagtcttttcatttaataaaaattagtacttcaaggccgggcatggtggctcacgcctttaatcccagcactttgggaggccaaggtgggcggatcacttgaggtcaggagttcaagaccagcctggccaacatggtgaaaccccatctctactaaaagtacaaaaattagccgggtgtggtggcacgcgcctgtagtcccagctactcgggaggctgaggcaggagaatcacttgaacctgggaggcagaggttgcagtgagcctgggtgacagggcaaaactccatctcaaaaaaaaaaaaaagaaaaaaaaattagtacttcaaattgtttttaattgcatttagtatttcatagtttgatttatctttttcaataattcttttttcctatttcttattaaaatatgtacttgattttttaaatttttactaaaagttacaaaacatttattcaaggtgttacatttaattggcatggcactacaagaagaaaaacaacatttagagaatgtcacggaagagcatgtagtaacatttaccttcactcagaagatatcaagtatgtatatatctttttactaaactaactcaagatataaatgattttaagaaatcacttaataacctcttttatttgatcatatagattctaaaagggtaatatttaatccaaacatttgaggctatatgtactcatctgtgtagtaaaggtactgtattaaaccctgatacatttttataaaaatatctagggctaagttcaaagttacagtcagctgtggttgacgtaagattctacagtattgaaaataaaaaaaaattataggggattagattgtcatttcatataaagaaatgtgactttttaaaagaaggccagggagtttttctagctttttattttaaaaatttcatacatatagacaagttgaaagaattgtccagtaaacattcatatacctgctccctagattcagtagtttgctatatttgcttttatatttacatactttcttgaaccatttgttgtagacataatatttcatgtctcaaagaaaagcttctcatttactaattttcagaaccagccattggtctgatagttacctgcaattgtggcaattttgaatgttttttgtttagagtttttttaaatattattcatggatttttattcagtgttttatagtcacttataatgggtattccttttgatgctcaaattatgcccattttggtcagtgggagtttatttagtcagcttctgtgtccttttcacccagccccatttgtatttgagtaccacctcgctttccagcccaaaagatgcccaagctcatcttgtactttccctgccacagacctgtagtcagccatttgctgaagtgtttttaaatgaattgatggtgctatgataggagtttataaatgctttgattgaaaaggattatttctgtaactgtgttcagtgccatttcttcctaaacgataactgtgagaattatactaccaggggacaaggaggaagtaattttgtttgctgctagatctctagttttcctttttgccctcatccaagtaaatgagagaaagaggagaaaccaccttttcccactgaagactttattcttggatgccagtttttacctattctttttctctgccatattttctttggattaatactgttgtttttgctttctttgtttctggtgtgtttattttagaataaccacacagaatactccctaatttcattcactcatcactataaaatattaggttcttggccaggcatggtggctcactcctgtaatcccaccactttgggagatcaaggtggatgaatcacctgaggtcaagagttcgagaccaacctggccaacatgacgaaaccctgtctctaccaaaaatacaaaaattaaccgggcatggtggcgggcgcctataatcccagctgctcgggaggctgaggcaggaaaatcgcttgaacccaggaggtggaggttgcagtgatccgagattacaccactgcactccagcctgggcgacagagtgagactctgtctcaaaaaaaaaaaaaaaaaaaattaggttctctcttactttctctttccttattaaacaatcatcattttccctcaacattactcttaacttgtctttagacattctacataattaagacacacgatttatttccaaagaaacctctcccttatctagagtcacatctctaatgcatgccacagttttagatgtgatagaatattaaagatcacacaggtcaatctcttcccctcttaggaaaaagggacatttttccagaatggcagcaccaaaatcaagaaaatcaatagttgaactttctggctacagactaatagaaaatatggacttgactcttatattcaaataaacaaactatgaattcctaggagaagaaattcattttattctgaatctagtttttattaaagtcaatggtcagagcaaataaacatatttgtgcatatatgcacctcttaatgctaatttatttttagacctgtaaaatctgagacaccacttatttttagctgaatttgtatgtaattttgctaaagggatgttaaaataatcatttgctataaaaagtcacttttgaatccttaaagaattctagttgttggcaacttgtttgtaaaagacaaatatgtcacattctcaagaagtattgaaaatctctattttggtagagccataatcaaattatgggcaataggtgttataagcaactgcatttatgttcctgtgcgtaggaataagtactatgaagtattagctattgttattgtgccttttatttttctgccgtagaacctggtgaagcgccaaaaaattctcctagcatactagctatgctggaaacactacaaaatgctccctacctagaagtccacaaagacatgattcggtggatattgaaggtaaaatttccacattcctctgctttttgtgagaaatattgaatatttgttatgtgtacattgtgatcatatttcatacaggatactgatacttttttttttgtagacttttaatgctgttaaaaagatgagggagagttcacctaccagtcccgtggcagagacagaaggaaccataatggaagaggtataaacagtaaaaagtgtgataatactaaaaaattacagcaagttcagtatgaacaaaataaatttatctacattaagttgccagttactcacaacatttaaattccaagaaatatgccactatttatctctatttgttgtagcaattttttgtctgctttttttctttaaaacaagtcagtttaagagtcttttctcttatttaaataagtgagattatagaatagttttttaattggtatttacagtgaagatatttctgctttggaaaaaaatgtgcgttttagcatctaattgtctaattgaatggagcataatttcagagttcaagggacaaagacaaagctgagaggaagagaaaagcagagattgccagactgcgcagagaaaagatcatggctcagatgtctgaaatgcagcggcattttattgatgaaaacaaagaactctttcagcagacattagaactggatgcctcaacctctgctgttcttgatcataggtaaaaaaaaaaaaaaaaaaaattaatgtcttgacgagtttttcccaactaggggcagtgttgcgttttctccttgtaagtatacttttaatcctaaagtaatttagtagaattcataggtaaattttgtgacctccatttagaagatttaatcttagaagtctctgaatgtaggtatggtaagtcctgtgtacacctggtagggtattttctgcagaagaccttggacattcatgaaagaatgagtacactacactcagttacctagagcgtatgacatctgtgttgaagattagattactgtgaggattaaaggagatggttttgatacataccaaagacttgacaatccaagttatcaaaaccatgtgttaaatatatacattcctggctgtgcgtggtggctcacgcctgtaatcccagcacttcgggaggccaaggcgggcggatcacaaggtgaggagttcgagaccagcctgaccaacatggtgaaaccccatctctactaaaaatacaaaaaaaaaaaattagccgggtgtggtggtgcatgcctataatcccagctactcaggaggctgagtcaggagaattgcttgaacctgcgaggcggaggttgcagtgagccaagattgtgccactcaccccagcctgggtgacagagcaagactctgtctcaaaaaataaataaatatatatacacacacacacacacacacacacacacacacacacacacactacacacacacacacatacctgtagtctgctattttgtgattatatagaaagttttgggatcattaattatattcataacctttgtattgcagccctgtggcttcagatatgacacttacagcactgggccccgcacaaactcaggttcctgaacaaagacaattcgttacatgtatattgtgtcaagaggagcaagaagttaaagtggaaagcagggcaatggtcttggcagcatttgttcagagatcaactgtattatcaaaaaacagaagtaaatttattcaagatccaggtaagtcatagctagatcctcatcttcccttttaataacaactgccagttaatgtggttggtgatacgttgagattttttaaacctaaaaataactccatggacttggatggtatctttggcaggtaacttaggcaggaattccccacttggcagatgtggaaccactccagaaagttgcacctgaatcacatagctgataaatagcagggattcaaagaaaagcttttctttgtgatgtaacattacatactttggcatttcacagtcttttccatccttcagtacacttgcaaagtcctggtcatttgttgacacactgaaataataattgttttgtcttattgatagagcctgagtggaatctcctgagaacagtgatggagagttacctatgtaagaggcaatccttgagccaaattgttttagaatagtaataccaccacagatcgggttccccagaaagcagattcttgggatacagattaccgtgcaggacagttgagggccctctttcagcaactgagggagtaaagcagggagatccagtccgcacatgattttgtccaccacagacacatttatttctctgcttgtaggttgtgctctgtgtgcgtgtgcttcagcgatacccagtaaacttcttgagagtaggaactgtgtcttgggaattcccagagcactgctttaaccagtgcctttcacactgcagcgtgaaaggaggtttgagagcccacttttagagttgccttctctctgtaaagaaagtctttgcatcctacttatgaaaggttggtctgcttcatctttaaaaatggtcatttaggctgggtatggtggctcatgcctgtaatcccagcactttgggaggccgaggcaggtggatcacctgaggtcaggagttcaagaccagcctggccaacatggcgaaaccccatctctactaatagtacaaaaaaaaaactagccaaatttggtggcacgcgcctgtagtcccagctactcaagaggctgaggcatgagaattgcttgaacctgggaggcagaggttgcagtgagccgagattgcaccactgccctccagcctgggcaacggagcgagaccctgtgtggtttttttgtttgtttgtttgtttgtttttaaaaaaaaaaaaaaaggccaggcgcagtggctcatgtctgtaatcccagcactctgggaggccaaggcaggcagatcacaaggtcaggagatcaagaccatcctggctaacacagtgaaaccccatctctactaaaaaatacaaaaaaaaattagccaggcgtggtggcagttacctgctactcgggaggctgaggcaggagaatggcgtgaacccaggaagcagagcttgcagtgagtcgagatcgcgccactgcactccaatctgggcgacaaagcgagactgtcttaaaaaaaaaaaagatatttaaactaggtgctttataaatttcattccaggccaaagacaaagttgctaattttatttaacttattacttctgaagaaaaagcattagctggctataagtggattttcttaatgctttgacatttgcactgttctagtgttaaagcaaattaaaactattaaagcaaattaaaagtagttctttctagagtgttaggaaatttcgaagattatactaatttatataaagaattcaaaaattccaaaagaagccagacatccatcttgtttttcatgatttttcatcccctttgaatataaaaattagcaccaggacagaagactctgaattaccttttttccccccatctgatctggtctgtgcttagattttttgttgtcactttggctctgatgtgattattcgctgtatgagtgttgttaggcagtctgtcctctagggggcgccccgttactgccaaaacattttttattagcgatcattttaacccagctgccctgaacgcacataaggcagccccatgaagagagtagctcttttacctggagctcagggtacaatgggaggaattggaatatctcagcaccctgaaagtgtgaaatgttcaaaagattggatatatttaaattcatagttctaatttcagtttaacaatttgagaatgtttaattaatttgctgtgggtggtgaaaattagagagtcctactttctaaataatccaaggtgttgcataaattggtatctcagaggaataaactagcatttcatttcaaatttcaagtctttatcaaggattttacaatttaaagttacacatttgttataggaaaattaaatgcttcacttttgttttgttttgttttgttttgtaatgcagaaaaatatgatccattattcatgcaccctgatctgtcttgtggaacacacactagtagctgtgggcacattatgcatgcccattgttggcaaaggtaatgtatattcttaatatttgtcaagagaagtttatctaagggctcaatattttttaaatagaggaaatttcattctagaaaaaaggaaaagaactaaaaatgttgaaaaaatccgtatcattgcctaataaataacaaaagttatttgccttgtcatagatgtaaagtgtatgtcagatatgttttttaatttagctttatatccaagtctcttctatatcttccaaagaaggaagtggatctgtatcagtctgtggatgaagaaaagggtttttacagtaggataaactctagaagggtaatgttgtctttctttgggtccagggtggacaacttttgattccatagatgttagtacttgctttgttacttcccaaaattgtaatggctccctgtgatgagatgtcctgaatttgttctaccttggtgtttcctatgcttctacaaaaccaacaaatcaataatactattattctagaactatgctcacccagttatcatgaactacccctaacaactagccaccacattgtagtcccagctacttgggaggctgagacaggagaattgcttgaatgtgggaggtggaggttgcagtgaaccaagattgtgcaactgcactccagcctgggcgacagagcaagactccatctcaaaaacaacaacaacaacaaaaaaaaaacaaatagccaccagccttggggaagtggcaagagaacaatgacaccaagaaatttttgttgctgctttgtgaatgcttttttacatggcagtctttttttttattttactcttttagaacttttaatccatttggatttttaaaatcactcaaaaatcatgttaaaaataatttagtttaagattttcatttttgaactatttgtggaaacaaattattttaaatgttgaagcttatggctgtcatttatgtaaattaccattgttttgatacctcatgttctctaattgtaaaggtattttgattccgttcaagctaaagaacagcgaaggcaacagagattacgcttacatacgagctatgatgtagaaaacggagaattcctttgccccctttgtgaatgcttgagtaatactgttattcctctgctgcttcctccaagaaatatttttaacaagtaagttttggctcatgacaactattacaaagcaatagtttgctttgaagataatgaaataataaatcaaggaggaaaacttagtctaggcaattgcatagtgttttccagatactttccaaactctaatcattttcttctagcagacctgtggaatgtgattttagtttttagagaggaacaggtgaaaatttaacagtttctaagctattaaattcctatgtatttatgaaaaccaagtatctggtttatttctagggaccctacttttaatatcttccatacacttttcaagagatgctcagtaaactggtagagggagatggaacaactcaaactgactttataggacagtctaaaaatcgaataaaactttttgctgtactggccattcatagttttaagaaccaggcaaaaaagtgaaaatctgttggtatattttaaatggaaaaatctcagctgggcgttgtggctcacatctataatcctagcactttgagaggccaagatgaaaggatcatttgagcccaggagttcaagaccagcctgggcaacatagtgagaccctgtctgtacaaaaaataaaaagttagctggatgtagcggcatattcctatagtcccagctacttcagagactcaggtgggaggctcgcttgggtcaaggctgcagtgagctttgatcatgccattgcacttcagcctgagtgacagagcaagaccctgtctcaaaaataaaataagtgcttgcttcagcagcacatatactaaaattggaacgataaagagaagataagcatggctctttcacaaggatgacacacaaattcatgaagtgttccatatttttagctcttttagaatttgtctagcagactaaaaaaaaataagaaaagaaaatggaaaatttctgtaacttcacagttttttggatgcttttagttacgagtattggacatactcatttcgagtatgaatttgataatgtctgcttttcgaatctgaacttcatttctcaatgtagaattatgctatctacgttgcatgcacaaatactaagttatgtgagtataaacgatccatttctgtgttatttggattcagttcaaagcaaagtcagttttttcttgtcagttttaggagttcaaactttggtgttcttagtctatgctaccacaaaatgttcttaaaatattagtagatttgagtgtaagctcatgctttttaattataaaagaatatcgtggtactgacttatctgcatttgaactgatgaagaaattaattattgttagatggaggattaactgtgtataagaagaaatcacccttgttggatttcatctgtcactttattggtccaatttttgggttttgcccatgagattcaattatggtttagtcatattcgaatacaatcataaaaagaacacaggctttggaatctgacagagccaagtttgaatgctagctttgtcccttattcggccttagtcaagttacatagctctaaacctcagtttcctcatctgtaaaatggggacaataataaaacctattacaaaatataggaatacaacctatgcaaataataatacaacctgaaacaaaatgtagggatattttgaggattaagtctaataccataagatatttacagtaaaattccttactaagtgcttgtaacataataagcacttggtagatattaatagtgatggtgattatgatacttaagaaattctagcaaattccaatactgaagagtgagatttttaatacacagtgttattaccatcatattgacaaataatatattcctttccattggccaatatcctgattttttttaatgcaacaaattttcccttatcctttttgtttttaatatttggagtgtgtctaaaatatgcctgtgatcatttaaggagtcttttgtatcttaaggaacaataataaaacactaaatactctctataatcttttctagcaggttaaatttttcagaccaaccaaatctgactcagtggattagaacaatatctcagcaaataaaagcattacagtttcttaggaaagaagaaagtactcctagtaagttctggtaacctgttttcatttttccctaaagtccgaggtcatcagaaaatgtatttccagaagaagttgtttaaaagtgaaacctcccatttaaaattttgactcattctaattttccttgtcttaataaactaaatttgactttactgcattactccttattccttaaacacacaagctcatgtgaagtttctaataaacacttctcacttattcccccattttattgaagagcttctggaggtgggggagatgtaactgagtgttgcagagctagctttagttctcggtgggctaactcaccttactgttggcattaccaaaggcttcccaagtttcatagaccatgcactgcacttatgaccttgtgggaacgtagtatgaacaggatttatatcattggttttcatagaaacagaatagctactcttgtttttgttttagtggctgtactataaggaaaagcatagttaagaaagggccttggtcaactagagcaataacgttttcatgcttcatatggttgttatgccagtttttattagggaatttttttccttttgtttttgatttctttgacctatatggctgtacttttaggaatattgtcatctattgaataatagtataaaatgcctgtttctatagataatgcctctacaaagaattcagaaaatgtggatgaattacagctccctgaagggttcaggcctgattttcgtcctaagtgagtatattattttactcctttaatatttgacccatttgaaatgaatgattaagtcagcagttaggaggaatatgatttggcaagtgagggagcaaaatgttataggatactgatctttagttgtaaggtttaagcagaggctgagacaggaggatagtgtgagccccagaggtggaggctgcagtgagccttcattgcaccactacattccagtctgggtgacagagtgagaccctgtctcaacaacaacaacaaaaaaagtttaagcattacttgatggtatttattgcagtacattaaaaaaatctaagaaccatgtggcatgtttaactctcaccaccctctcctagtcagcattgctgacccctgccacacccctttctttacctggctctccttgacaacatctaatcagtaattctaaatacaaactgctcagcctccccaatgaatcccgcacttccgtctgacttcaaaatttctattaatgacctaaccaagctcttagtaacccaggattaaaaccagaatattttccaccctattttaccccatagccagttagttacaaggtatagcatagattctggagctagactggttgattcagttcccagcaccaccacttattagctgtgcaactttgggcaaattgcttgacctctgtgtacctcaattccctcatctgtcaagtgaggataattcataggtgttattaggataaagtgacataatgtacgtagagctacctgaaagctgtgcctggcatgtaccaagtaactcaataaatacagacctaaagacttgaatagaaaaaaacatcatgcctataatcccaggactttgggaggccatggcgggcagatcacttgaggtcaggaattcaagaccagtctagccaacatgatgaaaccctgtctctactaaaaatacaaaaattagccaggcgtggtggtgcacgcttgtaatcccagctacttggggggctgaggcaggagaatcgcttgaacttgggaggcagaggttgcaatgagccaagatcatgccactgctctccagcctgggcgacagaccaagaccctatctcaaaaaaaaaaaaaagaaaaagaaaaaacttcaatcttctgtctgccacactcccccagtcctgtcattttatttgtcacttctagtgtttacttccatatttctaattagacagtatcttcactgttgactggtaaattattccacaatttttggttaaatctagttgtcagtttttacattataataactgtgtttctgctgatacaagttgcgtattagaattatatttcctttcttgtacagttttgtcttttttttttttttttttttttttgagatggaatctcgtgctgtcgcccaggctcagttttgtctttcttatagttaataattaccttgtctttttcatgtacttgttttctatgtatttttttttttttttctgaatggtgcagtagatctatccaatgtctaacaactttttctttttttttttttttgagacagagtctcactctgtcacccaggctggagtgcagtggcgtgatctcagctccctgcagcctcccctcccgggttcaaacaattctcctgcctcagcctcccaagtagctgggattacaggcatgcactaccatgcccgactgatttttgcatttttagtagaggtggggtttctccatgttgcccaggctggtctcaaactcctgacctcaggtgatccacccgcctcagcctcccaaagtgctgggattacaggcatgagccaccacacctggcctcctaacaacttttctaagtgctcagatctgtccgatgatcttctgttgctaggtccctccttcccctacacagcctctgttctcctacagtcaggagggggcacagctgtcacttctcttggccctgctcctcttattttctggattgagtatcttcctctttcttaagtacttgactctttttgcagattcctaagaaaggatacctggatggtatattttcatgttcgaaaatatgtttattttattcatatgctcaattgatagtttgggtgtagaattctagggtagaagtaactttttatctagattttgaaggcattattttactaaattctaatccattgagaaattattcccattctaattcttgttcctttgtaaatttttgtttttttgagacaggttctcactctgtcatccaggctagagtgcagtggcacaatctcagttcactgcaacctctgcatcccggattcaagcgattctcctgtctcagcctcccaagtagctgggattacagacatgagctgccacacctggctaatttttgtatttttagtagagacagggtttcaccccatcttggccagactggtctcaaactcctgacctcagatgatccacccacctcggcctcccaaagtgctgcaattacagtcatcagccactgcactcagcctcattttttttaacttttttagagacaggttctatgttgtccaggttggccttgaactcctgggctcaagcgatcctcccgcctcagcctcctgagtagttgggattacaagtgtgagccaccatgcctggttcctttataactctattactatactattacttctattttctattactactttttttttttcttttttgagacagagtgttgttcttgtcacccaggatggagtgcagtggcacgatctcagctcactgcaacctctgccacccaggttcaagggattctcatgcctcagccttccaagtagctgggactacaggcatgcaccaccatgtcccactcattttttgtatttttagtggagacagggttttaccatgttggccaggctggtctcgaactcctgacctcaagtgattcacccaccctggcctcccaaagtgctaggattacatgctgagccaccgcacccaggcttgtaactctgttacttctgaaaactgtaagatactctctttatctcttcagtgttccgaaattttctatgatatttcttggtatatgaatctttttttattcattttgctaggcgttcagtaaacctattgaatctgaacattcatgtccttcatttctgagaattttttatgttgtttcttaaataattttctcttggattttcttctttgaggtagttctgttagctcactgttgcccctcttgaactgataacctaattttcttatgattttttttgctttctacattgtctctgttttccctgagttctgtttctctgctcctttgttttggtttatctctttgatgctttccttaaatgtttattagtccttggataactatttaagcataaggcaatgagcataaggatacctggtggacaggttggagcttgctgacttgtaagcctcacaataaggtgatcaggacacctccagtcttttgcttggtgacccccgaatgtctgtgtaaaaacaactttcccctgaggattgttcactggaaaaactaatctctgtggaagtgggtatacattgctgatgttctcaggatgggaaacagggtcaaggatctcattgtgtagtgtgtaggcttgtgcccagcaccctgttttcagccctgtgcctcacccctgctaagtcaaagagtctaactcctcttgggcaggggcagtttgcattatctctgatcactgcatacaattatctctggatatatgttaagtggttcaatttcaatatagcaaagagctgttaagaaaccgaaccatttgattgatatgtgcacattgttctgagctaattttatacatgtttacttcaggatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcataggtaagagatttacagctgtttctctataagtcacaagcattcattgatatgaattaggcatagaatcttgtttttaaatgaaatgtttgaagtgggtaacaacgtgaagaaataataaaaagacttagaagcaagaaatgtaatgtactgacaaaatactagattgatagttcataaattaaccacagcaacagagaactcttggtggtggtggttatagcttcttgtcagttgaaggaatgtactgttcgtttttactttgtaaccaaatttaattcttgtgaaatgactttgaagattctgaaacttgacaatattgtactttctgtaggattggggtttttttaacctttttaagaaaattatattaaaatatacataacataacatttaccattttaaccatctttaatctgtagaaagaattttgagtgatgaagataaaccattgtttggtcctttaccttgcagactggtaagttctcagtttattcagttcatgatagtggggcatggaaattaggtggttctgctgcttttaatcttatggacctgcagtagttacttacaccttcacttctttcgtagtaaaaacccattttctgtaaggatattaaaaagtaatgtttgtggtttaatctttcttttaaataaacttcaggaggccgggcgcagtggcccacgcctgtaatcccagcactttgggaggccgaggcaggaggatcacctgaggtcgggagtttaagaccagcctgaccaacatggagaaacctcgtctctactaaaaacacaaaattagccaggcgtggtggcgcatgcctatagtcccagctactcaggaggcagaggcaagacaatcgcttgaacccgggaggcagaggttgcggtgagctgagattgtgccattgcactccagcctgggcaacaagagtgaaactccatctcaaaaaaaaaaaaaaaaaaaaattgcagcctggcagtatagtgagacctcatctctacacaaattttaaaattggctaggagtggtggcgtggcatgtacctgtggtcccaactacttaagaggctgagttgggaagatcactggagctggggaggttgaggctgcagtgagccatgattgtgcccctgtactctaggctgtgcaacagcacaagatcctatctttaaaaaaaaaaaaaagaagaagaagaagcagaagaatgtatattctagctccactttcttgctaaccattcatatttcaactcctgcagtttggctccacttctaacactttctgacttctatgaaatatctctttccaagttcaccaaatgatctcctgattatcattttgcgtgggcattttttagcccttgtctttgaaacctctacttaattgctcattctgaaacttttatttctctccattccttcttcattctgaaactcaattttcccttaatttctgtgacactcttggctttctttctgcctctgtggctcctgcctctcagcccactctccctcctccatcctgcagttgtcatttttaaacctccagagttctgccatctaatactcttccctggtcagccccatctatgcctctgatttcagttatatccaaatgatccccacctgtgtatctccaacccagatctttatcttaggtgtaggttatctctgcctatttttttaacctggatctcctacacatacctaaaattcaatccaaattaatttttcttcctatagtccctgttttagttaatttcaccactattcatccaggagaaaccagaaaattgaagtcttttttttttgagatggagtctcactctgttgctcagactggagtgcaatggcacaatctcggcccactgcagcctctgcatcctgggttcaagcgactctcctgtctcagcctcccgagtagctgggattacaggtgcatgccaccgtgcccagctaatttttgcgtttttagtagagatggggtttcaccatgttggccaggctggtctcaaactcctgacctcaggtgatctgcccatctcggcctcccaaaatgctgagattgcaggcatgagccaccattcccggcctagatacattttttagcctgggcattcacattcagttggtcagcagagtctgacaaattctcaccattccttcttctacttgtttggttcagccccatattatttcttgcctagattatcatagcagtttttacccagaatctcactcttctctaatacgttattagaggggctcctcaaaagcaatcctgttcatattcttcatacttttacaaacttcttaacctatttctccattatcacctcctgccagttcccacccctgtggtccagacttgtagaatcactgccagttcctcaatgctagttcccatgcctttgcacattccatttcctctgcctagagtaccctaagcagactgctactctttcagatgctgttcaagctttcccttcccttagaaagccctctgaaccatgtactgtgagttagagacctctcatctgtgatgcctgcctccttccccactttcttcctttcccaccccaggactttaagctctttgagagcaggagggggagaatgggttttatttgaagatcttcagaaccaagacctagtgtatatagtaggacctcaatatttattgaaccaaacattacagaaaatttggaaaatgaaaaaacaagcaggaagaaaaaagtcatcaacttatcacatacccatctttttccattagcatatttatgcttgattacaattggtactcacatgtagctttgtttctgctgtattctttaaatcaagagttttcttattactgctacttagtcctcataacaatttttaatagctgcaggcaccctcatttgtaccaccatcttcttagacagtttccccaatatttggagtatctctttaggatactctacattttacggaagagtatccacattttagaggatctctttaggataaacataagagatatgtgttttagggtatctgtttaggataaacatagagaaatactgcatccgcatcttggcttgtttatttgttttttgagatagagtctcgctctgttttccaggctggagtgcagtggtgtgatctcagctcactgcaacctctgcctccagggttcaagtgattctccttcctcagcctctcgagtagctgggattacaggtgtgagccaccacacccggcctgcactggcatcttgggagtgtcccttgctttctgtcagatgcgtatattctatattcttttcttttccagagaaaaccagcaacatggtggcaaagagatagatttcatttattcagcacacacttagacatttcccattccatttatcctgtgttagaggcatgtcattgagatgtcatagatctagttccataccatctagagcagtttcattgtgcatccagctgtgctctgaactagcattcctgaaagagaactgctttgcatttttgttttttgttaattgcgttggtttattttaggatgactgtcttaggtcattgacgagatttgccgcagcacactggacagtggcatcagtttcagtggtgcaaggacatttttgtaaactttttgcatgtgagtattaatacatttataacatgttgtaatttttcatcctctgaaattttgtttttaatggtacagcttctctcagtaatgaattaaatatttagtagtactggttttcttatatataagctctagcttataaattctcatgtgtcttgcaagaagataaatttaaagcagattatatgcattttaacatgttggcatatgaaatatgctaatgtatttctctttaaatctgtagcactggtgcctaatgacagccatgaggaacttccatgcatattagatattgacatgtttcatttattggtgggtattgtgcagtttgtttggacttctacgtcatactatgtaactttaccttaggtttggtgagcagtgtagtggcagacaggaaggagttatgtgatttccttaccccttctgagtataattcttttatgagaaacctcaaaaagaaaatatttaggaacctagttgagagacttgacctggttatcgagacgtcctctgactcttattttgctttatggctgaggttagtattttaacctctctgtgcttttaacctgtaaagagataaaaacaccagcaacgggtcaggtgtggtgactcatgcctgtaatcccagcactttgcgaggctcaccccagatcacttgaggtcaggagtttgagagcagccttgccaacatggtgaaaccctatctctactaaaaatacaaaaaattagctgggcgtggtggcacatgcctgtaatctcagctactcaggaaagtgagacaggagaatcacttgaacccaggaggcggaggttgcagtgaccaagattgcatgactgcactccagcctggatgacagagcaagaccccatccaaaaaaaaaaaaacagcaacagaagcactgctgctggcccatacagtgcttttgtacattttcgaaaatctggcagatacagccctgtggtcacactacttagcagcagagagccccttataattcagggaaaggtatgtcctctgagccaggacatcctagtgctaagacacacagctgtccaaatagtgggtagccaaatttcagccctacctcaactgggttcccttgcacagggtacagagtgtactgccacacccagcagccccgagtgctgtgcctttattctctggacctcagattctgcccctttaagttggttagtacctactttatatgactatgtcagaactcagtgagttaatccatgtaacacacttagagcaatatattcctaataaatgcggctattactgttctcattgctgcaactaaaaccaccaccacttatactgccatgcagacagcaggaggccaacagagctagcatttgtgtacctgccagcttttacatacgttcacacttacatctctacaatttacatgtaacatattgtctttagtttaccaatagggaaactgaggcctgatcagagatattaatttgtgtaaaacagctcataagaggaggaggtaggattcatatctagatatttatgggtccaaaacccatgttttttcaactgcctacagtcctggagagagttcagatactgtttttgttaacaataagctatgtatagaggacccactggattaatgaaatcatagtgcccatcaagagtcctgtaactcaagtcatttcatgtagccagtcctattggattttccaacatggatgccctttctttaagaacaaagatttcttaaagggaggagctgaactcaggagggatcacagtaagaaaatggaaatgtgaccaggcgcggtggctcacgcctgtaatcccagcactttgggaggccgaggtgggcggattacctgaggtcaggagttcgagaccagcctggccaacgtggcaaaacctcatctctactaaaaatacaaaaagtcgggcatgatgttgcacgcctgtaatcccagctactcaggaggctgaggcaggagaatcgcttgaacccaggaggtggatgttgcagtgaaccgaggttgcgccattgcactccagcctgggcaacagagtaagactctgtctcaaaaaaaaaatcaaaataaaagtaaaagtaagaagatggaaatttgcttagctgtgaaaggaaaggcgatctgtctgatgtcctgtgtttggtgcctaggtgggcttggtgcttgcatttcctgcgttgcagtgtcaggatttttcagggatcagccttggcactggagaccttcacattttccatctggttactatggcacacatcatacagatcttacttacctcatgtacaggtaactcttgcctttttgtcagtttcttgaaggaaatacttgagttttctgagttttaaaaaaagtattagaggaaaaggtatttggatgagaataacacatgaataaggctgtttttttctgtgtatcttcatatgaaaagttttgaaacatttctttctcctcttaaaatttcctagtaatgtgaatgtttctagttttaatttcatacattcagtaatatttgtgtagaatagtaattaaatcttttagaatcttatgttttagaatgccaattttgttttaacttacatgtttgttaatgcccacatgaattcatcattaaattacgttttgcattcaaaattcttgtttttcatacactttaagactatatttatttgattttacttaaaacatgccagctggctgtttggtttgattgagatcaatactgtgctcccacttgagggattacaattttgcatgttttctaggaatacttcatgttatatgtgagtttatgaatatatttgcatgcttaatgtcttcagtccttttgataacacttaattggaaaatacagagtactagtatttccttatctttcagaagagaatggcatggatcaagaaaatcccccttgtgaagaagaatcagcagttcttgctttgtataaaacacttcaccagtatacgggaaggtgagttagttatctttacataacgcatttccctaaatattgctagatgatgatagcatgagaaaggaattcgtttgttaattaggggaatttgttgtctgttgacatgtttttaaaataagacgtggagtgatctgcagagcctttctgaactattcatatactaacataattggaaatctgggagaaaggtgataatatgcagagcttcccacatttatttggctgtggaacccttcatttgctcagggatctggcagagactagaggatagatcaaatgtactttggaaagttgatactctaaaacttatgttgtctcattcagaatgggaatttaaaactgcaagttaaattggcataatttatttttaaggtaatattcagtagtagcaggaataaaatgaaattattagaattccatgtatggttagagtcatgatttgctacaaatagcaattcagtagtttgcttagctttcaacagtatatatgtcaagaatctgtagtcaggaacctataaaaatgtctgttttttgactatcccatttctgagaacctacattaacaaaataattcaacatatagaaaaaaaacatataggcatataaagatggacactccagccaggcacggtgtctcacccctataatcccagcactttgggagaatgaggctggcagattgcttgagcccaggcatttgagaccagcctggccaacatggtgaaaccctgtctctaccaaaaaatacaaaaattagccaggcatggtagcatgtgcctgtggttctatcttctcaggaggttgaggtagtcagatcacccaggcaggtgaaggctgcagtgagccatcacaccactgcactccagactggacaaaagagtgagaccctgtctcaaaaagaaaaagatgtacactctgatattatttatattagcaaataattgaaagcaatctaagtgtttgcaggggaatagtttgatatagtgatgaatgtgttccaaaatattataaatctatttaaaatatggctcctaggagctgggtgcagtggcatgtgcctgtagtcccagctgctcaggaggctgaggtgggaggattgctggagcccagtagtttgagtccagcctggacaacttttcattttccacattttctctttatgtcactatgttacttttataaattttaataacatcacacctgtaatcccagcactttgggaggccaaggcgggcagatcacaagatcaggagatcgagaccatcctggctaacacagcgaaaccccgtctctactaaaaatacaaaaaattagccgggcgtggtggcaggcacctgtagtcccagctactcaggaggctgaggcaggagaatggcgtgaacccaggaggcagagcttgcagtgagccgagattgtgccactgcactccagcctgggcgacagagcgagactccgtctcaaaaaatttaataacagcattggaggctgtgtcaccacttacacctggcatcctataataacacacacccacttgcctgttaactcacaacttttaagcatacatgccatcagttccaaatgacagtcaagtctgttttcacactataagtacagtgaccttttcttagtagatttcccaataatcttttttttcttttttagtgccttgaaagaaataccatccggctggcatctgtggaggagtgtcagagctggaatcatgcctttcctgaagtgttctgctttattttttcattacttaaatggagttccttccccacccgacattcaaggtaatttatactttctttcaaaacgtagggagagttagtaatcctttactccagcaaatataaagatcacttgcaaaaatgaaaattgactaaaagttcaaagaatagcttattgactatggtgatgtacacatttatagcataaaatgtatgtttatgcatatgtctccatttatttggatctcagtaaatgactgttaaacttctgtgtaaatgtttttacacctgcaaagcccttctcccgtaaagatcatagttttgctttcagatgttaaaatgttcagttatgtattattcataaacaaggttcctcagatttgaaaaggtgaaaactgacaatttcaagtgatttttaacttgaaacatgcatagcattaaaatttagaatacccataattgcacataaatctgattttaatctgggaattgatttgctctttcatagttgttttccatgttctgttttgattcatttcataaaagtagtatgaatgtggacttgactgtatctctgtatcccacagtgcctggcactggccgtagagtacctgcatgcagtgctactctctgaaagtttgtccactggcatttccatttagctagttgcctaggaaccatataaaagagtttagtcttccagattatttgcagtgatgattagagttggtatttaaatctgtgtctcgtggtaaaaccatcttgtatttctgtattggttgatccttttccagagcacccatacatttttatcatttaatgttcacaataaccctgtgcagtagattgtgcaggcacaccattttgcaaatgataaagccgagacaccaggacattgggaccagtttgatgtaggagtcgcctgactgcacttgacgcattgcgtcattttccatggattccttccatgtgccattctgttaacttcctacaagttacgtacctggcaaattggaagtctttcatcctttttttttaaactctgctattgcttaactctcatgcagaatatgcccttagttgttatatgcactcttttcttgttcttcatttgcagttcctggaacaagccattttgaacatttatgtagctatctttccctaccaaacaacctcatttgcctttttcaagaaaatagtgagataatgaattcactgattgaaaggtaatgattatatacttttctttgttgtattaaatagctctatggaaccaaactttagttatcacatatgtagcaaaattctcaagtaatgaccctggtagaattcaacacaaataattcaaactataatgggtgggccttttgttgttgtttgttttgttttgttttgtttttgtttttgtttttgttttgagactgagtcttgctctgtcacccaggctggagtgcagtggcatgatcttggctcactgcaacctccacctcctgggttcaggggattctcctgcctcggcctcccaagtagctggggttacaggcatacaccaccatgcctggctagttctttgaccaccatgttggtcaggctggtctcgaactcctgacctcaaatgattcacccacctcggccttccaaagtgctgggattacaggtgtgagccaccgcacctggcctatgagtaggcctttttagctaaggatctggcttttcagtaaactttttgccaagctagtgaatagcataaacaaatttgcatggaaggggaatagtggtagaaatgttgatttctttacatgaacttacttgttaaggactctcttccataggttttttcttgtttttgtttttaagagatggggttttgccattttttccagactgcctttgaactcctgggctgagacattcctcccacctcagcctcctgagtagctgggactgcaggcacatgccatcacactcagcttttcatagatttttaaagctgaaagaacccttaaggctatctagtccaataccctcaactttatatttgagaaaagtgaagtctagagaaattggcctgtcaatcatgtcaagttagtgactgagttaaatatatggctgttctgtccacaaaacgggggaaaatatttgcaaactacatatctgataagggattaacatccagaataggccgggcacagtggctcacccctgtaatcccagcactttgggaggcagaagtgggaggatcacttgagcccagaagttcaagaccagcctggggcgggggcgcggtggctcacgcctgtaatccgcagcactttgggaggcccagacgggcggatcacgaggtcaggagatcgagaccatcctggctaacacgatgaaaccccgtctctactaaaaatacaaaaaattagccaggtgtgttggtaggtgcctgtaatcccagctactcgggaggctgaggcaggagaatggcgtgaacccgggaggcggagcttgcagtgagccgagatcatgccactgcactccagcctgggggacaaagcgagactccgtctcaaaaaaaaaaaaaaaaaaaagaaagaccagcctgggtaacatggcgaaaccccatctctacaaaaaatttaaacattaggcatgctgacatgtacctgtcaggaggctgaagtgggaggatcacttgagccctggaggtcgaggctacagtgagctgcatgccattccactccagcctggatgacagatcaagaccctgtatcaaaagaaaaaatccagactatatatatccagaattcctacaacaacaacaaaaataaaacccaattaaaaaataggtaaagggcttaaataggcatttctccaaagaagataaatagccaaaaaagcatacgaaaagatgctcaacatcactagtcactggggaaatcacactgacataccacttcacacccattaggtgagctattacttttttaaaaaaagaaaattacaaatgtttacaaggatgtggaaaaactggtatactggtatccttgtgcatgggatatagaaaatgatagagccactacggaagacagcatgacagttcctcaaaaagataaacataaagttaccttatgattcagcaattccacttctaggtacagattacaaaataactgaaagcaggaactcagatcaatattatacacccacatttatagcagcattattcatgatagccaaaaaatggaaccaactcagatgttcaacagatgaatggatgcacaaaatgtggtgtgtacacacacacaatggactattattcagtcttaaaagtaggccaggtgtggtggtgcacgcctgtagtcccagctactcgggaggctgaggcaggagaatcacttgaacctgggaggcggaggttgcagtgagccaagattacgccactgcactccagcctgagtgacagagcaagactctgtctcaaaaagaaaagtaaagaaaattctcacacatgctacaacgtggatgaaccttgaggacgtgtgctaagtgaaataagccagtcacaaaaggataaatactgtatgattccacttcactgaggtacctagagtagtcaaatttatagaaacagaaagtagaatggtggttcccaggggctgggagaaggaattttgcatttaatgagtacagagtttcagttgggaaagatgaaaatgttctggagatggatggtggtgctggttgcacaacaatatgaaggtacttaatgctacagaacattagactttgaagtggttaacatggtcatttttatgttatatatattttaccacactaaaaaaaaaaatttttttttttttaagtctcactctgtcacccaggcttgagtgcactggcacagtcacagctcatcctcctgggttcaagcactcctcctgcctcagcttcccaagtagctgcgactacaggcacatgccaccacacccagctaatttttgtatttttagtagagaagggcttttgccatattgcccaggctggtctcaaactcctgggatcaagtaatcttcccgcctcagcctccgaaagtgcagggattacaggcatgagcacctggccaaaaaagttttatttttaatatgaatgttctagctccagataatgttagcttggcattaatacaaattaatatagactagtttttctagagtatccaaattagtaagataatgatgtttatagtcacaaattgtatatatttaagcattcttgcttttagaaaatattctcctgattttaaaagttgtaggcaaaatagtatttctacaggtttcttttgatgaagtaaatatgttaggtcaagaatattattttcctcttattggctatggaggggaaaaaattctagttctaaccctttaaaagtgttttgtgtttttccccctctgtttacattaaagttggtgccgtaacagtgaagttaaaagatatctagaaggtgaaagagatgctataaggtaagttaaagagcctcaaaaactttattgaggtgggagaaagggtggaatcaggatataagtgctatattccttcagaaactgacttctcaagcctttagtgattccaaaaggttaagatatgttgccttcatattttcttcttaatctaatgagagtctatcaaagtcagaattatgaacataaatatactacattcttggcagagaaagcaaataacaaagttatattttaggatatttgctttaaaaaatataacacgtctcctaggtttttcttagctctatttttttctatctttcattatgggaaaactctccagaagtgtgaagagtaaaataatgaggctccacatacttgtcattcaccttcaataactatcagtcaaatcatggccagtcatttcttataattattttttcttcatttctttttacattctattctgattctatagtaaagtgtgctctaccagatcctaacaagatgtgtctcaattgttactatacaagttgcgcatctctaatccaaaaatctgaaatttggaatgtccccatgagcattcctttaagcatcatgttggcactcaaaaagtttcaaattatggagcatttcagatttcaggttttaacagtagagatactcaacctggattaacaattgaaatgcatttgttgttatctggtagagtatgctttactacagaatccaaacagaagtaatgcaaacattccaaactctaaaagaattcaaaacccaaagcacttctggtcccaagcatctcagataagggatactcaacccatatctcttagttctggtaaatacatcgtccataaaagtcagaagactagagattatctgtcctatttgtttgcttttacacatccagaaataacaccccaattttattagtttggaccacatgaaatgtcaatttttatcagtcaaaaatggttgaatatcacaatttcatgtgattccaccctgacgtcagaaaactcttaataaatggaacagtaatcctcaactagaagtatacatcagaataaccttgggaacttttgaaaaaatactcaggccactacctactgaatctaatttctctaaagttaaagccctagcatgtctgtcccctcaaaattcccccaagtgattttgatatgattaagaactactgtctagccgagcacattggctcacgcctgtaatcccagcattttgggaggccgaggcgggcagatcacgaggtcaggagatcaagaccatcctggctaatacggtgaaaccctgtctctactaaaaaaaaaaaaatacaaaaaattagctgggcatggtggcgggtgcctgtagtcccagctactcgggaggctgaggcaggagaatagcatgaacccgggaggcggaggttgcagtgagccaagattgcgccactgcactccagcctgggcacagagctagactccgtctcaaaaaaaaaacaaaaaacaaaaacaaaaaaaaaactgtctaaaataatccccccttcagtttaactccatttcttgtcttggcaataggtaaagtagtgaaaggccataccatgttacccgggctaggcaggtatgtgcacatggaagtgcctcatagtataatatgacctaaattaatggagtgttctttaatttttctctttttttcagatatccaagagaatctaacaaattaataaaccttccagaggattacagcagcctcattaatcaagcatccaatttctcgtaagttttgctgttagcattgaacattccctgccactggaaacacctctctacaaagaatttgaaggattttgttgttgttctttgtttgggtagagaaatcatatctgtagtcctttatgagaggagagggagaaaaaaggaaaaaaagaagaaacttggcgaggcacggtggctcacgcctgtaatcccagcactttgggaggccgaggtgggtggatcacctgaggtcaggagttccagcctggccaaacccttggtgaaaccctgtctctactaaaaatacagaattagcggggcatggtggcaggcgcctgtaatcgcagctactcgggaggctgaggcaggagaatcacttgaacctgagaggcagaggttgtagtgagccaagattgagcaattacactccagcctgggtgacaaaagcaaaactctgtctcaaaaaatgaataacatctgtagtactctatactacataacttataaaagcatcatttcactatgtttcagaataagacatggaatgggagtaggagaagcaaatttgattcatgaatgtttaataattgcacttaaagtaataacagcccttagtaatttttttttttttttgagacgagtctcgctctgttgcccaggatggagtgcagtggtgcaaccttggctcgctgcaacctccgcctcccagatgctagtgattcttgtacctcagcctcctgagtagctgggattacaggcatgcaccacaacgcccagctaattttttttttgtatttttagtatcacctcagcctcccaaagtgctgggattacaggcatgagccactacacccggcagtaatttttaatatagtatcaaatatttaacatacaagcagcataaagaataatataataggggaggctgaggtgggagtatcactcgagcccaggagatggaggctgcagttagtcatgatcgtgccactgcactctagcctgggtgacagcgagaccttgtctcaaaaaaaaaaagaagaatataataatgtaagagcttaaacattacctagacagttgaagctccccagctgtctcttctctgttgcctctttctcctccctctgaagatacctactattctaaatggaatattaagcattccattcctatacattaactatataagtttctattcttgagcagcatgtattgttattttgtatgttttttttttaattagtatttattgatcattcttgggtgtttctcggagggggggatttggcagggtcataggacaatagtggagggaaggtcagcagataaagatgtgaacaaaggtctctggttttcctaggcagaggtccctgcggccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttcccccttttctattcgacaaaaccgccatcgtcatcacggcctgttgtcaatgagctgttggttgcacctcccagatggggtggcggccaggtagagaggctcctcacttcccagacggggcagccgggcagaggcgccccccacctcccggacggggcggctggccgggtgggagctgccccccacctcccggacggggcagctggccgggtaggggctgccccccacctcccggactgggcggctgctgggcggagacgctcctcacttcccagacggggcggctgccgggcggaggggctcctcacttctcagacggggcagccggtcggagacactcctcacctcccagacagggtcgcggccgggcagaggcgctcctcacatcccagacggggcggcggggcagaggcgctccccacatcccagacgatgggcggccgggcagagacgctcctcacttcctagacgggatgacggccaggaagaggggctcctcacttctcagactgggcggccgggcagagacgctcgtcacttcctagacggggtggcggccgggcagaggctgcaatctccgcactttgggaggccaaggcaggcggctgggaggtggaggttgtagcgagccgagatcgcgccactgcactccagcctgggcaacattgagcactgagtgagcaagactccctctgcaatcctggcacctcgggaggccgaggctggcagatcactcgccgtcaggagctggagaccagcccggccaacacggcgaaaccccgtctccaccaaaaaatacaaaaaccagtcaggcgtggcggcgcgcgcctgcaatcccaggcactgggcaggctgagacaggagaatcaggcagggaggttgcagtgagccaagatggcggcagtacagtccagcctcggctcggcatcagagggagactgtgcaaaggggagagggagagaagagagggagagggagagctgtatgttgtattttattttatttatttatttatttatttatttattgagacagggtctcactctgttgcccaggctggagtgcagtggtgtgatcttggctcacagcaacctccgcctcccaggttcaagtgattctccagtctcagcctccaaagtagctgggactacaggtgcacaccaccatgcctggctaatttttgtatttttagtagagacggggtttcaccatattggtcaggctggtctcaaactcctgacctcagttgatccacccacctttgcctcccaaagtgctgggattacaggcgtgagccactgcacccagccaattttgcattcattcagcattgtttctaagatttatctgtattgacgtttataactttattgatttttcattgctccatagtattttattatatggcagtggtaccgtttatctttttctcctattgatgattttatttatttttttttctccagttactgattcttttgagtgtttccagtacatggtctttgtatatatgtgcaagatgtttcctattccagattctaggaataaacttgcatagactgtaggatatacacttctttggctttacttgatattgcagaattcttttctgggctggttttttcatcactagctctttagccactctttagatcaatgacttgtgggttttttatcccttggaggtgcccgaaatcaggtggtgataagagcagagccccaactctgtgccttgtgtgcggatctctgctgtgctcccagagttactgctgccagactgaactggaaggggaggatgtaggagcctgcacagctcacacctactcctgtggctctggagtgggcatcttcctgaggtaaggacctgcaggggctttttagctttggatctgcctcagtatctgactgttagggtgtcacaggaaactactatattgccaggaattttgagactactgttccgtgtgattcattccagaaacgtggagctccttgtcgcctcacatctcacatctggtccatgccaactctgtgttggttcttttattgttaccattcccactcctcttccctcaaccataggtgacagttctgttctactttctccatgtctcccactaatgtgaaacttctctgattttctgaacaaatccagtcagaattactctttctgttatgtcctcatggcttttggattttacctccacttatacatattatcacaactctacatgccagcttgtgattagtgactactatgtaccaggcattgaggatgcagtagtccacagtgcaaagatctctgcccttatggatggagcttgttttgtatgagagagaggacaagcaagactgacaagaatttagatagtgatataggctaaggagaaaaaataaagcagggaaggggaatatgaaatggcagctatggagctaaatttgagatttaattttagtagatcagggaaggcttcctaagaacatgacttctgagtaaagacctaaagaagtgggagaacattctactcagaacattctgcacagttcctggggtagaaatgtgcctgtctgctcaaggcaaggaggcgcgtgtcactggagtgttgtgcacaggtgagagaatccaggggcctgctgtgtgctggtgacatctctgggcaaggtgtaagccatttcagggtttgaagcagaggcatgacatgagtgtgggctcctctggagcataggttgtatccatagcttagtcatccccccagtaccttgataatttcttatacgtattaggtcctcaataaatgtctgtttaattgtgctgtactattaatgccagaaaaaggcaaatgtctcaaagggatcaggggacacaaatttgactcgattcaacctatttcctagtttgtgcacaattttttaatggataacttcctcctaatagtggtttaaatatcagtactataagacttcattctatttggaactgaatacaaatgttggttactaatgtgtaaatgtgtaacgtatgactgatctctctacagagtacgggaatgtcaggtgctatttttagctggcaaaaccaaaggctgtttttattctcctccttaccttgatgactatggggagaccgaccagggactcaggtaagaacccatcctgagttagctaactcagggcctgcagcgcccttccgtatgtggtgacgtcctgagggtggagggctgaggtggttctggaagaggtggctgtgttatctgtggagtcttccaaggagggtgccctgtcagcctggtttggtgttcttttcccagccttcagaatgccatgaggaacatcaggataggtaagggaagagaataggacagagtgcaactttattccatttatcactccaaagaactgtttgaattgccatatagcatcccagctcagagcactccagggatggcccactctgacttgtatggccttgtatagaggaagcccagtgtttgagaaaatcttaattgctaacaaatgtgcttattacattaaaatctgggggacaaagatttaaaacataaagaacaatataacaatatttgaggctaagttacttctactctggtagctttagtatattgtaagctaacaattcccccaagcactattaaagaacttctttcagaccatctcttttgtctaaaggaggtataagttttaaccgccatagatatgcctgtccagccttaagtagcagatgttaaaggcctagaaacccaagcaaggtaagtagatgagctgccccaggcgctggactgcgaggctatgcccatatgccacccagtgctggtgcttcccactgttctcagcgtgggctgttaggaggaggagagtctgattagtgagtgagaggatggctgtgctcagaaacaggagcagaggtgcctggctcagggcactggtcccaggcaggaacccaccaaagcttgcacttgtgtttaaattagacctggaagttactcacatttgattgcttcactgagactgtggctgaaagattgcatctgaggaatgtttttcttttcttttcttttcttttttctttgcactcttagtaaaatctgtgaggaatatttttactcctataattcttcttttgtgttctcctctgccctcttccctttttacacgttaccaacaaaatgggcaatgaattggtagttttagcctctcaacccagaccctccttatcccccgcaacctctattccctcacctcactctgggtaagtctggtttgtgtacctttccttcctcatttcagcacttattcccttttacctgctcttggcaaagggtcagagctgatgtttttgttaatagccacagtcacctgccagacagaaatgttgcagggagtctaaaaccaataacttgtaaccttgcctaaatcaggaagggttgggttataatagaggaataaacagaacacattctgagtgacatgtgtcttctctttctagacggggaaatcctttacatttatgcaaagagcgattcaagaagattcagaagctctggcaccaacacagtgtcacagaggaaattggacatgcacaggaagccaatcagacactggttggcattgactggcaacatttataattattgcaccaccaaaaaacacaaacttggatttttttaacccagttggctttttaagaaagaaagaagttctgctgaatttggaaataaattctttatttaaactttccttcccagttttatagtttctggttctgaggactgatgaaaatcatcttccatcagcagattttcttgcactgtttgctgtgcccctcaaatataatgtcttgggttttaagatcgagcaaggagcttctcttcctagattggatcccagcccctttgtgggggtctgactgcatagtcccagccattatgtgatatttcacgttattgatgatagtgaaccgtgggtccgaagctgactcaacggaggcagggaacaaagtctctgtggtctgttgggtcatacttcctggttccactgagtggcccaacactgggactgggttggtgtcccctctgctgacaggaccctactcctaggagcaaagtggttgattttgaaggcagtgttcccttctctccattgactatgagagagttgggggacacacatgcagaagaagcccgtggggagaaggtggattcctggtgtgctggctggtttttcagggctgttagaggttttttttttttctttttttttttatggcaagacttttggctttgagaaaactcacttagagggctttccaaaaacttaggatggtctaaaaaattaggatattcttttagaattaggaagaaaaattaggatattctaaaagaatatggattaaaaatttaggatattcttttagatatcctaatatctagatgagaggccttccttcataagatctggttgtttgggctgtggttggcataagtgatatttattttggcctctgtcacatccagtttcttgagcttttaaggtaagcttcttttggctttttttcagatgttcaccaagcttaagtttaaaataataggtattctaaaagagtatcctaattttcttatctgtattcttttagaataccctaatgtttcagacagtgatattctcttgttatttctaaggctaaattggcagagtatatcatctaaagccaaacactgaagaaggtgagaacccactcccacccagccagcatttcctggaacagacaagctgctgcttccttgctggctcacttagtgcattcctgggatggtctggcacccaggctttttattctttttgatcattgttcttactgaggtgccttcctagaacaagagccacttacaaaatagcttataattattatgtaccacacaactactattgtttgatgtatgactgctgagagcttgaatacatgcagagagtgactgaagacttagtagaggaataaattctgagcctgtctaaggtggggctaaggaacagatgagtaataagaggctcttggatttttttaaccaatgcaactgaccctttcaatcagttttctttgaattacatctacaagttttgttccactcagctaccagtcaactaggcatgctccacagtatcacaggaagaaggtcagaaatctggaactgaagctaaaagaagtgaggatgtagaagccacattcctctccaaggtagtgtgtgaaagaaccgccccctcttgacaggaggatgaccgtcgccattcttgcgtgggactgactcacccagctgagaggaggaccaatagaaagaaaattcacatttgagtccacctctctccccctttttctggccttcattcataagatctggttgtttgggctgtaggtggcataattcatgtttattttggcctctgtcacatccagtttctttagcttttaaggtaagcttcttttggctttttttcatatgttcaccaagctaaaatttaaaataataagaccaggtttctctctgtacaagtggattataaacattttcaccaaatcataacaatactccagctttccggtccgacttcctaggagcctggagttagcaaaggttgtctctggatttcattctctgagaatatcacagagcctgggagaagatgaatttacatgaaattgcaacatacacacctttttattttctggtgttaagctagttgtctttcctaccttacaaatcatgttagttttatgatttgttccgcatgttttatgtttattgtagaaatgtttatataacatacgctttccatatcagggaaaatcatatctgtttaataaattggctataactttaatatctgtggacaacttgtaaaatttggaatgtatcatatgtaaaaagtttaaagatatccaaataaatgctttaggtgttggcatta

SEQ ID NO: 6420 - DNA, 2071 bp, Homo sapiens
actcttgttttttaagtcacatttattgaggtatattttacaaacagattaactctttttagtgtacagttttatacattttaacaaatgcatacagttaaacaaccacaatcgagaaatagaacaattccatcttccccaaaagtcccctttgtagtcagcttcttgcctcatcctggctttcagctaccagtgtttttctctccctttgttttgtctcttcccgaatgttatataaatggaattgtatcatatgtagcattttgagtctggcttctcactaaagaagaatgcattcgggtcctccctgttcctttggattgctgagtagcattccgttgtacagacttctgggcagttgccagatgaagggcatttgggtgagtttgggtgattgttttggtgattactgctacaaacattcatggatgggtttttgtacaaacctgaattttcacttccctcaggtaaatagctagaagttgtcccttacatcttaatcctccatttgatgccatcctgagagctcagcattctctaatctgtaactttgctgtttacagtcctctgtgatggacaggataaaatgctgtcaggagttaagaactgacatgtttttccccttccagccaatctatccattgtgacctgggaaggcacttgtctcttccctggactttcatagtattggacagacacttttctcttcctaacacagtggtgctgcctgcctgcgctgtcattgagagccatctttttagccagtcgtggatgaaaagccctgtcttggtccacgattttccctggctaagctgcaaacatgctggcctagtgtaacaggtgcccggacgaggaggggcaggggagcgtgcagagcgggcacctaatcttattaacccatattaaggttactaggggtttatttactggcagctcagtcccaggcttgaagcatgttgtaaagaagctgtgggttctggaactgaggccaaaaattctaggacacagcttcccaaatattcaggatagtcatcacctgtttcttcaccgtggagtgagcattttaaaaatgaaagtcctaaggccctgtctacccccaccccatcccggggctatgctggcagaactttaaaagctagctgggccaggtggctcactcctataatcccagcactttgggaggccaaggcgggcagatcacctaaggacaggagttcgagaccagcctggccaacatggtgaaatctcatctctaataaaaatacaaaaattagccgggcgtggtggcaaacgcctgtaatcccagctagtagggaggctgaggcaggagaatcacttgaacccaggaggcggaggttgcagtgagctgagatcatgccattgcactccagcctgggcaacaagagcaaaactccatatttgaaaaaaaaaaaaaaaaagtaggctgggtccctcaggagaaaaggatttacaccagcccaaggaaagactgaagttacacacaagcaaaaacctgatagcagagacttcctgggcactggtaggtgaccaaaagggatggtccaggtttctctcgcaactaccggctacctgagaagacctgttaaaatgcagttaaccctaagcctgctccgaaccaatgagtgagatttattgtagagtcaatgcactcttggtcctctcaacaaccttcagattctcaggttgttcacatttgctcctataacctggccccatagagactcatatttccctgtttgaggaaataacgttttggccagaggagaagaaaaaatggcttggagttttgcctaaatttctacattaaaattccatgtattcagctctggttcaaactccagcaaatgctgagattatttggatataataatagtcactgttgtaatagtcaccgttcttacaggtaagagatggcaagatggagagatgtgatacccaagccatgtttataacaacgattgttaccaatgcttcccttagggtgggtttcttttcttttttggcaaatactagcggtagtaggggattctgatatatgttgttgaatggg

SEQ ID NO: 6421 - DNA, 7428 bp, Homo sapiens
actgaatggtcagatgagctgaggcagaagttcctagaagggtttgatgcctttttggaattactaaaatgtatgcaggtatgtaaaaactgttacacttttctttttccttttttttttttctcttttctctttttttttttttttttaatttttctttttctttttaagagatgggggtctcactgtgttgcccagggtggagtgtagtggctagtcatagacacaaccatagtgtactatacctttgaactcctggtctctggcagttctcctgcctcagcctccaaagttgcctgggactagaggcgcaggcacgggcccaggcccagcttctttgttgttgttgttgttgttgttgttgttgttcattgaaatgaacagctttctgtctgcgcatcttttcatttcgtgcacatttccaaaagatcaatttggatggctgcaattctgaccaggaagctcctctttaattggaaattcttagaaaggtatggagcaaaggagatcccagcaaacattccggcatctactgctcttgggttttttctgtgttggttttttttgttttgttttgtttatgagatggagtctcactctgtcgcccaggctggagtgcagtggcgcaatctcagctcactgcaatctccacctccagagttcaagtgaatatcctgcctcagcctctcaaacagctggaattacaggtatacaccaccacaccagctaattttttgtatttttaatagagatagggtttcaccaagttgtccaggctggtctcgaactcctgacctcaagtgatccacccacctcaacctcccagagtgctgggattaccggcatgagccaccgcacctggccagtttttggggttgtttttttgtttgttttttgttttgttttgttttgttttgtttgagacatagtttttcactctgttgcccaggctggagtacaatggcacaatcctggctcactgcaacctccgcctcctgggttcaagtgattctctgacctcagctttttgagtagctgggattacaggcacctgccaccatgcctggctattttttgtatttttagtagagacgaggtttcaccaagttgtccaggctgatttcaaactgctgacctcaagtgatccgcccacctcggcctcccaatgtgctgggattacaggcatgagccactgcgccagccacttttatatttctttggtttccactaatgttctttctttagaggttacaagtttatttttttaatatgctttcttggaagtatagtcaagttatttgagaaactgtagtggtttttgattttgctttttaatgtttccatgtttctttttctctccttcatgtggtatttatataatacagtgtagacctttttcccctgtttaattctctttttaggaaacatccctatatacaaaacagaatctagaagtagaaacgaacaggtatatttaaccagttataactgtaagaagataggtgacgtctctaaaaatctgagcaagtactattatgatttctttagtagccacctggctttcttaagaaaaggaatgaccaaagttgacttaccatttttatttttatttgtttgaatttatttttatttatttatttattttggaggtggaggtttgctctatcgcccaggcgggagtgcagtggcgcgatcttggctcactgcaacctctgcctcccaggttcaagcaattcttctgcctcagcctcccgagtagctgggattacaggtgcacgccaccacacctagctcatttttgtattgttagtagagacagggtttcgccatgttggccaggctggtcttgaattcctgacctcaagtgatccacccgcctcggcctcccaaagtgctgggattacaggcgtgggccaccatgtctggcctgacttaccattctagttcctaggttgggtggtagttcatgggtgtttattataatactactatgtttttcatgtatctgtgaaaacaatagctactttggtcatttttgatacttgaagtattctgtattctctattgtttaataagttctgacatactagaatagttaggctagtttctgaacagtaattttaattaaaagctatttattgttttgccttctttcaggctctgtgaaaacttctaattgcatattaggacataatattaaaactttattataaaatacagttataaattcaataacattttaaaagcttgtcacatttcttttaacaattttttctatagaccatagagctaaaaaggaaggattattgcagtgaaatattgaagtattttattgcctaaaacagatcttagatgatacctctgaaataatgtgtttattgggatttctaaatttatattttagagaatgttatataaacacataattttaaaagctattatttctcatagtacttgaagtttcctgttaaaacttataccttctatgtttttataatcaatatatatttctcctacattacttcttaggtttccatataaaagaacaactattattttcattcatatataattttttcacttccgttaagggaatggatccaattacacgtcaagtaggacaacatattgaaatggaaccagagtgggaagcagccttcacactacaaatgaaattaacacatgtcatttcaatgatgcaggactggtgtgcttcagatgtgagtttcttctgggtgcggggaataggaggaaagtggaagagggaggaataagcagaatcctaagtaaatttcaaggagatctggagaaaatagtggtgatacttagttcattaaacagcgtattttccttctccacctataaactcagtaaaattttaaaattctacagcctgaggaaaaacttgaaaaatagagaaagaaataatccagattgtctcttccctaatgtaactatctttgttttttttccataatcccttctagactttgaggatataaaaatggtagtttctaaatttattcaaaaataaagttttattattggtacatttgtcctgtgtcttaaaattattttggccttcctttggcgataaagtctagatgagagcctgtatacattatgaggttagggaggtttctgtaaggtctgaacaatctgtaaaagttaatggaacaatgagtaaatgatattcctgactgagaagacagctgcattatagtctgtgatgacagggactagggtagtcctaggagctatagaaaggtctgtggttggagcacagaagtagagaacagagatttgggcacaggagtgatttttcggggccttggccatggttgtttttttttttgttttttttttttttgagacacagcttactctgttgcccaggccagagtgcagtggtgcaatcccggctcactgcagcctcaacctccctgggcttaggtgatcctcccacctcagcctcccaagtagctgggacaacaggcacacaccaccacacctggctaatttttctattttttgtagagacagggcttcgccgtgttacccaggctggtcttgaattcctgggctcaagcgatctgcttgcctcggcctcccaaagtcttggaattaccagcgtgagccaccacactcagcctgcattttatttgaattgaagtgggaagcctttagagattaccatctctctattaaattccctgcttcaactcttgccccctttatccattttccatacagtgacatgattcaatttacatgttttttaaaattgctctgtatggagaatggatgaagggggcaagagtcaaagcaggaatttaatagagagacgcttggcaatgccttggagttactagagatagagaaaagtagcaagttttgagagaaacttagaagatgaagttgccagcttggtaatagattggacaatggggaatgggggaaaggagggtattggaataacttctagatttctgcactatatgagtaaatgtatcattcactgagatgagggacactggaagagggaccaaatttgggagggaggattgagtttggttttgcctatattgttatttgaggtacttactcactgaatttaaggtgcttattcaatgttgtaaaaactcaaccttttgagtaacttacagaaaaaccctcttttttaggaaaaagtgttaatcgaagcttacaagaaatgtctcgctgtactgatgcagtgtcatggtggttatactgatggtgaacagccaatcacactaagcatttgtggacattcagtggaaactatcagatactgtgtttcccaagaaaaagttagcattcacctcccagtttctcgcttacttgcaggtaaagcatttcccctaaaataaaaccctaaaattatcttttaaattgttgtttgtggttaatatctgtgaatacttactttgtgccagatgttattctgtgatttctacatcattaacttatccaatcatcacatcgtcctgtgaagtaggtattattattaagcttgcttcatagatgggaagacagaggcatagagagtgacttgcttagtaagtcacacaacaagaaagaatcagttggcattatgaggaagtttggcaccagaggccatgtttatagccgttataccatagtgcttctttagacaactacagataccacgttttatcatttcatcgaatccagcttcaaagtctatgttgttaccattcaaattaatctgtcacttaagcaattgctaatcatttgaagccaccctaggttttctattctcctttttttcctctccctctgagctgtttcatatatttattgatagctttttacgcaacaggtcaagaacaaggacataatggggtgataatcttttaatttcaagtagttgatttacaagccacttgtaattaattggtagaatgtctgaagctgccatcttatgtggccaaagactttgaatatgcacttatccatctctgcagactcatttcagtacagctttcatatttcttgattctaggtattcttttcttgctcgcacactgttgttttctttagttccgttttaactcagagaacagaaagaaattttgaaggtatttttactcattgtaaaatatgtagtttatgttaagtttgtggctcagtagcttaatgtgatgtgagggtatgttttttgttttgttttgtttttttctggaggagattgtagagagtttgtttcatttcttccttaaatgtttgacagaattcaccagtgaagtcatctcatctgatgctttaggttttggaaggttattaataattgactcaatttctttaatagatacgggcctgtttaggttatctttttctccttgtgtgagttttggtagtctgtgtctttcagggaattgatccatttcatctaagttatcagatttgtgggcctagagttgttaatattccttcattatccttttaatgtacatggggtcagtagtaatgattcctctttcattctgaaggcattttttttcattgttctgagacctatcacattatcccactgatagacccttgccatgggtatattattgaagtcatggtaatttaagataattacttactctgaggcttataaagttgttattcctagacatatgaatatcaaatggtacaatagaccattacctagaatgaaatcatgatcgtaagaagaaatctctcttatttctataacttgttcaggcccagttttgtttttataagtgttttgagcaactgaactgtcaatcctcaacacaggcaattgatggcatggtgttgtggaaaagtattggacagaaggcaagaaagtgaggcatgcgtgtggaagtagcacgcaggcgcagcgtggcatgccctgcacgtgcccttaaaaaaaaaaaaggcaagaaattgagtaatgagtcctgtctccaactgagccactgatctcttctgcctttaaaaatcagagtgagactctgtctcaaaaaaaaaaagtctaattttatgggaggaagctgatgctgatagttatctacagtgaaaaaagtcagtgctctaaaaatgtactaatttctgcctaggtttttacctccctcaaagctgtcgtgtgaatatttttgagtattcatttcatggtatttcataaaccttagcctaactgcttataatctaattggaaatctaagtaaaccaacacaaaacagttcatggacagtttgaagcaagtgctaatggagtttgtaaatgttgagcatttacaacatttacaaatggagcagtaaatgttgagaataagctattagaatggcattagtagtgcaagttttcctagatgaagaaagcctcaaaccaggcttgagtaaatggccattatatattgataagactttaaagggtgtcctctgtttaagcaatagcataaacaacacattcagaatgaactgaaggctgggcgtggtggctcatgcctgtaatcccagcactttgggaggccgaggccagcagatcacctgaggtcaggagttcgagaccagcctggccaacatggcaaaaccccgtctctactaaaaataaaaaaattagctgggcatggtggagtgcacctgtagtcccagctgctctgctcaggaggctgaggcaggagaatcgcttgaacctgggaggcagaggttgcagtcagccaagatcccttgaggttagaaactaatgaggctttgatcctaaaccaaaagttctggggaacttaattcaaaggtcagtatcagtaaggaccgtgaattccagggccagtttttccgatcagtggccagaaggatctctcactgctatactttaaatgggaacaaattccatggcccagtgaaatacaactcttaaagctggcataacatgtatataaattgttttgatagcttttaaaatgtcattggtgtgtattagtacatacaactaagactagttctaagtgtgcctttgataacagattcatgagaagcattaaaaagcctcttttattagccgggtgtggtggcgggtgcctgtggtcccagctactcgggaggctgaggcaggagaatggcgtgaacccgggaggcggagcttgcagtgatccaagatcgcgccactgcactccagccgggtgacagagcgagactccgtctcaaaaaattaataataataataagcctcttatgaatatagatcattttctatcttaattggtaatttgataggttcccaaagagaaaagaagttagatataaagttgagtgaatatttagggtatttttcctaaatgatttttactgatagaaatactgttttttgtttgttctttcatgcaggtttacatgtattattaagcaaaagtgaagtggcatataaatttcc

SEQ ID NO: 6422 - DNA, 17646 bp, Homo sapiens
gtttgtaaatattatctctgtggtttttgtcctgcggaattgttcacaaatacacgttctgatcttggtaagtgaattttctgtgtaacttttatcaaatttatgatatttaaaatgttgaataggagtggtgaaaggaaaaaaactgattataattctgtgaagttttttcttaaagatttgctaataagtaatttcttacttggtttagatatttgaatgtattaataaatgtcagtctgattaaacatggtggcttaattaaacatacatgtctatttccactccctcccaaaactccacttaaatgaaaaaaattttaaaaagatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggtaccacagaaggcagggttgagtcatggggctgaaaatgagagagattagtctgtagtctagttcagggtttctcaaccttgacattgttgacattttgagccagttttggagggggcttttcatgcattgtgggatgtttagcaacatctctggcctttacccactagataaccagtagcaccccctgttgtgacaccccaaaatgtcttcagacattgccagatgtcccccaggatgcaaaattgccactagtgtaggtggtcctgtgcatctgttgatcttactctcctccccatagaccccaggagaagagagggttattttctggagaaattggactagagagactagtttatctgaaccacaaaatagaaaaaaataattgactatttcctcaattctctcaaggatggtacataaccaggatcattctggatacataaaagaagtcaattcattatgtacaatctttgccttagagcattaggagcatattaaggcaggaccagtctagatcttgagatttcagacacagcaggggcagtagtaagttaaaaaaagaatgtaaaacagagtaaatgaatctatatttttattggtggggctctcctctgccctgttcctagaaggatacagccagatgtttttccccaggcagaagaaaagaggattcttctctagagaaagtgaacagttcctgagaagtgatctctgcaggtactgacccttggggaatctcttaaaagaaagtcttactgcctgattttcctatgataaagcccattcatgagctgacaaaccctgcctaatccctactaacttccagtcagattttggaagtgtctttttaaaaaattagttgcttgccaaggaccaccagccagacgttcgaagaaagccttcaacacaagagattaacaaaaccaacagagaaagaagaatttagtggaattggagataatggggaaagcagaagagagattcttcaaaatcttaagaaatttagtatcttcagagacatatgagaagacactatattcttcagcaataatacgatgccataaagagggaacttgtggaaaaagtgaaaaacattttctgaaaaacagctcttagaaattaaaactgaagaaatagaactaaaatcaccagaaagatttgaaaataaaattaaggaaatttactggaatattgggcagtacgacagaaggatttttaaaaaacttagtccaggaactgtactaccagcttaatagttgtggacagaataaaagcagagggaattgcttaagaaaaaaaatttgcagtactaaaggacattcatctttaggttgagcaggtcctacaagtgatcaggacagtgaatgaaaaagatccatacctaggcatacccctgtgaaattttagaacacgggggtggtgggggtgggtgtaggtcacagaattatgaatcagaatggcctaagactggtcagtaacaacgggggaagttgaagacattggagaaacatcctcagggtgctgagtgaaaatgtgtctgccggagggggaaaaagacattttcagatatacagggtctcaactgatttatctcccacgggccttttctcaggaaactccaccaaaacatgtccataaaccgagaaagaggaaagaaaaaacaagagatccagtaattctcatctactacagagcagaaaaggaattcatcaggacaataattctatagtgagcttagaaaataagtatcccagattgaagtaaggcagaaggcccatggaagaaaatgaaactgatgatgtgatatattttgagtcatatgtgaaattagtattgagatagtttctatagctgagtttgaagtgtttgagaagaatttgaaaatatagagaaaaaactaggctcacacctgtaatcccagcacttttggaggcaaaggagggcagatcactcgaggtgaggagttcaagaacagcttgcccaacagggtgaaatcctgtctctactaaaaatacaaaaaaattacgcaggcatggtggtgggtgcctgtaatcctagctccttggaaggttgaggcaggagaatcccttgaacctggtgggcagaagttgcggtgagccaaaattgcgccgctgcactccggcctgggcgacagagcaagactctatctcaaaaaaaacaaaacaacaacaacaacaacagaaaacatcagaagtgtctcataatgagcctttgtttggcctgacagtgaatagtacttgcataatataagcaccaagtgtttatttatccaaaaattttgatgtctaggattgataaatagcaaaataagcatagaattttaaaaggtggaggtaaattcgggaagaaatagagaagagttaagataattgctttttagaggtgggaagaagtaggggttaggtactagtctagtgctatttgactttatatacagatttgaaaataataaagtcggcaatggttcagttcagtggtctgtccccatcagttttctttagtggcaataaggaacagtttcctttcaccttccctccttttctccctccctcctttacttctcttttaaccatatatggttgctgtccattatattgactttgaagactgagcagatcaattttatatcctatttggttatgatgcttcatgatttagtaggatcagtttagatgtctacaaactactcagtgataaagtgaatcctttttctttttaaaaagaaaaataactctttttttttggcaagaaaaggttgctaataatcacagataatttatacaattatattttttcccccaggtccgtgtgaaaaaattcatgatgaaaatctacgaaaacagtaagttattttgcttgtcatttccacccccccagttattagttggtttaagtgggacaagggttgaggaataattgcaattaaatgtaaaatgagtgtctgagagaagtccagtcagtggctggggatagtaagaaagttctatagcttcagtaatgatactgatagctaccacatgagtgcaccctgtatgtcagactttttttttctgtagcccatttgctgttttttttaaatgagcctcactgtgtcgctcaggctggagtgcagtggcatgatctcagcttactgcaacctccgcctcccaggttcaagggattctcctgcctcaaactcccgagtagttgggattacaggtgcccaccaccatgcctgactaatattttgtatttttagtagagacagggtttcaccatgttggccaggctggtctcaaactgctgacctcaagtgatccacccacctcggcctcccaaagtgctgggattacaggcgtgagccaccatgcccagccccgattttatccatgagacttgtcctaggtccagggtcatagatccagtacagtggtaaagctagtggttaaacccctgtgtaaagctctatgatgaggggcaatcagaaagtcacttcaaatacacctggtttaccctgcagcctaaatggaatagtcgttgaggctagttaagatagaatatttgagttgtaatggctgaagatttggaaatgagtacttgtttattttcatgttaccaggtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggtaagtgaagtcaattcagtctttgtaaacggtccttgttttctggagattcagagacctccctaatatttttgaaacttgtcttctgttcattactttgttctttaaaatgatatgaaacttatagggcattcattttttttccagtctttattagcaaacataacactgattttgctaaccataagatttttctttgtttttatttttcttgaggccaagatttttcccttaaatagtagtaactgacaatatgtgattgaccaacagaagttgaagataattgaattactatcctttcaattaagcattttaattattaaatagaaatattatgtatggtatgtgcaagtttgcatgtttatctttgttttcaacttgttggtaatacgttttattgtcttcaataggccgctggcccaacaggcaaaaatgaagaaaaaattcaggttctaacagacaaaattgatgtacttctgcaacaggtgagaattgtgtgcattaatgtcaggaagtaatgtgaaacagacatgtaaccagcaaaaatacaaggatgggccaggcatggtaactcatgtgtataatcccagcactttgggaggccgaggcgggaggattgcttgagccggagaatttgagaccagtctgggcaacaaagtgagacccagtctttacaaaaattagccaggtgcaatggcgtgtacctgtggtcccagctacacacgaggctgagttaggagaattgcttaagcctacaagggcgaggctgtagttagacgtgtctgtgccactgcactccagcttgggcaacagagtgagacctcgtcttgtgtgtgtgtgtgtgtgtacatgtacatatatatgtatctgaaaggacagcaaatatgaaaagacgctcaacactattagtcgttagggaaatacagattaaaactgcaatcaaatacctatttgacacctatgagaatagctaaaattaaactgatcataccagctattggcaaggatgtgagccagctggaactggggtataatattgcacaaccactttggaaaaaatagtctcatttttttctttcatattcctgtagatgatattggagtctgttttgttgtcgttgttactgtttttttgacagtcttgctttgtcacccatgctggagtgcagtggtgcgatctcagctcactgcaacctctgcctcccaggttcaaatgattctcctgcctcagcctcccgagtagctgggattacaggtgtgcgccaccatccccggctgattgttgtatttttaatagagatggggtttcaccgtgctggccaagctggtctcaaattcctgacctcaagtaatccgcccaccttggcttcccaaagtgttgagattacaggtgtaagccactgtgcctggccctggagtctcttaaaaagttaaaaatgtaccatatgccattctactcccaaatatttatccaagagaaatgaaaacatatgtctacacaaagatttacactccagtgttcatgagtgctatattcataatggcacaaaaaaaataaaacccagactggaatcaattaaaatacccatcagcaggtgagtggataattaaatcatgatgtatctatatggtggaatgcctgtcagtaataaaagggaattagctacatgagacaatatgggtggatcttaaaataattaggctgagtgaaagaagccggacaaaaaaggaatatagactctatgactctatataaaattttagaaaatgcatattaacctacagtgacagaaagcagatctgtggttgcctggggattgtgtttaggattcaggctggaggaggtactgaaaagagtaggtggctcacacctgtaatcccagcactttgggaggattgcttgagcccagcagttcaaaaccagcctgggcaacatagtgagacgctgtctttccttttttttaaaaaaaaaaacagagtctcacgtcatcatccaggctggagtgcagtggcacgatcttggctcactgcagcctcctcctcctgggttcaagcaattcttctgcctcagtctccccagtagctgggattacaggtgcccaccaccatgcctggctaattttttttttttatatttttagtagagatggggtttcaccatgttggccaggctggtcttgaattcctgacctcaggtgatctgcccaccttggcctcccaaagtgcttggattacaggcatgagccatcgcgtctggccgaaagtgcatttttcttaacacatcagttatactttattgaagtataaaaaaaatccaggataaattaaacccaaagaggcttttgtaaatgaaaccaaacaaaaaagatggaaaacaaccactaatgaaccatggggaaaaaagacaatagttgggtttgaaagaaatcttaactgtttttttcccctactcttctaagattgaagaattagggtctgaaggaaaagtagaagaagcccaggggatgatgaaattagttgagcaattaaaagaagagagagaactgctaaggtccacaacgtcggtgagtaaaccttatttcacattatctcatctgtctgttaacagttagtaggaactcatttttatttgagaacctttgaaaactgatgttccaaacttagagtcagcacaatttgtagcccacaaggtctgtggcatctactaagctctgcctttgtgcagtatgcaagcaactttatatagtacaagaaacaaatgggtgtggttgtatcccaataaaatgttagcaaaaggcctctctggcttgccaatcactgccttaaaccataaattttcatatgagcctggttttattttcatttttgttgtaataaattactcagtacatacttacatctttgttaaaaattaatacacccttaaatatctaattcttttaattggagaatagaatatacttgtttcagatactattgattgcagaatgtaattggtcattggttcctccatattgaataggatatgttcagattatagtcaatgtgcttagttccttaattagttttgtatatggacattattccttgaacctaagcaaggaatgtattcatactaaaataggtggctttctgaaaggtgatttaaattttgtaaggtaatgtgggtgttgaacattgaacagtgggtctcaacatttcttctggatgattcagtaagttagttgctgttaccttaaacatccctctctaaaagttgaccacttgtagtccaatattactgatttggggaaatggaaaagagcaattcacacacattagaaatcttttctaaatgttgagtactttcctgggatttgtttctcttcctcagatgttcttaaaataactgatttatcattttagacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagtaagtttttttgtttgttttgaggcagattcttgctctgtcacctagagtgcagtgacgcgatctcagctcactgccacctccacctcccaggtttaagcaattctcatgcctcagcctcctgagtagctgggagtacaggcatgtgccaccaggcctggctaatttttgtttgtttgtttgtttgtttatttttgagacagtctcgctttgttacccaggctgaagtacagtggcgtgatctcggctcaccgcaacctccacctctggggttcaagcaattctcatgcctcagcttcctgagtagctgggattacaggcacacactaccacgcccggctgatttttgtattttttttaatagagacggggttttttcctgttggccaggctggtcttgaactcctgcctcaggtgatccgtcctcctcagcctcccaaagtgctgagccactgcgctcggccagcgtaaatttcttctaaagatacattttagctattaaaaaaatctattttagctatagctacagcttttagctatcagtagctatagataaaaataactatattctaatatggcttaaatggagatatgaccctctcattgatattttcctatgtgtaattatttttgaagcattgtgagttctgtgaaattttgctatttattgaactatgaaagcacttgattttcttaactcttgagtgccagaaatttgggaagaatattcctgaggattagacaaataatgataccttgtgtatatacatggtgttggaatgtctacatttcccttaagggcatcaattccataagttggtctacagataacttcacattagttgaccattgtttaacaatgctttaaagttacatttgcataagaatccaacttgatttttctaggaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcaggtatatataaaacaccctaagactgtccagctcataatgggtgtgcaataacaataataactactagtattattccttggaatggtacttgggaagctcttaagcatctttaagtgataggatgggttgcgagagcggaatcagtgaataaaatagttccatcttcggggcaacttctgtgccatttcccacctgtctaggaaatttcacccaacctttttacaaagttagagtacctgatggtctcttaagtgcttgtctcactgattccgagaaataaaatatgaaatcagccatactgttttaattataattacaaattgaagaagagtcttaaagagcacaacgataaccatcttagcactattggagatgaatttagaaagattttcaataatttttagttcttaagatttctaatgtaaatatgttttagagggtaagttttgcctagtcttgttaattaatagcatctactccaaggcctttacttattgtaatactggctgaagttgccttttggttttaaattattaagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaaggttagtttatatgagaattcagttcattaagaaacttttcacaccctaatcgccccactcacttttctccagacacaggcaaagatccatttcatacatactccttttcactttgaggaatgccattcagtaggagacaggcattctttccccctctcctacttagatttgtgaaaatgacagtttatctggtgttttcttagatgttaaaaacatctttcagttgataaacctgaaggtttttaatgtagcttcttttaagtgttatattacctttcggggttattaggtgtaggatttattatattaccttggttattggctccttttttttttacacactgcagtgtttcataatacgtcttataaagtgagtgtacattgttgcattaatcttcatttgtagcattcatttaagttagtaattaacatctaagtacctagaagttgaattgcttacatgtgtcttacccacgttttcaatgggatcaacatgctctttcccctttactttttcttttttctttttctttttttttttttttggtgtggcatcccagtagctgatttactgtgctgttggcactattaatggactttttaatttgtgtggcatgttttcacaagaatattctcatctaacttagcctttattggaagataattctgttaaccaccagggtctcctttctgagtttcatgttcttctattttgtattttttatataaaagatataaaatatcttttattttgtattgaatgagctgttgtgctttgcatggttttaggaatgagagaaggggcctatttctgattttctcagctctccttgtttcatttcattctacctgtctccatgtttaatcaccagcataatatatgtgctactattaaggtttattatactagtcttttgtgtgttgtttgtttattatatcctttaatagaactgtcctggttttttgttttcgtttttcctctagactcagctagaactagcagcacaaaccatggacatattttttggtctctgcttttattttcttaaaataagcacacactctttttctgaaatatttaacatctattggcttttactgtaatgtgagaaagtgttgaaaacttttgtcttcctgccagatgtgctagtgtttgccattcaagttgagaacttgcttctgattcaaaaggcagttgctacaaagggttaactgatttaacattagatttaagaatgttttacctaatctttttgcaagactttctgtgtaatgtctttttgggttgagaggtcaactcttaagagccaggtatgactgtcaggtcaaattaataatatttgttttgagaaagtttttagttttacatttcctattgttagctttagttgctctattctgtgttatcatttgtgccacttaaaattgttgggttggttcttagggataaaagctagctagccttcataactacttgaagtcaaagttgagtagtaaatgacactggcctgactaaaaacaggcatatttgtgtaatttctggatagagcaaaaagatgtccagagttgcttacctttaatcctaaaattgtaatgatgatgacatgaaatttagtgaaacttttttttttttccagacagggtctcagtgtcacccaggctgagtgcagtggcacgatcacagctcactgcagcctctacctccccggcccaggtgatcctcccacctcagcctcctgggtggctgggactgtaggtgcatactaccatgcttggctaattttttttttttttttgggggggtagagatggggttttgccatgttgtccagtgtgatctcgatctcctgggttcaagcaatcctcctgcctcagtctcctaaagtgctggggttataggtgtaagccaccatgcctggcccctagtaaaacttttcgttaagcggaataagctgagttacgtttagattagcaacagacagggattttccatgtgagacttggtgcaaagagagaagttactaagaaaactgtatcaggcttgtctcccatgattgggtatgctatgatagagttaaacattggaatctcttttagaagtgatataatttattggcattttgaaaatgctatgtaaaaataaattaattaaaatcagtgtgcagatgagtgaatttaaaaaatgtaaaaaaaaaaatacagaaaagaaactaccatgtagccatctaggcactcttataaatgactgaagatctggactttgggaccaggtgtgagccacagtgggcatttattaatggcaaatgagaaaaagcaagtttattactccaggtgctatgatagaagcagtttatcttactccacaaatgaaaagtggtttctcacacaaagctgtcagcaaccagtgtaaggtgctctctttgtcaagagagtttccttttttcatccatagccctaaaatccaccacaaattgtggatgtccttaggactattaagatctaccatatttacatagggcagaagataagattattggactgactactagtcctctacgggacaacaagacgactcttcctcattgaagctacctgtgcaccggagaagcccataaggcacaaagggaggactttcccacaaggtcagttagagcccactgtcctggcacagttctcacaagtggacagacagacatgaagcaagtcttgcgcttaactacttggacattgctttgtgtattatgcaagtgttacggactaaatatgctcttttacataagatcttcagttctctgagtgggtgcccctcccataccatgttttgtttttcattaccatctctttcctagatatttggtgttacgtcttcataactgtgcagaaactatgtagagggttctgtttctcttaaaatgtctttttgtctaattaactactctgccagaccagctattcttagtaaggggaaaagtaatttttccagaaagtttctagttggctttaacattttctgtagaaattttttgttgggggaatacttggaactgaaaaggctagactatgcttgctctggtgtactacttttacctctagtctgaggtcttacccatccaaagaatagtagaggaaaaagttgtttacctttttcattcttcatttgcagctgagttgaattttaatttctctttttggaaaaacaactctcagatggcatatatattacttttcttagcaaagcacaaaagttcagttgcttagattgggatttaagatccattttctttgattaggcttatccttcttggatattcaaatatatataaaaataatgttttgcattgaaaaatatgtagttgtagtttttaaaacatgcctgttataaacattcaactttttttcaccttttggggtctccatttttacccttctaacttaataattgaacctcatgtgaacatagttttgtatgctgtcttttatacctttcccagtgctttttgatgttttttacccacaatgaaatttacttaaatattatattctgcaatgtgcttaatagcttctcaccaattgagagaatttacccactattttaccttttgcttccttgaattccccttcctgccttctctctcatatattacaaattttatccctttggtaaattcaccaaaccgttgcttgcagtctgtgggaaatgattgtctctcatctctcagttgtttcactttttttcaaaatcatgtctttattgtattttactttaaaatccatggtcaatgtcttcttttatggcagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaaaactttattttggaaatttaaagacatacacaaaagaggaacaatataattaacctctgttaactcatcaccaacaagactcatgaccacttttatacttcatgagtgattgtatttgtatccactgttttctattattttcgagcaagtctcagacacaccatttaatctgtaaataattcagcatgtatctctaaaagacaaagacctcttaaataacagttcattagtataaaacaaattgggtaaacttttgttggtcatcaaactatattagcactggtccaatagtttaattttcattgagcctttcaagaggaccgaccagtctgctgctcaagacatcctctcctctgga

SEQ ID NO: 6423 - DNA, 1466 bp, Homo sapiens
attctgtgggatgggacttcatgcaggattggttttcaagtttgatttcctgagggattttttagttgtttgtgaaagaaccccaggtctacttttgaaattttgtattataattgtaatgttgcccatggttaaaaaaaaaaagtgttcagtgatctatgtctcctactactcctatttctctgtttttcctctgcaggagcttgctgctgttaacagttattcttccaagttgttttctttgtggggagatgggaggtgggaggaaatataaacatatatgtatagatctttcaaaatatatgacggtatacccgtatgttctgagtcttgctgtttttacctggtaatatttagaaacatttattttgagataaaggagagcacttttaagttgaacctgtagttttaaaaagtacatttcaagtaagccaaagcagagaagtaaatgtatttttcattgttgtatcagaattttgaatttactattttaaaaattcaagagttttgtagctgatctatttcttcccctcagccatcccaaataggtcatttgtcaacagatttaagaatgtttagaaacaacaactttgggaaacgggaaacaatttggtataagtgggtgtgccataacctctctcgtagccattcattcccggatacataccctagagaaactcttacacatgcgtaccaggggatggatttaagcatttgtgtgtaataggaagaaaagaagaaaaaacccgggaagatcccaagtgtccaccaacagtgtgttggataaatactgtggtatattccaacagtggaattccacagaagtgaaactgaactgcagctgtgtatgtgaacatggacaaaactcaacaatagaaggatcaaaaaaagcaagtcacagaagaatacatcactatggttccatttcaatgaaagtcaaaaacaggctgtcaaatacatgataaaaggaaacgattaagacaaaatttaatgttagccgttttgatggagggagaggtgatcatgagggcacaggggtcttcagaagaactggtgagggtctgtttctgaagcctgtgggcatttccttttttaatctgtatgtttatgtgcttttgtatgtatgatatttcttaataaaatttaaaaagaagaatgggaaaaaagtcttggtgtaggtagttactaatatataagctgtagtgtatttcgtaaaattaaccatcagtcagtgacaaatttaaagatgctgtttcttgagtgcccaatttaaggttttattttgtttgagacagggtctctgtcttgtcacccaggctggagtgcagtggcacgagctcagctcactgcatctttcgcctcctgggttcaagccattctcgtgcctcagcctcccaagtagctgggattacagcttcgcaccaccacacctggctcatttttttgtatttttagtagagtgtttc

SEQ ID NO: 6424 - DNA, 17646 bp, Homo sapiens; identical to SEQ ID NO: 6422

SEQ ID NO: 6425 - DNA, 1466 bp, Homo sapiens; identical to SEQ ID NO: 6423

SEQ ID NO: 6426 - DNA, 1938 bp, Homo sapiens
gcggccgcacaatccaacatggcagcgggggcgggcgagaccacaggacggagggcgcgggggagcgcgccggaaacgcgcggctgcggcccgggagaaacccccccactcggcggcgggcctcgcggcgcgggcccgaagccacgcccccttccggccgaggcgcggaccgcgcggagctaagtggaatcccggttggcttggggcgcaggcttccaacttcgtactctggcctctggcgtctcggctcgtcggttgggtacccgaacccagctactgctgcttgaagagaagatggatggggactcctcgccgtcgctgcgccgccggccttccctgggcggacgtacacctttgcgaagcgtcagtgaggacccagggcccctccttggaatagctcttatttctcaagcgctgcagcgtgaagctcgctctgcgggtccgagaggcctgcgatctgaagactgaaaactgggaagagacgctctaccctgtgctcctcgccggcttcgataggagccgcaggtgcctgggattttctcaaactttgtcccaaacttcagctgtgggagtggaggaacaaacaggcctctcccagaattgtgaaagagatcgccctggtggatgaaacaaaaacaaatgcacttgacttccaccgcctgcctggcgtgtcacgcgggtttaatgtatgtgtcacatttaaattcaaagtattttcttctaagggcctggacacatttcttttctccctgtatcgtgaattggaaaataccttaggatattaaaagttatctaagataaccccctttcttctgtaagttaaatactaaacggcttaagacgaaattttggaatatagagatgatgatgcagactgcagtgaattatcaaatatgcatctcactgttctccacattaaacatatttttgttgcgtaaattcatgttaagacgtctataacaattacactttggtaaaattgttggatgttaacatctctgatagctcccaatagaaatctctgatgtactaaccagactggtaaaccattatcatgcactttgaaaatataataaaatattataattaaagctgccattaatgaaataggctgagcaacaataaatttacaaaggaaaataaaagtggatagccttgggagttctcacataaaatatggagatttcaaagttaaacttgattaattatgttagggtaaaaagtgaattaaagcaacaggactatttataaaataattagatttagaaagcagtcgtagaaatataagcctggagttgcctctgaattacatatttaacaaacctagaagctaaatcagtttgtcttttatcaaaactgcaactcctctaagttgaaagcacagtgacaagagaaagcattacaaattcttgagaaataatagaaattaaagctcttttcaaacctgtgaacaagtatagtaccagaagtataagattcagataggcccaagttgtagttcttgttatgagtcttacaaccctatggactttggacaaattacttctctgcgtctgtttcctcatctgtaaaatgaaaataatttctgtttcatacaggtatagtctaaatagggataattacacctacttcaaagttgtaaaatacacaattacaactagataggaggtataagttctagtgttctgtagcactgtaggatgactatagttaacaatattgtatagtttcaaatagctagaagaaggatattgcatgttcccaaaacaaagacataagtttttgagatgatagatatgctaattaccctaatcactatatgttatatgtattgcaacatcactatgtacccccataaatatgtacagttattgtgtattaaaatttttttaaactaaaattataagacattaaaaaaaggtatcacatgtaaagtac

SEQ ID NO: 6427 - DNA, 2368 bp, Homo sapiens
cacacatttcttgccgaggaaagtgaagagggactcgttctcctgcggggtgagcaacagggaccccacgttggtgaccctccgcggcggcggcggctgctgctggacggagctcatggtttcgccggcggggttgggagtccagggccgtctcctccggcgagtgggcgagagctcgttccccctctcggtgacaggggcggggagaagtggagtcagaggcgccacatctcgcagctcctccggagcggggaggaggacgaggtcgagggaagcaggcgctgacggcgagccaccttcgcgccgcgctgagaaagggaagctcccggcacccgcccggccaggctagggccggatggtcgttgtcctcgcactccggcgactgcgctaaactcccaactcctcccccaaccctcccgcagcggcggcggcggccgcacaatccaacatggcagcgggggcgggcgagaccacaggacggagggcgcgggggagcgcgccggaaacgcgcggctgcggcccgggagaaacccccccactcggcggcgggcctcgcggcgcgggcccgaagccacgcccccttccggccgaggcgcggaccgcgcggagctaagtggaatcccggttggcttggggcgcaggcttccaacttcgtactctggcctctggcgtctcggctcgtcggttgggtacccgaacccagctactgctgcttgaagagaagatggatggggactcctcgccgtcgctgcgccgccggccttccctgggcggacgtacacctttgcgaagcgtcagtgaggacccagggcccctccttggaatagctcttatttctcaagcgctgcagcgtgaagctcgctctgcgggtccgagaggcctgcgatctgaagactgaaaactgggaagagacgctctaccctgtgctcctcgccggcttcgataggagccgcaggtgcctgggattttctcaaactttgtcccaaacttcagctgtgggagtggaggaacaaacaggcctctcccagaattgtgaaagagatcgccctggtggatgaaacaaaaacaaatgcacttgacttccaccgcctgcctggcgtgtcacgcgggtttaatgtatgtgtcacatttaaattcaaagtattttcttctaagggcctggacacatttcttttctccctgtatcgtgaattggaaaataccttaggatattaaaagttatctaagataaccccctttcttctgtaagttaaatactaaacggcttaagacgaaattttggaatatagagatgatgatgcagactgcagtgaattatcaaatatgcatctcactgttctccacattaaacatatttttgttgcgtaaattcatgttaagacgtctataacaattacactttggtaaaattgttggatgttaacatctctgatagctcccaatagaaatctctgatgtactaaccagactggtaaaccattatcatgcactttgaaaatataataaaatattataattaaagctgccattaatgaaataggctgagcaacaataaatttacaaaggaaaataaaagtggatagccttgggagttctcacataaaatatggagatttcaaagttaaacttgattaattatgttagggtaaaaagtgaattaaagcaacaggactatttataaaataattagatttagaaagcagtcgtagaaatataagcctggagttgcctctgaattacatatttaacaaacctagaagctaaatcagtttgtcttttatcaaaactgcaactcctctaagttgaaagcacagtgacaagagaaagcattacaaattcttgagaaataatagaaattaaagctcttttcaaacctgtgaacaagtatagtaccagaagtataagattcagataggcccaagttgtagttcttgttatgagtcttacaaccctatggactttggacaaattacttctctgcgtctgtttcctcatctgtaaaatgaaaataatttctgtttcatacaggtatagtctaaatagggataattacacctacttcaaagttgtaaaatacacaattacaactagataggaggtataagttctagtgttctgtagcactgtaggatgactatagttaacaatattgtatagtttcaaatagctagaagaaggatattgcatgttcccaaaacaaagacataagtttttgagatgatagatatgctaattaccctaatcactatatgttatatgtattgcaacatcactatgtacccccataaatatgtacagttattgtgtattaaaatttttttaaactaaaattataagacattaaaaaaaggtatcacatgtaaagtac

SEQ ID NO: 6428 - DNA, 430 bp, Homo sapiens
cacacatttcttgccgaggaaagtgaagagggactcgttctcctgcggggtgagcaacagggaccccacgttggtgaccctccgcggcggcggcggctgctgctggacggagctcatggtttcgccggcggggttgggagtccagggccgtctcctccggcgagtgggcgagagctcgttccccctctcggtgacaggggcggggagaagtggagtcagaggcgccacatctcgcagctcctccggagcggggaggaggacgaggtcgagggaagcaggcgctgacggcgagccaccttcgcgccgcgctgagaaagggaagctcccggcacccgcccggccaggctagggccggatggtcgttgtcctcgcactccggcgactgcgctaaactcccaactcctcccccaaccctcccgcagcggcggcg

SEQ ID NO: 6429 - DNA, 8473 bp, Homo sapiens
gctctacctcccgcggccgggactaccctcagagccgcgaccgccgcggcgtgcgtcccgggcctgcaaaactgtttccaaactgcccgggccggaggcgggcgcgcggggcccggggagatggctggggtctggggggccgagggtgtgtgtggacgctgggagccgcggggggaggccggcgtcgactcagaggagttgcaatcgaggtatctgcgctccggcttcctcctgcggcccgcgaccccctccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagtgggtttttcctttgttgcaaatggggaatgtttttcctttgactctaccatccagttcaggacgtctcagtgtgtttaacatttgtcaacaggcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggcggctggtgcgtcttgtgccttttgtttgatttgactgtattttcgccttttgtctcttaatgacgatcacaccattgctatatccagagcagtaaacagtcctcagcgaagccgcctttttgcctacccaaccctggaaagtttgcagaagtggaaggagcagaacgtgagggtgtaacttacaaaaaggtaataagaacaaagacaccaccataacccccaaatttcccaactaaatcaaaaaatatatatgtttttacaataacgtctccaaaaccaccgcccagcttgatcttctagactccatggcaccgggctgagcgggtaagtaagaaagataaaaagtgccttttgccccttcgaggaaacccttttgcaggccaagcaagggctgcaagtgtttgggagctgagaggagaaggaggattctggagcattgtatttggcagccggagcgggcagtgggcggggggttgggacacgaagggctcttcggacccctgtgcctcttctgccccaagggcgagaagacgggcttcgcagcgaccctcgggggtccatggagccgcctgccttcgccccctcgctcttcccaggtctgaacctggatggggagaagaaattgaagtgctttggagacgggggggcttaaaacactagggagcctcatcgcccagccttgggcccactttcctttcgatcgtgaggattccgcaccccgaagccggcttctcggggctccggggcgcgcctgcgctggcaacgcgaaggaggacaaaaggccggcgtccatgttggcaccatgacgcagcatctccgcccgcagcccggagctgctgtcctcccggccgcgctcgctcctcctcccaaacaccagttttctttacaggcttcgagcccgtcgcggctgggccgggctggtctggcaggcgggcccagccgggcagggctgctttgctaatggcggcggctctctttccttccttcctcctttcctccgtccccccggtcgtggggagcccggagcaggaggcgggcccgcggccaggtcgggccccgagagcccgcggggcgcagcgctggcgaccgggtgtcgggggccgtttcgggggccgtgggcctcgggggcgtcgcgcgccgcgcctcccgcgctcgcctcagccgggcgcggcggcctgatgggcgccatttcgcgcgctgcccgtggctggggcggtggcggccgccgcgcgccgggcgggaggagcggcaggggtagggggctgggcgacccggcggcccacgcgggcaccaggaggcctcgccccggaccgcttccctctttcgtctttgtcctgcgcgggcgcccgcagccgagggccacggggtcggcggggcttcgaggccgccccgggtcccaccggctcctccggaagccgcggaccggcctggccctgaccccaggccgccccccgctgcccacccagctctgggcgcccaggtccgacctcccagtcgccctctgagagccgagtcagcgcggggcggggggtcgccccctttgtcctcactcagggcgggaggccctcggggtggccgcagacgccccgttgggcagccctccagcccagctctccaggcaggaggtgggggaagcctgggaaagcggagggggggccccgggatcccccgaggcgcggggctcccggcgaagcctcagatctccggcccttcccggggagggtgcgggcggggcgggcctttggaaatgcagatgagccgccgcccgggccggggttgaaccttctgactcagccacccccggccgcccgggccgctgggggaggggcggcgtctggggtgctccctttcagccccggagcccgtctgctgtgtattcggccggtcacatctctctcccccaacgccctgatccgccctccaccttcctctcctccaggttctgggccggagaaggggcgacgttcgggcaccccccgaatggacaatctttccttctgtcaacggcaggggcaggcctagtttgactctgacagtcctcccactaaggtaggtgtgagtacttgcccagaccgtgagggagatttggggggctctggcctgcagcccagggagggccgaaccccaaacacgccgggctggttctgcgggcccggcccaccccacccccccccccccagctgcgagcgcgtagggccgcctgctgggccgccggggccatccatccccgtctgtcagcttctgttgtcaggcatttggggcgtgtaagtctctgccgaatatagcagcatacgagaggatccacttgcaagtatttcccagttgtgtgttcttcggcggggggagggccctgggtgccgcctacttctgaaagacacaggtcactgtcagaaagcccaactgtgctgtggccttccctccagccgcccccgtggggcatgtggggtgacagtgtgagccgtcctctgatgtctggctgctagagaggcaaagaacagagacccgaggttccggccacctttctctatgaaagggccttccttgacgcttctccaccttcctgggattgttttcttctccagtccccgaatgggcaggcctgtatataagccttgtttctagaaccagacaaagctggatttgaaacctggcgagccattgaacagctatggccttgcgtaagcggtatagcctccaagcctatttctccatctccgaaaacagggctagatcagtggttcttagtctggaaccggcatcagaatcacaccggaaggggggctcactgaaaatggaccaccgggcctggtgcccaagtgtctgattcagtgggttggtccttaggactggcatttctaacaagttcccaggtgaggtgaggctgatgctgtggtctgggaacacattttgagactccagcccctagcctggtaacacctggggttttgacgcagaagtgccacgttccacgcttggcacatagtaattgatttcattctaacgctagccgacttcatgtattgaatagtttcccatctcagtgtctaagaagctccacagctggagatggcggcccttggtctcggagcccccctccttgtgatttctgctttgtgattgctttgatgaaccatttgggtccaggtgctcctgatcacaccacctcccctatttgggacttgtgccccactcccgctgtgagggctacaccgagctttgggggcctgttcggattaacaaggagatcttgctaaaggtatcttggtgctaagttaagggagatagttcgccatgggctaggatctctcagtgctggtgaccttgggtgagtgtctccctgtaaagtgataaggatgcctgctggaaagggtggtgggaggattaagtgcgttaaagaggccctcctcccaagcttttagttggcctccattgtgatcgtggttattgctgggagtggctgcagggggtgggggctgggctgcctcagagcttccccccgcaccagcccacctgctgaagcacgtgtccctgcctcagggcaaaggggaatctggcgctccctgggaaggcggccaacgcggttctcctctggagtggttgagtccagctgcaggcctttccccatccacaggggctgttccatgatggggtcaagatttgggtcacccacccatggtccggggagaagtgactccccaaggtcacaaggccaccaccaatagagccaggatggggttccaggtggcttgacttggcagccagcgcctgtgcccatggcaccccctcaccccagctgtctgggttattttgggcttcctcccgtgccagctgtctgctggcatccctgcccgggactgtctggttggaagtaactggcgtggtgctgttggctcctcctgtgagggccagggctgggtcttcaatccccgatgagccgtgctgggtccagctcctttgctgggagggaagagtgttcctgcccagactccccgctgcccaagtacagcaagagggcgaaagcacctgataaaaattgaggttcacattgttaatatcccaaaagcctcctccttctatactccctgaaacctgttttaaatttggctctgccattgaaccccgttgctctcacgttaccctctgccgcccgagggtgtggcgcctccctttagagtcttcgttgctctccgggtggggtctttactccccacctgctttggataattaagtaattgatgtacgtctccctcccagctgcaccctggagggctccagccagtttctcccctccctggatccaatcagtgagctgttgggtgctcagctgtggtctggatgtggttctcggcacggtgtcgggacccacctggctggactgtacccctctctctctgctttggtccctcttctttctttgtccccccaccatcacctcttggggcagggagggtgaggcagtttgtcctcctgctgctgttcctgctggtccctcgagggcgccccgcccaccggtcacccagcgaacgcggggcggggccgctgctggcgctgggccccagggcttgcagagagagggccacgccagcggaagggccggccaggaggtggcaggacttgccttactactgagtcgccggcatccccgcctcttccggcctctccgcccggagccctagcgtggaacatgacctttcggaccctctgggtggagacacagcctctgcctgggctgtgcagtgaggtggcaccaccatctcaggtcgtctggcccagtgcatctgtagctggcatgtgacttccagcaagctcctgcccctgagcgctgggaggagcaggtccagcaataatttttttttttttttttttgagacagagtttcgctcttgttgcccaggcaatggtgtgatctgggctcaccgcaacctccgcctccagggttcaagcgattctcctgcctcagcctccgagtagctgggattacaggcatgtgccaccacgcccggataattttgtatttttagtagagacagggtttctccatgttggtcaggctggtctcaaactgacctcaggtgatccgcccacctcggcctcccaaagtgctgggattacaggcatgagccaccgcgcctggccggacaataatgttttgagctgttgctgagtctggcttttgtgacgggaacttttagcactcaaggagtggccttgtctctggcctgtccccgagtgctcatgggcagccaaggcctggggactgctcaggcagggtagatgtatttgccaggccagctcccgtccctgggacctcagggagtagcttcatccctgaaggctgagtgtcttctgcctcatgtgggtggcccctctgcagggttctcaggcatccagggaagtgggtgccacagcgttgcctccagcctcactggggctggctggactttgctctgacaacacagcagtggctgggcccctgcaactctccagggctcagtttccctgttggccgcactatggcataggcccctgtgtggacaccgatgagctgaccccacaaatgccacccggccgctcccccaggcttcagtggcctaacagctgttgtgtcaggaaccagcttaaagaatctttcttgctttctcaaactctccaggaattcctggtgactggaagggggagtgactcaggccctcaacctctagcaggtaagggagctacctcctgggtgggcatgcccagttcctcagtgggcccagcgcggcccagcctccgaggaagctctgagcagctggcttggctccgaggtatttttagctacagatccagcccccctccatcaccacaacagtcgagtccaaatcaaacgcgctccaggcaggtggggctggggttctgccagcctcctggccagcaggggtgggtgggcagactggggccagtatcagctgttctgcctggacccaggccgggctgggaaggcacacttgtgcttatttcccgcctccacttctgtgcaagcttgtgctgtcataagcagagatcacagccccatttcttggatggagaaagtggacactgaggtctgaggcttttgaggacagtcaggagccctcctatgggctccagtgatgcactcaccagcttctggtcctcttcttccacctcttagagtgccttggctccctcctgtcgtcctggggaacctcggccccagccctgcctccccagccagtcacagctcctccctggtcaccctgagggagctcagggcccggctggtagctgggttgctctgcttctgtcccccactcctgtggagcctggcaggcaactccatgatctgaccccggttaccttgacagccctgcctggcctcccctctcatggcccagccaccccagaacctgaagaggttttctagctgccgtgcatttgccaggctgggttacccaccctactttccctgcctgccctccagtgctgccaggcctagtgtgccagccagcgctcagccttcagtaaagggttcccctgcttccaacctccattgcactgcttcccctaagactgtgacctcctggaaggctggagcacaactgcctctcaataaacgtgttgcaaaaaaggaat

SEQ ID NO: 6430 - DNA, 438 bp, Homo sapiens
gatcccactctcggccatgctctcgtgcctgtctgccgtggaccggctccaggggggggtccctctgccaccctgtcgactcatctgggtggtgcagagggcagtcagcccgcccagggtgaggagtaagaggaggggtgggggttacgggtaattcagccagcagccctgatagcactgcctacagtaagtgctcaacaaataagctgttttgatcaggggatgggagagttggggggattcctgggatgaaggacatgtggctgctggcaaggaaacgcattttcttacatttcttggtgggtgtggggttatcagtctccaaagctccaggagagggaccaagttgacttcaactagagctactccaacctgcccctccctgacgacgtcttgcgtggttcacgcctctggctcctgccggaaggaggcggccgc

SEQ ID NO: 6431 - DNA, 6195 bp, Homo sapiens
gtgttttctgcatcccctttttattctgtaagttccacctgttatattggctttcctagccccattgcttccgcatcttagctagtcatgctaaatgcttgaagggggaaagggagatacaagatagacaaaaccagtcccagacagatggacagacacggtggtacctcatccatcttctctgaggtcggggttctgtctccaaccaggtccaaggccacctcagctgtctggctcagaagcccagcagggtccggggggcctggctcaggtggaggccgaggcccaaggcccaggtcgagctcctcgtcctcgtcggagtctgggaggggtgttgggctgatatcctccaggccggtgctggaggggcgtgacgaggggggcgtggggccccggaagcctggctgggagttggtgccaaagggggccagtggggagagctgggaggaggaggaggagatggggctgccctccatctgcagctcggtgtccgagtccggctccctcaggaagagcagcttggtgcgctgctccttcagcagcatctcgatgcgcgagtccaggctgtcgtggggtttctctggccctgcaggggacgactccagcgtgggcgtgccagggctgtcacagggctcaggactccagccgaaggtgggccggccgcccagctccatgctgttggtgtcggggggcggcgggccgggtggcgtgcctggcttctccttggccagaggctcagcaggtggcaggggtgggggcgccggtgccctccggaactccccactgtcgcgggccccaaaagcggctgtggcggtgggctcttccgggggtggagggaagtgggccactggggtctgatacggagagaaagcagacttgaatccaggagcaggggttgcttgggcgggtggtggagtgtgggcaaatgtggctgaatcctgtggttgagccttgaacgggggaccgctgctgcccccagtgccgccgactgctccgaacgggaggtccgaggaaccccggaaagcggctgtggccccggccaccgcagtgaccgcgggagaattgtgtacataatgatgttcgtggcggcggttgtaggcgtccgtgaacttgctctcgtggcgccgggccttgaaggtcactgcagggtcctggctgaagaggtatgagggtgtgggctggcggctggagtagctggagtcctgtgagaaaggggtgcccaggcgcggtgtgagcggggtgccctgtccataggagttgggtgtgtccaggcggcagctggaataagctgtgtcctgggagaagggtgtcccaccgctattgggggtgacagaggaggagccggagccacagcctgcagacaggcctccatccttgaggcgcttcagggcatctgacagctaaggagagacagagatgtcagaccactgggggaaaacatgcaatggaacagggctattttcccttctcactctggctgctgggaagctcagagccaaactgctctagaactgcagcataaggaatggaagtgggggagattgaggaggagtgtcaggatggtactaactttttctctaatcttaggggtagccaaatatgttcagggaaccttgagggtcattcctaattccagaggaggcagagaaaaaagaagactgtaacatcttggtttaggctgggattttctttctgcctcaggctgtcagaaatcaaagaccttccaggcaggattatgaccaagaactacaatcttgtgcacgagaggatggccaagggctttgtcctcctagtcacccagtgctttaggatttaaagtgataaacagaggccaggcgtggtggctcatgactgtaaccccagcactttgggaagccgaggcaggtggatcacttgaggtcaggagttcaagaccagcctggacaacatggtgaaaccccacctctactaaccaaaaatataaaaattagccaggtgtggtggcgtgtgcctgtaatcccagctactcaggaggctgaggcaagagaatcacttgagcccaggaggtggagcttgcagtgagctgagatcgcaccactgcactccagcctggggacagactgagactctgtctcaaaaaaataaataaaacaaaaaaaaagtgatgaacaggccagtggcagctagtcagcctgatgccagggaggagctggcatgagactcgccccacgcgagagttgtccctgtgtcctggaaggcagtggtttggaaggagtcagccttgctctggaaggcagggcatgaactctggtttctgggtttaggggtagtggcatgcccaggacaccagacactaaggaccccggaaacagcaatgtttggcatcaacgtggaaaagcgggccagggcaggctctgggtctgtgggaatcacagcctgtgctggggaggggagaagccacaggaaacagaaccaatcccatggagccctactgcaggagcacttgggaaaatggggctctaggccctgctcccaattgtggggggcgtggccaggcttcacaccctcctaggccttggtctccaaagctggagtgaggtgggggtaggctgggggtcccataagagagttggtgaggctttccagaggtggggggcacatcaaagagctggcgatggggcagactgacggccataaacccacctgcagggtctcattcacgattggagagacagcgtccagctcgcccactgggagggtctggggggtgtatcggccagtgaccaacagttcatagaaccgcattcgggtttcccctgtagatgggcaggaaagggggaactcagtgaggttccaggatggggcagcccccacaaggattccaacctgtgtggcaccctggtgggtcccttgtgcccgagaccccagtcctagggaggctgtgtggccctgagttcccacccctctgcacctcgctcagggtccccacctcttcaacaaagctgctgagctgcaccatttttctgatcctgagatccagaagctcatgtctcctggggctgagactcccccaaacccaaacccagaggtgccacccgcgacgcccagcccccccccacccctgcattacctgggccatggcacccacagagccaggtcttcccctttctgctcaatacccaggggcttgcagtaagaggaagggaagcccgtgacacagaagccagagtttgttaaatatctggggccaggtgagcagcagagtttgcaacacgctctagtagcacattactgtgaactccacaggccctgaccaggctgagggccccagggtggcctggggactaccttgggcttgaaccctccacccctcagcagaaggaggcttttatagaccagggcccaggggttatcgatatttatagagcctcagaggcagctgcttacatatgcaaaaaagacacgttcctggagctacactttactggtctctttcttgaaatacaaacttagttggcagtctctgagggcttttgtgttttttttcttttcttttcttttctttttttttttttttttacagaattgaaattttgttgagacctggctgctccttaaaatgtgggcacgtgataggaaaggggttaccatgttcaattcaattatcagggagaaatcgtgctgcagccacccaaggtcctcactgcccccccaacccccagagactgagaagctagggaaaggggtgggagggactgtggactggacagaaaaagagggctgtgccctgagaggaggaacagaaccgggcacaggctcggcaagtgtgcgtggaataactgccaccaccccccggcaccggcttagagctcggtcaatacattttaatcattaaacgcaaaaaaagaaaagttctgattttcctgccttgggtttggtgtgtcccagttgtccctgaacgccatgctcacaaaattcctggaagctgcacttttgccctcccaggcagggtttcccaggggaccccggtgggctagggaccgaatgacatctccccacaagctggctggccctcaaagcactcggcaccttcttttataggtgggagcttccctaaagaggcctcaggcacactttggggaatgccctcgagtcctccaagccccttggtcctgcaggggcctccgaagacccacagggtgggaggtatggcctccccagccagctccagagagcacctagctgattccagagcaggggaggtgctgcggtctctttaagagagaggagggaagacacagtgtcaacccttgagcacccagagccgcctgcctggctcttccctcttcccggctctgctcttccccggcggctctgtcgagaaccttatcaatgaaacaacactcctggccccagattggctgccacttccagaggggaaggggcagcaaggaggtggggggacaccctggatccttagaggactctcttttcagttttcagaccttctcttgatgtatttcaaggcatcctagtggcacttcctcagtcccccacaagtaaacaaactctgtctcctcccctaacacaggcaacactggggactgtctaaacccaagccaccagggctcagagagggggcccgcgggggtgtcagcggtggggaagcctccgggtggtccctaggggtgcggtggccaaggaccggcacatttggtaaattacagactgtctcctagcaacagacaacacatttagctccacgcgactctaccctcaggagggggctaagaaataaggttgtggggggggatcccaaggaagagtgagggggggtcctccccacgctgcaggaagggtggggagggaaagggtcgggctgacaggtctccccacgctcctcccctgccaggctcacctttggtgtccagctccacgtggataatgttgcccatgacggaagtgctgtgcaagtgctgaacggcatccttggctccccggaccgtggcaaagaccaccttggcgatgcccaggtgcttcttggtcttggggttgtacaaaatctccacctcctccacctccccatacttcttgcacatgtccctcaggaagttttcacggatgttatcattcagcttggcaaatgtcacctgcttcggaggcaccgggcccacgtagaactcatcgatctggcaggggccgagggggaagggagtttgaagaacgtttaaacctaagggaaaacacaacatcccccccgccccgcccgcaactcgcccacccgttgaaaacaataaagggtaaaaaaactaaaaattaaaaaaaaaaaaaaaattttttttggaaaaaaaaaatgcacgcgggcgggcccgggaagcggaggattaaatcgtttggaacgtggaagtcctctgggttcggaaggaaaggggaaaaagaaacagtttctctttccccacccccctttctggccttctcttcctgctgccgggtcaggggcgacccctcaggcttaagaagttgtcctgtagtgggctagcgagaggggagagtctcggagccgagccccccgcggggcgtgcaggacactgtatctgcgccgtgattacagtttcacccagtgttattttgttttcagtagctgagaggggacaccctctcgccagcgctctacccctccccgccaaaacttccctggccccggacggcgggaactgggaatccggctgggctcggtcaggactggcgttattttcgaactcggggaggtgggggagggacggcggggcagtggggaggggtcctaccttgaatttgggcaccgacagctccagctccttgtttttggtccagatcccgacgacccggggatcttcgacaatttccaccgggcggttgctggacatctgtggggagaaattggggggccgggatgagagaactggtccccctccccatgggcagacccctttctcgaggcacttgtcaaactccagggctggggccccgtctgacagttggccgggggatcgggcggggggtccctggccgctaggcgcgtctccccggacacgacgcggggcacggctgggggggcgcgccggctactcaccgccaggctgaaatgctgcccatcgtagcggtacagtttatgatgcccctttttcagagccgggtcaatcatcaacttgtaacttctccaatggtggttcctcc

SEQ ID NO: 6432 - DNA, 20501 bp, Homo sapiens
ctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacagtaggtatcttttactcaaaactgaaaattgatacctgtttttaaatatgagagtaggtttccatctagcatgttccttaattctccctgcacatgcagtgggaaatatgtatccatggttgcctttcacttggggcgttttaaacacgtttatgagatgagtaaaaattgcccggatttggtcatgttgttgcacataatatttggtaaaacttgtttagggctgtactacaaagctacaataaaaaggggatttggggactttaatgaatttggcagtgtacaaagccagatataaatgaagcttgaattattttcactattgtcctacatttacatggtttttggaatattacttattcaaataatattaatcttccagggccatctccttcccaaaccctaagtctggaaaccaatgtcttttggttagtataatggacacctgaatgaaaatctgttacccttttttttctgtttttatgctgttaatcctgccatgttcctgtgtcaaatggggtgatttgaatggatctggcaggagaactatgagtattggtttgagttatgtgctgttagcagtttgccatcttctagtcttttccattagaatgagagttcaaagagtggtttgccaagcttctagtcttttctattagaataaagaatggctctgtttaggaccactgaaatttgtttttcttgaaaatgtaaatgtgaataatttaatttctgaaaatcataagaaaatactgttaatggaatataaaggctgacgtgggaggatcacttgaggctaggagttggagaccagcctgggcaatatagtgggaccccgtctctacaaaaaataaaaaaattagctcagcatagtggcctgtgcttgtagtcccagccactcaagaggctgatgaagtgggaggattgcttgagctcttgagattgaggctgcagtgagctgtgattgagccattgcactccagcatgggtgacagtgagaccctgtctcagaaggaatataaataacttaaatggctcatagaagcgagacccatataatttgaggtaaagatctgtagtactgtatgaaaagaggtgccttgggaacacagaggagtaacaacagctagagagttgaagaggttcccagaggaagtgatatctaagctgcaatgttttataaacggtgtcttataatacgctttttactaacctgaaatgatgaatgtaatcatttcaaactagtactcaaactataatataaagacaggagattaaggtatcagttattaatcagaaattaatctatccgtgggtagattaacaaacagtatgatcattccagaggacatcatgaagtagttatatgcttgcacctatgcatagattgatcatgaataccaaagctacacatgccagattgatatggtatgttctgttggaaaataagataccataaatggcattgctgttggtgacatgaccctccaacatgctaaacaaacacttggtaaaattccaaacagtaagaagtacaattttcccttgctttatgtggtggttcaattcctagcaaatttagtatatatttaaaactacgtgggttgggcacagtggctcacgcctgtaattccagcactttgggaagccaaggtgggcggatcacttgaggttaggagctggagaccagcctgaccaatgatggtgaaacctcatctctactaaaaatacaaaaattagccaggcgtggtggcgggcgcctgcaatcccagctacttgagaggctgaggcggagaatcgcttgaacccacgaggtggaggttgcagtgagccgagatcatgccactgtactccagcctgagtgacagagctagactctgtctcaaaaatgaatgaatgaatgaatgaatggagtgactgaatccataggacgaatacttttgtatttgtatacacagacagataggtaaaataactttgttattctctagcctcagataattataaataattttcctactgccactataaaaatgactggcagaacactcaaagataatgcatagatgggataattttttggtctgcagaaatgtcacacccattaaagatgtctggcatcacaagtccctgcccactaaatgtcagtttggtccttccttcctccccatcatttagaaaactagcagtgaggtgataccaccctcactgaggaccagtggactagatgaaatcccgaaagagattctgacatgaaacaaaatgaaaatgtgggggtcatagaccatttttaatttttgtaaagtaatacaggaaaatcatatagttgagtgtttttgaatgtcatccttttttgtttttgtttgtttgttttaacagattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaaggtagtgacctttttggttgtattgctgcattcacattgttttatacacagaagttatgaaatcagtataataatgtcattttcaccagtaaaagagcatgtatttgcacaacagcaaaaaaaaaaaatatatatatatatatattttttttttttaagtgaaagagggtgccatgttgcccaggctgctcttgaacttctgagctcaagcaatctgcctgtctcggcctcccaaagtactgggattacaggcatgagccactgctcccagccaacagataatgtatttttataagatgtgtatgtcaagactcaaactgaaattattaaatgtttattagtcagcatcagttgggatcaaaatttccataatggtaaagtgaatttttatctagaatgagtctggtaacgttttttctagaatttaactggagcatttacttggaagcaacagtgttctattgattttaaactttattatgtttatattttgttcttttttccaaagcatttttcttctttacctattttttgactttttaatggatattaatatatgtaaacccttaaactgcagtactggggaacattgtaatttattcttataggatgaattaatgtgatttctttttgtgataacattaatgttcccaaatagcccacatacttttctgtaatacctgaaatacgaatgagaaataagatataaaactcatgattcttttatgtattttatcaacttttacagagaggtgaagattccagtttaaggaagaaagattttcaaatactttagattaatttgtgaaaaaaactcattttaattttaaagtagtaattctgtttaaattatacttaattagtactttatttttatggtggttaaaagttcacctctgttgtaattctctatgccaaagaattgtacactgctattgccttcttcggttaactctaaaagaagttcagtctgttaactaaatccaacagtgattcaggggtagaacttgctagaaatttagatgagactagggagcaaaggtttacagtttaggaattagatatgatttcattctgtgagcatatccagaagaataatagaagcaaataaatttctgtaattgacatgttggccagctggacataaatttactcattgtatttatgtgtaggtcatgtgaaatattagtgtatcatattgaattgatttcatccatgtcaggccaagtaaagaagcctttcccaaaatcatttcttggaaacgatttaaaattacaaagatgggcatggtagttcatgcctgtaattctaacactttgggaggccaaagtggaggattgcttgagaccaggagttaagaccagcctgggaaacatagtgagacccccatctctacaaaaatatatacatatatattagtccagtgtggtagtgtgcattgtagtctagctgctgcggaggctggaacaggaagattgcttgagcccaggagttcaaggatacattaggctatgatcatggtcactgcactccagcctgagggacagagtgagaccttgtctcaaaagaaaaattacagattttctctttgtaattaatatggtactgatttttaacatttattcctttttaatgcacacacaacaatttatctttggtaactacagagtgtaaggtattaggtgaagactttgggagagatttaataggtctttcctttcctcatgtttccaccaagtgatttttttctttggtttattctttgatctaacaagtttggttttactaaacaatttttgttgccttcgttatgttatttcagcactcagcattagtcataggttttttttctgtgtgttcattgaatacatgaatgatccacccttttactttagagaaagaatataatgtataaatgcaacttagcaagtttctttattttctttagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctaggtaagtttaacatttgtgttatttaagttacagaagttaagtaattcaagttgcttatgtttttggaaagcaatgtaacagaaagttgtaagggtgctttctcttatccagtttaggttccaagttttgaacattgatgtcatttaaaaattaagtatacattaagaagtttaccctgagtgcaccttgtaagaaacttttttttttttaatttttgagtgtctttccagtgtttatgcaaatacaaatacatatttttacttttctccccatatacaaaaggtaatctaccattatatggcatactatatatactctaaagtatccatatagaaatctttacatgttgttgaccttattttatacaggtgtaggataaattcccaaaagttggattgcaaatgcatttttgagatattgttaattatgcaaaagagcggtactgtttttcactctcaccagcggtaaatgaaagtgcctgtttcaccagtagagtgctaacttttgcatttttgctaatcagatggagaagtggtatcttaatgtaattttaatttacatttctcctaccaacactggggttaagagccttgcatattttattttctgtgagttattgttcatgttctacttttctgttggattgttatacagttgaatttatcagtcttttcttttatggcttctggatattgattcatagtaagtaagtcttctacattccaaatatataaaggaataaacccttattttcttctgatatgttaatggtggtatttttatacttaaatctttgatttacttatagtttatcttagggtattttgtgagttacagatcatgctttcatttttcaggttttttgtttttttttccagaaggccctaatgtctaataatccatctttatttcactgatttgagatggcttttttacatatgctggcttttcattctgttgatgtaccagcattatactttcagctttatagaggcataaaaagtatgttttaatctctagaagggctagtttcactcctttgcttgattttctgtatgaacttggcaaacattttctctattacaaaaatgtttttggaatctcagtaagtttacatattaacttagggacaaatgatatctttatagtaagtcttgctgttgaagaacttagcttgtctgtttgtttaaggctacttttgtgcctttcacacatttaaaaaggcctctccaaatatgtccatacatggctttttaaattgattcctaaatattttaaatttactgttctgttgtttatcagtcttgtctcccattatgcttcctaaccattgttgcttgtgcaccccaagttctttgtcagggaatccagtgccctttgatagtggactttgtctcactcttcagtaatatctcctgcctctcccttgcatagacgcttcactccgaccaaacatcttgtgatttcatagatgttttcatttctcatttctgtgtgcctttaacctttagttgcctctgcctaagatttttcttctcattttttctggctttttctggtccttttgctctgaaagccctgcctcataccttcttaacttttttctcttaccactgtaataaaagatatttttttgtttgtatttccaaggttagcctttgtttggggttagcctttgtttggattttttccctgttactgttagcgcttctcttgctgtcttttgtatgtaggcctgcattgtccattacagtagcctctagccacgtaaggcacttggcttatgagtgccacatgttgaattgatgatatttggatatattggcttaaatgaaatgtacaattaaaattaatttcacttgtttatttttacctttttaatgtggctaatagaacatatatgaaattatatattactcgtattttatttctattggacagtgctgcactagactaattcactgtttgagggactatctgtctccagcacaaagcttggtatgtcataaatgtttcttgtgactgaatgaaaaagaatttgaagttaaagctgagatacttttggaaacattttgtaattttggctaatttgttttgaatcaggtttaagtgaagatattttggtaatctttgctttcttataataactaactatgctttttttgagatgtcattttaaccttaattctttgaaaggtattactttactcttgcatagattttttttgttagtttgttttgatcttatccctatgtgtttctactttttggtcctaattttataaaaatatccaggttgtagatatatctgttaatacgtaaaatgttgctttttatcagcagatttgactttatttttcatttttctgcagttttgggaatatgatttataaggagaagcgagaatctgttagtaaagaagatctggcaagagctactttagttactatcaccaataacattggttctgtggcacgaatgtgtgctgttaatgaggtaaaaaaacaaaaaacacaaaacttgaattatcaaaaatgtgaattggagtcctatatacacctagcagggcttcttcactttccctaaggaggcctctgggattgagatgtaacccattaaatgccaagactcattaggtatatatgttacgtatccagttgctatattacttttaaagaaagtagcagataattcaaattgaaataggagaaatttattcagaattttttttcagaaaaacacaacctaaatcccttgaggatgtaaaagaaagttctaagcataagacattttgagatactttgtgaaagcattttttttagtcttaattttgcatttggaaggcagctatgctcaccactataccaccagtgcttaatgttgcatttgattagtgaaattcttggaagttttcttactgccctcggcttctttacagtgctgccttgttgcatatggatcaagcagcattgtacagggctatgaaggcattgagacctgttcttcatgatatttgagtggtgtttattgttacaagaaaagtgtgaaaaggatatactgttagattgaccatatagttgggattctttgtttggaagagaatatatatatttaattctagcttccttatataataatagatatatttgcccgtttaatttttataaatatcaaatactttaaatggattgggaagtacgcttttcgaaggaacccttcatttgttcattcattcatttattcattgagtaaatatttactgattaccagatgccagacatcgttctgggtatttggaacatattaatgaagaaaacaaagatctggctttgtggagcttgcattcattctagtgacatattaagtaaattgtgtagtgtgtattaggtgataagtgctatttttttaaaaagagaccatcaaacaggataaagaggattgggaatagggcagagagtggtagaggacaaattgctaagtaattgagtggttaaaggaaagctttattgaaaatgtgattcttaggcagaggtttgaaggaggtgagggggaaactgtgcatgtagacattttggggagaaagcttccagcagagagaacaaatatgcaaatcctctgaattattctgtatttaaatccagaacttggtctcatcagttttttaataacttagaaacttaagtgttagttggttgatggagttactagtagaccatgttgggagctgacaacaatttgagacctttattcttagccctttatgtctaaatttccactgaccaattgagttaacaataatttaggccatggtttacagtatcccaacttatgtacaaagatttctactcaaaagtcagtatagtgtgagagtcgaaataagttttctggtgattcaaacaccagttcccctttgtaagatttcctaatcatagagataatctaagaaaccaaattagtgtggaatctttgcagagagagaatgatttgatgaatcaggcaggggacggagaaagaatgctagaatcctaggggaatgcacatgccagtaccccagtcagtattactctccaattctgtagaatccacagttgcatgtcattgttcaacatgcattgcaatgtgtgggccaagtttgctacttatcaactaaatgcattttatagtacttaccatgttttgatttttttttttaatcacatcagtaatgtgtctccaaatgactttgtaagggggctatttattggccattttcaaaaacaaatctcacctgaaatcatctgctagagtctttctggaacctttttttaaaagtagactttattttttagatcagtttcaggttcacgtaaaattaagtggaaagctcagtgagttcccatataccaccttccatacacacacagcccacttccatcctcagcatcccatagtagagtgatcatgtgttacagtccataaccctgtgcacacatcatcatcacccaaagtccataatttagggttctctcttggtgttacacattttgtggattttggatgatgtgtgcagaactaatttttaaatattcaggattatacagctatatgccaggaatgtagtaggtgttatactaataaagcgtagttgtgtttttttgcattttaaaataaattttaaataaatatttagaaaccttttatattgtaaaatctattatttttacaagttttttctttgttcttttcttttagaaaataaacagagttgtctttgttggaaactttttacgtgtcaataccctctcaatgaaacttttggcatatgcactggattactggtcaaaaggtcaactaaaagcattgtttctagaacatgaggtatggtaggaaaatgttttttgtgaattttaatagcatgttttttaagagacagggtcttgctctgtcactcaggcttgagtttagtggcacaatgatggcttactgcagcctcttcctcctgggctcatcaatcctcccacctcagcctcccaagtagctgggaccacaggtatgcaccactgtgcccagaaaatttatttttattaatattttttgtggagacaggatcactctttgttgcccaggctagtctggaactcctggcctcaagcaatcctttataggtgtgagccaccatgcccagccttaagtagtagaatattggttccttcgcttcagtttcagttgtggggaagagaattacaataacctgttaggcacccccagatttttttgtattcatttactacatgcagttaagttctgatctgagcaattatcagtccacataatgttttggattaacttaacttgaatcattttgtgatcaaagtcaaatggctgtatcattacaaattagtaacagagattcaaattattctgctcttaaaagcttccatgtcttggccgggtgcggtggctcatgcctgtaatcccagcactttgggaggccaaggcggacggatcacgaggtcaggagatcaagaccatcctggctaacaacggtgaaaccccgtctctactaaaaatacaaaaaaaaattagccgggcgaggtggcgggcgcctgtaatcccagcgactcgggaggctgaggcaggagaatggtgtgaaccccagggggcggagcctgcagtgagtcgagatggcgccactgcactccagccactccagcctgggtgatagcgagactgtctaaaaaaaaaaaaaaaaaaaagcttccatgtctcattgtcactgctcacacaatacaaatcagaatggtgtgcccttgtgcaattccacatggcatgcagtgagagtgtcaggcacagccacaggaagttagtttgttttattaagtaaaggggagagggtgcagaattgctgttacagtcctggaagctttagtgtctaaaggccacacttttagaatacgtatttcagtgtgagcctatagtcccagctattcaagaggctgagatgggaggaccatgtgagcccaggaattcaaggccagcctgggcaaaatagtgagaccatgtctctaaaaataataataataaataaaaatacatatttcaaaggtgtgtagacatcaagaatacagattcagaaaattttttataatagctaacaacgcagaaattggtaggtttccaaatattattaaacaaatagattgtgcatagttgtgtgttctcaagtggttaatattatatgctaacttaaaagctgtactacataacagttatttttaaattacacagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaaatgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaggggtttgttcctcttatttcctctatgtaggaagttgtgtcttaggcaactttatcagtatcatggaaaatgataggcactacaatgaaatggcaggatgccaatatgagatatttcaggaataataagaaatacgtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccattttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttactatg

SEQ ID NO: 6433 - DNA, 15574 bp, Homo sapiens
agccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctaggtaagtttaacatttgtgttatttaagttacagaagttaagtaattcaagttgcttatgtttttggaaagcaatgtaacagaaagttgtaagggtgctttctcttatccagtttaggttccaagttttgaacattgatgtcatttaaaaattaagtatacattaagaagtttacccctgagtgcaccttgtaagaaacttttttttttttaatttttgagtgtctttccagtgtttatgcaaatacaaatacatatttttacttttctccccatatacaaaaggtaatctaccattatatggcatactatatatactctaaagtatccatatagaaatctttacatgttgttgaccttattttatacaggtgtaggataaattcccaaaagttggattgcaaatgcatttttgagatattgttaattatgcaaaagagcggtactgtttttcactctcaccagcggtaaatgaaagtgcctgtttcaccagtagagtgctaacttttgcatttttgctaatcagatggagaagtggtatcttaatgtaattttaatttacatttctcctaccaacactggggttaagagccttgcatattttattttctgtgagttattgttcatgttctacttttctgttggattgttatacagttgaatttatcagtcttttcttttatggcttctggatattgattcatagtaagtaagtcttctacattccaaatatataaaggaataaacccttattttcttctgatatgttaatggtggtatttttatacttaaatctttgatttacttatagtttatcttagggtattttgtgagttacagatcatgctttcatttttcaggttttttgtttttttttccagaaggccctaatgtctaataatccatctttatttcactgatttgagatggcttttttacatatgctggcttttcattctgttgatgtaccagcattatactttcagctttatagaggcataaaaagtatgttttaatctctagaagggctagtttcactcctttgcttgattttctgtatgaacttggcaaacattttctctattacaaaaatgtttttggaatctcagtaagtttacatattaacttagggacaaatgatatctttatagtaagtcttgctgttgaagaacttagcttgtctgtttgtttaaggctacttttgtgcctttcacacatttaaaaaggcctctccaaatatgtccatacatggctttttaaattgattcctaaatattttaaatttactgttctgttgtttatcagtcttgtctcccattatgcttcctaaccattgttgcttgtgcaccccaagttctttgtcagggaatccagtgccctttgatagtggactttgtctcactcttcagtaatatctcctgcctctcccttgcatagacgcttcactccgaccaaacatcttgtgatttcatagatgttttcatttctcatttctgtgtgcctttaacctttagttgcctctgcctaagatttttcttctcattttttctggctttttctggtccttttgctctgaaagccctgcctcataccttcttaacttttttctcttaccactgtaataaaagatatttttttgtttgtatttccaaggttagcctttgtttggggttagcctttgtttggattttttccctgttactgttagcgcttctcttgctgtcttttgtatgtaggcctgcattgtccattacagtagcctctagccacgtaaggcacttggcttatgagtgccacatgttgaattgatgatatttggatatattggcttaaatgaaatgtacaattaaaattaatttcacttgtttatttttacctttttaatgtggctaatagaacatatatgaaattatatattactcgtattttatttctattggacagtgctgcactagactaattcactgtttgagggactatctgtctccagcacaaagcttggtatgtcataaatgtttcttgtgactgaatgaaaaagaatttgaagttaaagctgagatacttttggaaacattttgtaattttggctaatttgttttgaatcaggtttaagtgaagatattttggtaatctttgctttcttataataactaactatgctttttttgagatgtcattttaaccttaattctttgaaaggtattactttactcttgcatagattttttttgttagtttgttttgatcttatccctatgtgtttctactttttggtcctaattttataaaaatatccaggttgtagatatatctgttaatacgtaaaatgttgctttttatcagcagatttgactttatttttcatttttctgcagttttgggaatatgatttataaggagaagcgagaatctgttagtaaagaagatctggcaagagctactttagttactatcaccaataacattggttctgtggcacgaatgtgtgctgttaatgaggtaaaaaaacaaaaaacacaaaacttgaattatcaaaaatgtgaattggagtcctatatacacctagcagggcttcttcactttccctaaggaggcctctgggattgagatgtaacccattaaatgccaagactcattaggtatatatgttacgtatccagttgctatattacttttaaagaaagtagcagataattcaaattgaaataggagaaatttattcagaattttttttcagaaaaacacaacctaaatcccttgaggatgtaaaagaaagttctaagcataagacattttgagatactttgtgaaagcattttttttagtcttaattttgcatttggaaggcagctatgctcaccactataccaccagtgcttaatgttgcatttgattagtgaaattcttggaagttttcttactgccctcggcttctttacagtgctgccttgttgcatatggatcaagcagcattgtacagggctatgaaggcattgagacctgttcttcatgatatttgagtggtgtttattgttacaagaaaagtgtgaaaaggatatactgttagattgaccatatagttgggattctttgtttggaagagaatatatatatttaattctagcttccttatataataatagatatatttgcccgtttaatttttataaatatcaaatactttaaatggattgggaagtacgcttttcgaaggaacccttcatttgttcattcattcatttattcattgagtaaatatttactgattaccagatgccagacatcgttctgggtatttggaacatattaatgaagaaaacaaagatctggctttgtggagcttgcattcattctagtgacatattaagtaaattgtgtagtgtgtattaggtgataagtgctatttttttaaaaagagaccatcaaacaggataaagaggattgggaatagggcagagagtggtagaggacaaattgctaagtaattgagtggttaaaggaaagctttattgaaaatgtgattcttaggcagaggtttgaaggaggtgagggggaaactgtgcatgtagacattttggggagaaagcttccagcagagagaacaaatatgcaaatcctctgaattattctgtatttaaatccagaacttggtctcatcagttttttaataacttagaaacttaagtgttagttggttgatggagttactagtagaccatgttgggagctgacaacaatttgagacctttattcttagccctttatgtctaaatttccactgaccaattgagttaacaataatttaggccatggtttacagtatcccaacttatgtacaaagatttctactcaaaagtcagtatagtgtgagagtcgaaataagttttctggtgattcaaacaccagttcccctttgtaagatttcctaatcatagagataatctaagaaaccaaattagtgtggaatctttgcagagagagaatgatttgatgaatcaggcaggggacggagaaagaatgctagaatcctaggggaatgcacatgccagtaccccagtcagtattactctccaattctgtagaatccacagttgcatgtcattgttcaacatgcattgcaatgtgtgggccaagtttgctacttatcaactaaatgcattttatagtacttaccatgttttgatttttttttttaatcacatcagtaatgtgtctccaaatgactttgtaagggggctatttattggccattttcaaaaacaaatctcacctgaaatcatctgctagagtctttctggaacctttttttaaaagtagactttattttttagatcagtttcaggttcacgtaaaattaagtggaaagctcagtgagttcccatataccaccttccatacacacacagcccacttccatcctcagcatcccatagtagagtgatcatgtgttacagtccataaccctgtgcacacatcatcatcacccaaagtccataatttagggttctctcttggtgttacacattttgtggattttggatgatgtgtgcagaactaatttttaaatattcaggattatacagctatatgccaggaatgtagtaggtgttatactaataaagcgtagttgtgtttttttgcattttaaaataaattttaaataaatatttagaaaccttttatattgtaaaatctattatttttacaagttttttctttgttcttttcttttagaaaataaacagagttgtctttgttggaaactttttacgtgtcaataccctctcaatgaaacttttggcatatgcactggattactggtcaaaaggtcaactaaaagcattgtttctagaacatgaggtatggtaggaaaatgttttttgtgaattttaatagcatgttttttaagagacagggtcttgctctgtcactcaggcttgagtttagtggcacaatgatggcttactgcagcctcttcctcctgggctcatcaatcctcccacctcagcctcccaagtagctgggaccacaggtatgcaccactgtgcccagaaaatttatttttattaatattttttgtggagacaggatcactctttgttgcccaggctagtctggaactcctggcctcaagcaatcctttataggtgtgagccaccatgcccagccttaagtagtagaatattggttccttcgcttcagtttcagttgtggggaagagaattacaataacctgttaggcacccccagatttttttgtattcatttactacatgcagttaagttctgatctgagcaattatcagtccacataatgttttggattaacttaacttgaatcattttgtgatcaaagtcaaatggctgtatcattacaaattagtaacagagattcaaattattctgctcttaaaagcttccatgtcttggccgggtgcggtggctcatgcctgtaatcccagcactttgggaggccaaggcggacggatcacgaggtcaggagatcaagaccatcctggctaacaacggtgaaaccccgtctctactaaaaatacaaaaaaaaattagccgggcgaggtggcgggcgcctgtaatcccagcgactcgggaggctgaggcaggagaatggtgtgaaccccagggggcggagcctgcagtgagtcgagatggcgccactgcactccagccactccagcctgggtgatagcgagactgtctaaaaaaaaaaaaaaaaaaaagcttccatgtctcattgtcactgctcacacaatacaaatcagaatggtgtgcccttgtgcaattccacatggcatgcagtgagagtgtcaggcacagccacaggaagttagtttgttttattaagtaaaggggagagggtgcagaattgctgttacagtcctggaagctttagtgtctaaaggccacacttttagaatacgtatttcagtgtgagcctatagtcccagctattcaagaggctgagatgggaggaccatgtgagcccaggaattcaaggccagcctgggcaaaatagtgagaccatgtctctaaaaataataataataaataaaaatacatatttcaaaggtgtgtagacatcaagaatacagattcagaaaattttttataatagctaacaacgcagaaattggtaggtttccaaatattattaaacaaatagattgtgcatagttgtgtgttctcaagtggttaatattatatgctaacttaaaagctgtactacataacagttatttttaaattacacagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaaatgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccattttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgcccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaagcacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctggctttttttctggtatttaaccatttctaattttgttcatattctaaatcgatttttgaatcatactttttatttttctaactttcctaaattaattttcttagttgtt

SEQ ID NO: 6434 - DNA, 20507 bp, Homo sapiens
ctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacagtaggtatcttttactcaaaactgaaaattgatacctgtttttaaatatgagagtaggtttccatctagcatgttccttaattctccctgcacatgcagtgggaaatatgtatccatggttgcctttcacttggggcgttttaaacacgtttatgagatgagtaaaaattgcccggatttggtcatgttgttgcacataatatttggtaaaacttgtttagggctgtactacaaagctacaataaaaaggggatttggggactttaatgaatttggcagtgtacaaagccagatataaatgaagcttgaattattttcactattgtcctacatttacatggtttttggaatattacttattcaaataatattaatcttccagggccatctccttcccaaaccctaagtctggaaaccaatgtcttttggttagtataatggacacctgaatgaaaatctgttacccttttttttctgtttttatgctgttaatcctgccatgttcctgtgtcaaatggggtgatttgaatggatctggcaggagaactatgagtattggtttgagttatgtgctgttagcagtttgccatcttctagtcttttccattagaatgagagttcaaagagtggtttgccaagcttctagtcttttctattagaataaagaatggctctgtttaggaccactgaaatttgtttttcttgaaaatgtaaatgtgaataatttaatttctgaaaatcataagaaaatactgttaatggaatataaaggctgacgtgggaggatcacttgaggctaggagttggagaccagcctgggcaatatagtgggaccccgtctctacaaaaaataaaaaaattagctcagcatagtggcctgtgcttgtagtcccagccactcaagaggctgatgaagtgggaggattgcttgagctcttgagattgaggctgcagtgagctgtgattgagccattgcactccagcatgggtgacagtgagaccctgtctcagaaggaatataaataacttaaatggctcatagaagcgagacccatataatttgaggtaaagatctgtagtactgtatgaaaagaggtgccttgggaacacagaggagtaacaacagctagagagttgaagaggttcccagaggaagtgatatctaagctgcaatgttttataaacggtgtcttataatacgctttttactaacctgaaatgatgaatgtaatcatttcaaactagtactcaaactataatataaagacaggagattaaggtatcagttattaatcagaaattaatctatccgtgggtagattaacaaacagtatgatcattccagaggacatcatgaagtagttatatgcttgcacctatgcatagattgatcatgaataccaaagctacacatgccagattgatatggtatgttctgttggaaaataagataccataaatggcattgctgttggtgacatgaccctccaacatgctaaacaaacacttggtaaaattccaaacagtaagaagtacaattttcccttgctttatgtggtggttcaattcctagcaaatttagtatatatttaaaactacgtgggttgggcacagtggctcacgcctgtaattccagcactttgggaagccaaggtgggcggatcacttgaggttaggagctggagaccagcctgaccaatgatggtgaaacctcatctctactaaaaatacaaaaattagccaggcgtggtggcgggcgcctgcaatcccagctacttgagaggctgaggcggagaatcgcttgaacccacgaggtggaggttgcagtgagccgagatcatgccactgtactccagcctgagtgacagagctagactctgtctcaaaaatgaatgaatgaatgaatgaatggagtgactgaatccataggacgaatacttttgtatttgtatacacagacagataggtaaaataactttgttattctctagcctcagataattataaataattttcctactgccactataaaaatgactggcagaacactcaaagataatgcatagatgggataattttttggtctgcagaaatgtcacacccattaaagatgtctggcatcacaagtccctgcccactaaatgtcagtttggtccttccttcctccccatcatttagaaaactagcagtgaggtgataccaccctcactgaggaccagtggactagatgaaatcccgaaagagattctgacatgaaacaaaatgaaaatgtgggggtcatagaccatttttaatttttgtaaagtaatacaggaaaatcatatagttgagtgtttttgaatgtcatccttttttgtttttgtttgtttgttttaacagattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaaggtagtgacctttttggttgtattgctgcattcacattgttttatacacagaagttatgaaatcagtataataatgtcattttcaccagtaaaagagcatgtatttgcacaacagcaaaaaaaaaaaatatatatatatatatattttttttttttttaagtgaaagagggtgccatgttgcccaggctgctcttgaacttctgagctcaagcaatctgcctgtctcggcctcccaaagtactgggattacaggcatgagccactgctcccagccaacagataatgtatttttataagatgtgtatgtcaagactcaaactgaaattattaaatgtttattagtcagcatcagttgggatcaaaatttccataatggtaaagtgaatttttatctagaatgagtctggtaacgttttttctagaatttaactggagcatttacttggaagcaacagtgttctattgattttaaactttattatgtttatattttgttcttttttccaaagcatttttcttctttacctattttttgactttttaatggatattaatatatgtaaacccttaaactgcagtactggggaacattgtaatttattcttataggatgaattaatgtgatttctttttgtgataacattaatgttcccaaatagcccacatacttttctgtaatacctgaaatacgaatgagaaataagatataaaactcatgattcttttatgtattttatcaacttttacagagaggtgaagattccagtttaaggaagaaagattttcaaatactttagattaatttgtgaaaaaaactcattttaattttaaagtagtaattctgtttaaattatacttaattagtactttatttttatggtggttaaaagttcacctctgttgtaattctctatgccaaagaattgtacactgctattgccttcttcggttaactctaaaagaagttcagtctgttaactaaatccaacagtgattcaggggtagaacttgctagaaatttagatgagactagggagcaaaggtttacagtttaggaattagatacgatttcattctgtgagcatatccagaagaataatagaagcaaataaatttctgtaattgacatgttggccagctggacataaatttactcattgtatttatgtgtaggtcatgtgaaatattagtgtatcatattgaattgatttcatccatgtcaggccaagtaaagaagcctttcccaaaatcatttcttggaaacgatttaaaattacaaagatgggcatggtagttcatgcctgtaattctaacactttgggaggccaaagtggaggattgcttgagaccaggagttaagaccagcctgggaaacatagtgagacccccatctctacaaaaatatatacatatatattagtccagtgtggtagtgtgcattgtagtctagctgctgcggaggctggaacaggaagattgcttgagcccaggagttcaaggatacattaggctatgatcatggtcactgcactccagcctgagggacagagtgagaccttgtctcaaaagaaaaattacagattttctctttgtaattaatatggtactgatttttaacatttattcctttttaatgcacacacaacaatttatctttggtaactacagagtgtaaggtattaggtgaagactttgggagagatttaataggtctttcctttcctcatgtttccaccaagtgatttttttctttggtttattctttgatctaacaagtttggttttactaaacaatttttgttgccttcgttatgttatttcagcactcagcattagtcataggttttttttctgtgtgttcattgaatacatgaatgatccacccttttactttagagaaagaatataatgtataaatgcaacttagcaagtttctttattttctttagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctaggtaagtttaacatttgtgttatttaagttacagaagttaagtaattcaagttgcttatgtttttggaaagcaatgtaacagaaagttgtaagggtgctttctcttatccagtttaggttccaagttttgaacattgatgtcatttaaaaattaagtatacattaagaagtttaccctgagtgcaccttgtaagaaactttttttttttaatttttgagtgtctttccagtgtttatgcaaatacaaatacatatttttacttttctccccatatacaaaaggtaatctaccattatatggcatactatatatactctaaagtatccatatagaaatctttacatgttgttgaccttattttatacaggtgtaggataaattcccaaaagttggattgcaaatgcatttttgagatattgttaattatgcaaaagagcggtactgtttttcactctcaccagcggtaaatgaaagtgcctgtttcaccagtagagtgctaacttttgcatttttgctaatcagatggagaagtggtatcttaatgtaattttaatttacatttctcctaccaacactggggttaagagccttgcatattttattttctgtgagttattgttcatgttctacttttctgttggattgttatacagttgaatttatcagtcttttcttttatggcttctggatattgattcatagtaagtaagtcttctacattccaaatatataaaggaataaacccttattttcttctgatatgttaatggtggtatttttatacttaaatctttgatttacttatagtttatcttagggtattttgtgagttacagatcatgctttcatttttcaggttttttgtttttttttccagaaggccctaatgtctaataatccatctttatttcactgatttgagatggcttttttacatatgctggcttttcattctgttgatgtaccagcattatactttcagctttatagaggcataaaaagtatgttttaatctctagaagggctagtttcactcctttgcttgattttctgtatgaacttggcaaacattttctctattacaaaaatgtttttggaatctcagtaagtttacatattaacttagggacaaatgatatctttatagtaagtcttgctgttgaagaacttagcttgtctgtttgtttaaggctacttttgtgcctttcacacatttaaaaaggcctctccaaatatgtccatacatggctttttaaattgattcctaaatattttaaatttactgttctgttgtttatcagtcttgtctcccattatgcttcctaaccattgttgcttgtgcaccccaagttctttgtcagggaatccagtgccctttgatagtggactttgtctcactcttcagtaatatctcctgcctctcccttgcatagacgcttcactccgaccaaacatcttgtgatttcatagatgttttcatttctcatttctgtgtgcctttaacctttagttgcctctgcctaagatttttcttctcattttttctggctttttctggtccttttgctctgaaagccctgcctcataccttcttaacttttttctcttaccactgtaataaaagatatttttttgtttgtatttccaaggttagcctttgtttggggttagcctttgtttggattttttccctgttactgttagcgcttctcttgctgtcttttgtatgtaggcctgcattgtccattacagtagcctctagccacgtaaggcacttggcttatgagtgccacatgttgaattgatgatatttggatatattggcttaaatgaaatgtacaattaaaattaatttcacttgtttatttttacctttttaatgtggctaatagaacatatatgaaattatatattactcgtattttatttctattggacagtgctgcactagactaattcactgtttgagggactatctgtctccagcacaaagcttggtatgtcataaatgtttcttgtgactgaatgaaaaagaatttgaagttaaagctgagatacttttggaaacattttgtaattttggctaatttgttttgaatcaggtttaagtgaagatattttggtaatctttgctttcttataataactaactatgctttttttgagatgtcattttaaccttaattctttgaaaggtattactttactcttgcatagattttttttgttagtttgttttgatcttatccctatgtgtttctactttttggtcctaattttataaaaatatccaggttgtagatatatctgttaatacgtaaaatgttgctttttatcagcagatttgactttatttttcatttttctgcagttttgggaatatgatttataaggagaagcgagaatctgttagtaaagaagatctggcaagagctactttagttactatcaccaataacattggttctgtggcacgaatgtgtgctgttaatgaggtaaaaaaacaaaaaacacaaaacttgaattatcaaaaatgtgaattggagtcctatatacacctagcagggcttcttcactttccctaaggaggcctctgggattgagatgtaacccattaaatgccaagactcattaggtatatatgttacgtatccagttgctatattacttttaaagaaagtagcagataattcaaattgaaataggagaaatttattcagaattttttttcagaaaaacacaacctaaatcccttgaggatgtaaaagaaagttctaagcataagacattttgagatactttgtgaaagcattttttttagtcttaattttgcatttggaaggcagctatgctcaccactataccaccagtgcttaatgttgcatttgattagtgaaattcttggaagttttcttactgccctcggcttctttacagtgctgccttgttgcatatggatcaagcagcattgtacagggctatgaaggcattgagacctgttcttcatgatatttgagtggtgtttattgttacaagaaaagtgtgaaaaggatatactgttagattgaccatatagttgggattctttgtttggaagagaatatatatatttaattctagcttccttatataataatagatatatttgcccgtttaatttttataaatatcaaatactttaaatggattgggaagtacgcttttcgaaggaacccttcatttgttcattcattcatttattcattgagtaaatatttactgattaccagatgccagacatcgttctgggtatttggaacatattaatgaagaaaacaaagatctggctttgtggagcttgcattcattctagtgacatattaagtaaattgtgtagtgtgtattaggtgataagtgctatttttttaaaaagagaccatcaaacaggataaagaggattgggaatagggcagagagtggtagaggacaaattgctaagtaattgagtggttaaaggaaagctttattgaaaatgtgattcttaggcagaggtttgaaggaggtgagggggaaactgtgcatgtagacattttggggagaaagcttccagcagagagaacaaatatgcaaatcctctgaattattctgtatttaaatccagaacttggtctcatcagttttttaataacttagaaacttaagtgttagttggttgatggagttactagtagaccatgttgggagctgacaacaatttgagacctttattcttagccctttatgtctaaatttccactgaccaattgagttaacaataatttaggccatggtttacagtatcccaacttatgtacaaagatttctactcaaaagtcagtatagtgtgagagtcgaaataagttttctggtgattcaaacaccagttcccctttgtaagatttcctaatcatagagataatctaagaaaccaaattagtgtggaatctttgcagagagagaatgatttgatgaatcaggcaggggacggagaaagaatgctagaatcctaggggaatgcacatgccagtaccccagtcagtattactctccaattctgtagaatccacagttgcatgtcattgttcaacatgcattgcaatgtgtgggccaagtttgctacttatcaactaaatgcattttatagtacttaccatgttttgatttttttttttaatcacatcagtaatgtgtctccaaatgactttgtaagggggctatttattggccattttcaaaaacaaatctcacctgaaatcatctgctagagtctttctggaacctttttttaaaagtagactttattttttagatcagtttcaggttcacgtaaaattaagtggaaagctcagtgagttcccatataccaccttccatacacacacagcccacttccatcctcagcatcccatagtagagtgatcatgtgttacagtccataaccctgtgcacacatcatcatcacccaaagtccataatttagggttctctcttggtgttacacattttgtggattttggatgatgtgtgcagaactaatttttaaatattcaggattatacagctatatgccaggaatgtagtaggtgttatactaataaagggtagttgtgtttttttgcattttaaaataaattttaaataaatatttagaaaccttttatattgtaaaatctattatttttacaagttttttctttgttcttttcttttagaaaataaacagagttgtctttgttggaaactttttacgtgtcaataccctctcaatgaaacttttggcatatgcactggattactggtcaaaaggtcaactaaaagcattgtttctagaacatgaggtatggtaggaaaatgttttttgtgaattttaatagcatgttttttaagagacagggtcttgctctgtcactcaggcttgagtttagtggcacaatgatggcttactgcagcctcttcctcctgggctcatcaatcctcccacctcagcctcccaagtagctgggaccacaggtatgcaccactgtgcccagaaaatttatttttattaatattttttgtggagacaggatcactctttgttgcccaggctagtctggaactcctggcctcaagcaatcctttataggtgtgagccaccatgcccagccttaagtagtagaatattggttccttcgcttcagtttcagttgtggggaagagaattacaataacctgttaggcacccccagatttttttgtattcatttactacatgcagttaaattctgatctgagcaattatcagtccacataatgttttggattaacttaacttgaatcattttgtgatcaaagtcaaatggctgtatcattacaaattagtaacagagattcaaattattctgctcttaaaagcttccatgtcttggccgggtgcggtggctcatgcctgtaatcccagcactttgggaggccaaggcggacggatcacgaggtcaggagatcaagaccatcctggctaacaacggtgaaaccccgtctctactaaaaatacaaaaaaaaattagccgggcgaggtggcgggcgcctgtaatcccagcgactcgggaggctgaggcaggagaatggtgtgaaccccagggggcggagcctgcagtgagtcgagatggcgccactgcactccagccactccagcctgggtgatagcgagactgtctaaaaaaaaaaaaaaaaaaaagcttccatgtctcattgtcactgctcacacaatacaaatcagaatggtgtgcccttgtgcaattccacatggcatgcagtgagagtgtcaggcacagccacaggaagttagtttgttttattaagtaaaggggagagggtgcagaattgctgttacagtcctggaagctttagtgtctaaaggccacacttttagaatacgtatttcagtgtgagcctatagtcccagctattcaagaggctgagatgggaggaccatgtgagcccaggaattcaaggccagcctgggcaaaatagtgagaccatgtctctaaaaataataataataaataaaaatacatatttcaaaggtgtgtagacatcaagaatacagattcagaaaattttttataatagctaacaacgcagaaattggtaggtttccaaatattattaaacaaatagattgtgcatagttgtgtgttctcaagtggttaatattatatgctaacttaaaagctgtactacataacagttatttttaaattacacagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaagtgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacaaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccattttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggccctcgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttactatg

SEQ ID NO: 6435 - DNA, 372 bp, Homo sapiens
tgactaccatgtgacatgtgaagtacatatcttttatttaaaaaaaattagcaagaactaggatgaaaaaaatctaagatctggactaaaggagaacatgatgcagtatggaagagatttgaggtgtagtttagctattcaaatgtaggaagtactgctgtcgcaagcacttagaaataagctcctaaagagcatacattcaaggctacacacttaagtctttcatttaaataaactttccaaggagggaaaagtctgtactggagtcaatacacagtgctatataaattttgaaagtggccaggagcagtagctcacacctacaatcccagcactttgggaaaccaaggcaggtggatcacttgaggccag

SEQ ID NO: 6436 - DNA, 1242 bp, Homo sapiens
tttctttctttctttctttttttttttttttgagacggagtcttgctccgtcgcccaggctggagtgcaatggcgcgatctctgctcactgcaagctccacctcccgggttcacgccattctcctgcctcagcctccagagtagctgggactacaggcgcctgccaccacggccggctaatttttttgtatttttttagtagagacggggtttcgctgtgttagccaggaaggtctcgatctcctgacctcgtgatccacccgtctcggcctcccaaagtgctgggatcacaggcgtaagccaccgcgcccggcctggagataatgattatttactgaagggaattgctttttgggtttgttttttatgacaggatctcactctgttacctaatctgcagtgtagtggtgcaaacatggctcaccgcagccccagcctcctggactcaagtgatcctcctgcctcagcctcctgtaactgggactacaggtgcatgctgccacgcccagctaatttttaaattttttgcggagacaggatcttgttatattgccaaggctggtttcaaactcctgttttcaagcgatcccccctacctcagcctcccaaagtattgggatttcaggtgtgagcaccatacctggcaggaattgctttttaaggaggtgcttttctcctgggttacttgaagtgattataggccagttttattgtattaaaatgcttatagaaacaaagattttcatgcccttagtgttgacctatttattgaaaaaagaatgatctgaattttttctcatccctggagcacatggtatttagtaaatgaaaaggggttgcctaccaggccaggaattaaaagatcctgggtcaactctaagcaccctatacgtttttagaaaatatattaataaaactttgaagggccgagcgcggtggctcacgcctgcaatcccagcactttgggaggcagaggcaggcggatcacaaggtcaggagatcgagaccatcctggctaacacggtgaaaccccgtctctactaaaaatacaaaaaaaaaaaaaattaggcaggcgtggtggtgggcacctgtagtcccagctactcgggaggctgaggcaggagaatggcgtgaacccgggaggcggagtttgcagtgagccaagatcgcgccactgcactccagcctgggcaacagagcgagactccatctcaaaaaaaaaaaaaaaaaaaaaactttgaa

SEQ ID NO: 6437 - DNA, 350 bp, Homo sapiens
tttttagaaaatatattaataaaactttgaagggccgagcgcggtggctcacgcctgcaatcccagcactttgggaggcagaggcaggcggatcacaaggtcaggagatcgagaccatcctggctaacacggtgaaaccccgtctctactaaaaatacaaaaaaaaaaaaaattaggcaggcgtggtggtgggcacctgtagtcccagctactcgggaggctgaggcaggagaatggcgtgaacccgggaggcggagtttgcagtgagccaagatcgcgccactgcactccagcctgggcaacagagcgagactccatctcaaaaaaaaaaaaaaaaaaaaaactttgaa

SEQ ID NO: 6438 - DNA, 372 bp, Homo sapiens; identical to SEQ ID NO: 6435

SEQ ID NO: 6439 - DNA, 946 bp, Homo sapiens
aaatccctctggagagtgagcgcactgctccatttttagtttatgtccccttctctacttctgacctgtataattggaaggctcataatccccccttctctgaaaagccccaggtcttgacttcactgatggagtccgtgctctggactcactggcccaccaggaatgactgtcagcaactccttttaacgcttttcacctctgaagagagggaccgtatccgaagagaggccagaaagtattttctcacatcagccggtagaccagaggaggaagcccaggacctccttgaggaggcttttccctctacccggcctgattgggatccaaattcctcaggtgggaagacagctttggatgattttcaccagtatctccttgcgggtatcaagggagccactggaaaacccatgaatctgtccaagacaactgaagttgtccaggggcctgatgagtcaccaggagcgtttctagaatgcctcccagaggcccatcggacttacaccccttttgaccccgcggctcccgagaatagctgtgctattgatttggcatttatgactcaggcagcccctgatattaaaagaaaattacaaaagctggaaggatttgctggaatgaacaccagccaacttcttagaaatagcccagaaagtttatgacaatcgagagtttgaaaagcaagaacaggcagcccaggtagctgaaagaactgctgacaaagcatcaaaaagacaggcaaaaatcttagtagccaccatccaggggggcaagaagaaagggcccccatcacaaaacactggccaggggaccccgggtccccaccagaaaggccaaaaaggtgagtgggctcccctacaaagaaaccagtgcatgtattgcaaacagattggacactggaaaaagaaatgcccattaaaaccagaagaaaaaacagaaaagaaaa

SEQ ID NO: 6440 - DNA, 946 bp, Homo sapiens
aaatccctctggagagtgagcgcgctgctccatttttagtttatgtccccttctctacttctgacctgtataattggaaggctcataatccccccttctctgaaaagccccaggtcttgacttcactgatggagtccgtgctctggactcactggcccaccaggaatgactgtcagcaactccttttaacgcttttcacctctgaagagagggaccgtatccgaagagaggccagaaagtattttctcacatcagccggtagaccagaggaggaagcccaggacctccttgaggaggcttttccctctacccggcctgattgggatccaaattcctcaggtgggaagacagctttggatgattttcaccagtatctccttgcgggtatcaagggagccactggaaaacccatgaatctgtccaagacaactgaagttgtccaggggcctgatgagtcaccaggagcgtttctagaatgcctcccagaggcccatcggacttacaccccttttgaccccgcggctcccgagaatagctgtgctattgatttggcatttatgactcaggcagcccctgatattaaaagaaaattataaaagctggaaggatttgctggaatgaacaccagccaacttcttagaaatagcccagaaagtttatgacaatcgagagtttgaaaagcaagaacaggcagcccaggtagctgaaagaactgctgacaaagcatcaaaaagacaggcaaaaatcttagtagccaccatccaggggggcaagaagaaagggcccccatcacaaaacactggccaggggaccccgggtccccaccagaaaggccaaaaaggtgagtgggctcccctacaaagaaaccagtgcatgtattgcaaacagattggacactggaaaaagaaatgcccattaaaaccagaagaaaaaacagaaaagaaaa

SEQ ID NO: 6441 - DNA, 405 bp, Homo sapiens
acttggctctgctctccctcctaaaacccttaaaagaaagggctgagtttgaactttctgcctttcagtcgtggagacaccacagatatttgggctgtaagtcaagaagagagggggggtacttgaggaggcagatcttatgtggcaagaagcattagctatagctgttttcctacttcttctagctataatacttctgttcttccgatactacagcctcccaggctgtgaatatctctgtccgtgctgggtttaatatttctgctgaaaccttgttaattgcctccagaatgggaaactcttcttcccggccccgtagagattggagccctttccaatgtatgttacaatgtacttctctctgggcttctcagaggattacggagtccaccttaaaaaaggcaa

SEQ ID NO: 6442 - DNA, 405 bp, Homo sapiens
acttggctctgctctccctcctaaaacccttaaaagaaagggctgagtttgaactttctgcctttgagtcgtggagacaccacagatatttgggctgtaagtcaagaagagagggggggtccttgaggaggcagatcttatgtggcaagaagcattagctatagctgttttcctacttcttctggctataatacttctgttcttccgatactacagcctcccaggctgtgaatatctctgtccgtgctgggtttaatatttctgctgaaaccttgttaattgcctccagaatgggaaactcttcttcccggccccgtagagattggagccctttccaatgtatgttacaatgtacttctctctgggcttctcagaggattacggagtccaccttaaaaaaggcaa

SEQ ID NO: 6443 - DNA, 8056 bp, Homo sapiens
ccccactgccccctcccccaattatccttccccttccctccaggtctcggaggaccccatcctagccctacctgtctcggcccgcaacctccccgaagccgtcggtgccactcccagcccatgtgggcccccgcgggctgcccacgcctgtcccccagctccccgttccgctgggctttaccctcgccaggggtggctttctgagccgcccgctccgtgcccctctctgcagcctctcctgccactcggggcccccgttccccctcccggcggcggggggctgcccccggggggctggcggagctgggccgcgggggccccggggccggcggtgccggggtcatcgggatgatgcggacgcagtgtctgctggggctgcgcacgttcgtggccttcgccgccaagctctggagcttcttcatttaccttctgcggaggcagatccgcacggtgagccagggtgggcgctggcggtgttggggacgtctggcggtgttggggacatctgtccgtggtgctcaggggttttcggagtgtcgggcctctgtttgggcctaggaagggaatcctggctggggcttttctcgccagagaattgggcaccctaagcggggcgaggtgggagacccttgtaatagaaccttgcccttgggggttttgatggggctagatgggacaggatttggcaactcttgggggctaaggtggtgggtggggcgctctttaagaaagctggagttgttgctaaagaaaccaagaggcggggaacacctgtttgatgacagccggatctgtggatgtgggcttgggaaagaccctatttggaacctcggtgtgtgtttggtcctataacaaggaagagacagacttgtgtgtcaagggtggaggtgggtgggagggcatacgttacaaacaaggacgggaacttgggaaagccctgggtgtgaaggagaaacgcctgcggttcccattaagagaattcctccaaaaaggctgtgaaaatttatttcatagtgtgagtgtaggtatctggatttattgaagactaaagcagatgcttttacgatgggcctctttaattgtgggagggagttcaaggtgggtgctgtgcccaccattgaagtttgggtgtccctgtcagaggacagcgctgggcagttgtagggcttgaaaatgaggacgtttgcttctccaggagagcctagcattctgagggaaactgtccggatggacccaagcatctctgggtcccctctcccttagcttttctccaaggtcagaggtccttcagctaacagcactttaaatgaatgtgctcttgtggtctcaccaccaccagggagaatcctcggaaggagtctggggagaatttagtaagcggagacacaggttctgggtctgtactgtggtctgtaccccttagcatacctcaatacaatttgaaagaataaacccaggttggggtgacctggggtccagagaatttccagaaagccctcagtggtagtggtggttgatttaactgatttgggagaatgggtctggccttgggttcattctgtcctttaccagtctgcttccacttcctgatttagggcgcgaacagtacaggatggttgtggctgtaggcagcagcgctattcccccgagacaagagctaggagccaagaaaaatttagggtcagagatgctgggatatgtgtggggctatctcctggggttttcttttcttttctgagacagtctcgctttgtcgcccaggctggagtgcagtggtgccatctccgctcactgcaacctccacttcctgggttcaagcgattctcctgcttcagcctctcgaatagctgggattacaggcacctgccaccacacctggctaatttttgtaattttagtagaaacgggttttcaccatgttggccaggatggtctcaaactcctgacctcaagtgatctgcccgccttggcctcacaaaagtactgggattgagccactgcacccggcctccagcggttttctttatgggttgactgccatcttctctgacgttctcgctccaacacatcagttttctgggcatacggagtggtgcttcagctcatccacaggttacttccaaaattgctctcctttgggcagcactgaccccatagccttttgtcctcccttcccttccaatctggtttctttccccaccccgcttctggcagatgcttggagcattccctacatgcccagcatatgcaacccgagatagcaaggctggacactggagctctttcggacctcatcatggcccagggagaaaagaagggcagatcttgattagggggagagagccctgtgggtttagaagggagaacctggttctggtgtggcttggggcctaggtatgcactgaagagggtttgtacctttgaagaaaagtgtggaagagggaattgccaggctttgtatggggagatgtgcgtattaggaaatagcccctagagaatgcttggagaagcagagctggatgaggtggtgacgtccttgtcccttattcacctctcacttaacggccctgacttcactctggcctcctccagaccctgccagtcagcctggcaggggctttccagtgttctttgcctcaccctgggtaccaggataaggagactgttcagagggctgaggttctctgaacttgtgacttggctagaagggacagaagtggacaggtggctggttaaaataggcctggtggcttctagccagaggaacttagctgacctgacaacctctggattccctcattctatattcccattaaggacccagggatctcctcccgactcctactccatgtgcactagggaatctgaggcacttagttcccaatgatggtagttgctacaaataattcttggggtgaaggttgcgttgtgggggtcgtttctttgttcagtgtagcaggataatatcacagttaagagggcagcttcggccgggggtggtggctcttgcctgtaatcccagcactttgggaagctgaggcaggtggatcatgaggtcaggagctcaagaccagcctggccaatatggtgaaaccccgtctctactaaaaatacaaaaattagctgggcgtggttcgcgcgcctatagtcccagctgcttaggaggctgaggcaggagaattgcttgaacctgggaggtggaggttgcagtgagctgagatcgcgccactgcactccagcctgggcaatggagtgagactcccttctcaaaaaaaaaaaaaagaaaaaaaaagagggcacgttcttgggttgaactgcattggtacaatcctggctctatcacttcattgattctacttttttttttttttttttttttttttttgcgacggagtcttgctctgtcaccaggctggagtacagtggtgcgatctcggctcactgcaacctctgcctcctgggttcaagccactctgctgcctcagcctcccgagtagctggggctatgggcacgcaccaccacgcccagctaatttttatatttttagtagagacggggtttcaccatgttggccaggatggtctccgtctcttgaccttgtgatccgcctgccttggcctcccaaagtgctgggattacaggcatgagccactgcgcctggctgattctactaatatcaactgaccacttttgctactgtgttctaggcactgggaatacagccatgatctagacaaaatcatattctcatggagttttcattttaattagggagagaaacaacttaagataattcctagctgtgtggcctcagtttctttaaccttaaaacaggtataacagtaatattatggttgttttgaggattaaatgaaaaaggccagcgtagtggctcattcctgtaatcccagcactttgggaggcaaaggcaggaggatcacaaggtcaggagtttgagaccagccaggccaatatagttaaaccccgcctctactagaaatacaaaaatgagccgagcgtggtggtgcacgcctgtagtcccagctattagggaggctgaggcaggagaattgcttgaacctgggaggcggaggttgcagtgagccgagatcatgccgctgcactccagcctgggcaacagagcgagactccatctcaaaaaaaaaaaaaaaagaagaagaaataagcctaaattacatacatagtacctgtggtaaatgttcattatgtgctccctgttactgttactggggaaggcttccttatcaagggtttcaatcctcttttgtgctatttgtaggtaattcagtaccaaactgttcgatatgatatcctccccttatctcctgtgtcccggaatcggctaggtaagtatgtggtgggaagcctcctttagggtgaagtaggggctagctctgggtcagaggtcggtcaatattattcctccccactctggttcagcccaggtgaagaggaagatcctggtgctggatctggatgagacacttattcactcccaccatgatggggtcctgaggcccacagtccggcctggtacgcctcctgacttcatcctcaaggtgtgtggtggtggggagtgatgaaatggttccatctgttcctctgcccaaacctggactccctttcccagtcccagagcatctgtctccatccgctggcaccagtgtcagcctggaggagggaagcagatgggtggggcgttttctaggcctgggttgtggtggtcatgacatcccccagcccatcttgttcctctgtaggtggtaatagacaaacatcctgtccggttttttgtacataagaggccccatgtggatttcttcctggaagtggtgagttttggagagctaaagggagctctgtaatgaaggaatggttttagggctctgggaattgggaggatttggaggaaggggtgaggagaaacgggttagagcagttttctagaggggaggctgtgtaatggtaggggagtggctttcagtacttggggttcatttgttgtgctgatgtaattcttttccgctggcatctttctcttttgttcttgcatttctgaatcataagagtgtaggatgcctaacactgagtttggaggtttgggctgggggttcagaatttcgtgtcctcagagacatttgatgttgatggaaggcctgaaggactatgccattgcctttctgaaagataactgtatgtctaaaggaatcatcaccttgtatggcatcgccctctcccccaatctatttcaggtgagccagtggtacgagctggtggtgtttacagcaagcatggagatctatggctctgctgtggcagataaactggacaatagcagaagcattcttaagaggagatattacagacaggtaagctagaatcccagtctaagagtgtggcttgggagggaggccaccagggagggatctgggtttgaggagagtatcctggagagaggcctgctacatgatcccctgccttccagcactgcactttggagttgggcagctacatcaaggacctctctgtggtccacagtgacctctccagcattgtgatcctggataactccccaggggcttacaggagccatccaggtacgggggaaggtggtgagtctggcaggaccagaacatggttctgagaaggtatttttgcaggagacctgggctttggtccttgagagctgggattccctagattatccctagtttgctgtaagtcgaaatgcaagttatttttgtgtttcaaatgagataccatatatgtccatttcataagtcggatttcttatatcatttttttcatttttaaaatttatttttggctgggcacggtggattatgcttgtaatcccagcactttgggaggccgaggcaggcggatcacgaggtcagaagttcgagaccagcctaacaaacatggtgaaaccccatctctactaaaaatagaaaaaactagccaggcgtggtggcgcacgcctgtaatcccagcaactcgggaggctgaggcaggagaatcgcttgaacccgggaggcggaggttgcagtgagccgagattgcaccattgcactccagcctgggtgacagagcgagacgccgtctcaaaaaaaataaataataaataaataaaaataaaatttatttttatttattttttgagatagggtctcactctgttcccaggctggagtgcagtgtcatgatcatagctcactgcagcctcgatctcccaggctcaagtgatccttctgcctcagcctctcagtagttgggactacaggcgtgcaccaccatgcccagctaatttttttattttttatttttttttgagacagagtctcgcactgtcacccaggctggaatgcagtggcgtgatctcggcttactgcaacctccgacttccaggttcaagcaattctcctgcctcagcctcccaagtagctgggatcacaggcacctgccaccacgcgcagctaattttttgtatttttagtagcgacggagtttcaccacgttggccaggctggtcttgaattcctgacctcgtgattcgtccgctttggcctcccaaagtgctgggattacaggcgtaagccactgcccttggccaattttttgatttttagtagagaagggatctcattatgttgcccaggctggactcaaactcctgagctcaagtgatcctcccacctcggcctctcaaagtgttgggataacaggtgtgagccactgcgcctggccaagtgtgtttcaagtgaggcacaatggcagtaagcttgactagaagcatcaataggtatgagatctggtgattaaaacttagtttcggagcataaaccaggaaagttttacttaggttgttgacttccggtagtgggaggcatatatttttaacaataattcctccttccctccaagaagagaaaaacaccgtctctcttgaattctgtttcttctcatctgcattttcacccaccctagacaatgccatccccatcaaatcctggttcagtgaccccagcgacacagcccttctcaacctgctcccaatgctggatgccctcaggtaagggaagtgggctctggacacttggatatctcaagaaaggaggaggtgggggatcctcagagggaataaaaaaggtttgtcctgttttaactctgttcccttaagaatttaacatttggacccaggtcgtcttacttcaaagctcatcactttagctagtaggctgtgggcaaattgaacctatctaatcatgaatatggtgataatttaggtcccacatctccagtgatgctgccttacaagagtgttgtgagggtatgaactataaggtactctaccaatgcaagttattgtcaccccaggttcaccgctgatgttcgttccgtgctgagccgaaaccttcaccaacatcggctctggtgacagctgctccccctccacctgagttggggtgggggggaaagggagggcgagcccttgggatgccgtctgatgccctgtccaatgtgaggactgcctgggcagggtctgcccctcccacccctctctgccctgggagccctacactccacttgggagtctggatggacacatgggccaggggctctgaagcagcctcactcttaacttcgtgttcacactccatggaaaccccagactgggacacaggcggaagcctaggagagccgaatcagtgtttgtgaagaggcaggactggccagagtgacagacatacggtgatccaggaggctcaaagagaagccaagtcagctttgttgtgatttgattttttttaaaaaactcttgtacaaaactgatctaattcttcactcctgctccaagggctgggctgtgggtgggatactgggattttgggccactggattttccctaaatttgtcccccctttactctccctctatttttctctccttagactccctcagacctgtaaccagctttgtgtcttttttccttttctctcttttaaaccatgcattataactttgaaaccaaag

SEQ ID NO: 6444 - DNA, 1405 bp, Homo sapiens
gggccgtgggggcctccggggccggcggtgccggggtcatccggatggtgcggacgcagtgtctgctgggactgcgcacgttcgtggccttcgctgccaagctctggagcttcttcatttaccttttgcgggggcagatccgcacggtaattcagtaccaaactgttcgatatgatatcctccccttatctcctgtgtcccggaattggctagcccaggtgaggaggaagatcctggtgctggatctggatgagacacttattcactcccaccatgatggggtcctgaggccgcagtccggcctgttaggcctcctgacttcatcctcaaggtggtaatagacaaacattctgtccggttttttgtacgtaagaggccccatgtggatttcttcctggaagtggtgagccagtggtacgagctggtggtgtttacagaaagcatggagatctatggctttgctgtggcaggtaaactggacaatagcagaagcatccttaagaggagatattacagacagcactgcactttgcagttgagcagctacatcaaggacctctctgtggtccacagtgacctctccagcattgtgatcctggataactccctaggggcttacaggagccatccagacaatgccatccccatcaaatcctggttcagtgaccccagcgacacagcccttctcaacctgctcccgatgctggatgccctcaggttcaccgctgacgttcattctgtgctgagccgaaaccttcaccaacatcggctctggtgacagctaatccccctccacttgggttggggtgggggggcgggggggaaagggatggcgagcccttgggatgccatctgatgccctgtccaatgtgaggactgcctgggcagggtctgcccctcccacccctctctgccctgggagccctacactccacttggagtctggatggacacatgggctgggggctctgaagcagcctcactcttaacttcatgttcacactccatggaaaccccagactgggacacaggtggaagcctaggggagccgaatcagtgtttgtgaagaggcaggactggccagagtgacagacgtacggtgatccaggaggctcaaagagaagccaagtcagctttgttgtgattcgattttttaaaaaaactcttgtacaaaactgatctaattcttcactcctgctccaagggctgggctgtgggtgggatactgggattttgggccactggattttccctaaatttttcccctctttactctccttctatttttctctccttagactccctcagacctgtaaccagctttgtgtcttttttcctttcctctcttttaaaccacacattataactttgaaaaaaaaataaattagaaaaaggacagcaaact

SEQ ID NO: 6445 - DNA, 1333 bp, Homo sapiens
gggccgtgggggcctccggggccggcggtgccggggtcatccggatggtgcggacgcagtgtctgctgggactgcgcacgttcgtggccttcgctgccaagctctggagcttcttcatttaccttttgcgggggcagatccgcacggtaattcagtaccaaactgttcgatatgatatcctccccttatctcctgtgtcccggaattggctagcccaggtgaggaggaagatcctggtgctggatctggatgagacacttattcactcccaccatgatggggtcctgaggccgcagtccggcctgttaggcctcctgacttcatcctcaaggtggtaatagacaaacattctgtccggttttttgtacgtaagaggccccatgtggatttcttcctggaagtggtgagccagtggtacgagctggtggtgtttacagaaagcatggagatctatggctttgctgtggcaggtaaactggacaatagcagaagcatccttaagaggagatattacagacagcactgcactttgcagttgagcagctacatcaaggacctctctgtggtccacagtgacctctccagcattgtgatcctggataactccctaggggcttacaggagccatccagacaatgccatccccatcaaatcctggttcagtgaccccagcgacacagcccttctcaacctgctcccgatgctggatgccctcaggttcaccgctgacgttcattctgtgctgagccgaaaccttcaccaacatcggctctggtgacagctaatccccctccacttgggttggggtgggggggcgggggggaaagggatggcgagcccttgggatgccatctgatgccctgtccaatgtgaggactgcctgggcagggtctgcccctcccacccctctctgccctgggagccctacactccacttggagtctggatggacacatgggctgggggctctgaagcagcctcactcttaacttcatgttcacactccatggaaaccccagactgggacacaggtggaagcctaggggagccgaatcagtgtttgtgaagaggcaggactggccagagtgacagacgtacggtgatccaggaggctcaaagagaagccaagtcagctttgttgtgattcgattttttaaaaaaactcttgtacaaaactgatctaattcttcactcctgctccaagggctgggctgtgggtgggatactgggattttgggccactggattttccctaaatttttcccctctttactctccttctatttttctctccttagactccctcagacctgtaaccagctttgtgtctttt

SEQ ID NO: 6446 - DNA, 2295 bp, Homo sapiens
gcgcaaattcgtggatcgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgaggacagtagccagggccgagggcgcgggacgcttacgctgacgccacagcctggccttggatctgggacaggcagcgcagggatcaggctgctggctgtggtggggttggcagcgagcctgaaactgctgtccttgggacccaggatgaaaggagtggggtagtggtggatgtggggttgagagggatgtggacaggagagagaaaccttagcatttgaggccttagagagtttgacagcctgagcttcaaatggtcatccccccagctagctaaggttgcgagattgaatcactagtcgacccaaacaagtcacctccgtctaagatagttgtttatggtgacgccctattgggggatggatcctggatatttaaatgagctccagtcagtgaggtcaggatctctgggactcagtgctgcaccgcgtgtacaaagacaaagagatgaatctggggtagatttaggtgctaggaatattgtttcttgagttcttgacaggtgcagcttcggggctgcattccttctgtctcctaattttcatctctttatcaggtgatagtagaaaaggctcccaaagctcggataggagacctggacaaaaagaaatacctggtgccttctgatctcacaggtgggaacctgatccaagactcaggcttgcttcctgtgggtgggagtgcagtctctgcgggaggaggctccacctagcagctgttcttttgagggcatttttgacctctgtgactttcttgcatcttgtatcttttgcagttggtcagttctacttcttgatccggaagcgaattcatctccgagctgaggatgccttgtttttctttgtcaacaatgtcattccacccaccagtgccacaatgggtcagctgtaccaggtatggtgactgggaagtggtggaggctttggagaggaatcttggaagagcgtgaggggaagaaagtgttgttacatcagtagttttggactagcttcctggcttgccttaaagtttcataatagccgtgggttgggggtttggacagaacagtaggagtagagagaaggaaagagaacagtgagctagagaaactatctgttcgggactcttcccagtccccctccccattccaaagcagcagaaaacagtttgaggcctttttgcccaggactgcagagattatactgctcgtgtggtaggccttggagtcagtgaaggagtcaggcaatggtttgtggttctagaagaacgtgtctgggtcgtggttggtttaagttactggagcccagttgctgaacagttttctgctttcatcccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctca

SEQ ID NO: 6447 - DNA, 286 bp, Homo sapiens
gtcctttggacggtaaaatggcgcctgtcagagtgggaaacccagctgcagaggctgcagccccggtccccagcggctaaaggacccccgagctcggggagggggaggccgctccggcccagcgctctgcgccctccggctccccctccccctccttccctgctccttcgctctgcaggcccgttctccgctgccgcggccctttgcgcgccgctgcccccgccctccccgttcctgcgagcagccccctagcgcgcctgcgcagcgggccactctctgctttccc

SEQ ID NO: 6448 - DNA, 274 bp, Homo sapiens
ctgccccctcccccaattatccttccccttccctcctggtctcggaggaccccatcctagcccgacctgtctcggcccgcaacttccccgaaggcgtcggtgccactcccagtccatgtgggcccccgcgggctgcccacgcctgtcccccagctccccattccgctgggctttcccctcgccaggggtggctttctgagccgcccgctccgtgcccctctctgcattctctcctgccacttggggcccccgttccccctcccttcggcggggg

SEQ ID NO: 6449 - DNA, 274 bp, Homo sapiens
ctgccccctcccccaattatccttccccttccctcctggtctcggaggaccccatcctagcccgacctgtctcggcccgcaacttccccgaaggcgtcggtgccactcccagtccatgtgggcccccgcgggctgcccacgcctgtcccccagctccccattccgctgggctttcccctcgccaggggtggctttatgagccgcccgctccgtgcccctctctgcattctctcctgccacttggggcccccgttccccctcccttcggcggggg

SEQ ID NO: 6450 - DNA, 16301 bp, Homo sapiens
agtccccacctagggcacgctgccacgccgccgttacctggtccaagtgcccgggaggctccgcctgtcggcttcgctctgcagctgcatctctgatctgtcctgcaggctcaggtgagtcaaaggattgggaggcactgaggggtctgcaggggagtaggcatcaagccaggtcaggcgagtgtattttagcagagacgctgcctagggtgccctatctgatttgcagtgcccttccccacttctgcagggtcctttccaaatcgagcccccaccctcaaagccatcaaaataggatcatcccttttctactctcatccctccaggaaccccctgaaatgtccctaagggacttttgagaatttatttacaggcctctcctcccttgctgctccactccctcaacctcacctcagggcatctctgaatctttctttttttaatgcaaggattaactcctcagaggaatcccaggttctagtatcagtcctgccacgacatcgccatgtacccttcagcaagacactaccctctctggacctagttcctttctttgtagaatgaggggtttggaaaggtgatgaactttgaggcatttgctattttgactttctaggattcctggggtggaggcagggtgccaggtgagaagttggctcagaccaagaatgggatgaggggaaccttaaccaagatttaggggcccagaggcatctccgggtaggaaagtatgggaggtggcagaggccccttgtgccttagccctcatgctgtccagggatgttggctttgcctgtggcccaagcttgacaagggttccccgccctcccacttccaccagcgctgccacatcttgcttggtcaccctcccacgacgggccctgccagaggatttatgttcttctaccaggcctgggaggggaaaagggagaagaatccgggatgagaaggtcgcctggagtgagaagcaggcactggcctcgctcagaataggcgcattcacggaattggggggcgggggcggagctgctgttgggttaggggcagctggccctctctgccaagaaacagcaacagaaaaatggctaacacagcttcagcatggggcgcggcggtggggtaggagctggaaggaaatgaggtttagtgaattctaggcgccagggggcctcaagagagagaaggggaaccaggagccctaggttctaatcctgcttttgcagttcggcgggctgcctccttggggcttagttttcctatttgtatagtggggagggggtgggggggtggtccttcgtagttctcacggggcgtctccggggcctcgggagggtaagcgctcacctgctgcccctgcggggtccatggtggctccacggggccccagccgctcacccgccgccctctggacgagtccagtgctgctgtcgctggaaccctgcacacccctgctcctcggctcttgcgcgggttatatcctgtccaggccttatctccaaggccccgggccccggccccctgtttgctcggggtgggcgcacctgctgggcagatgtgggcttcccacgccccctgccatctcgggcgccccctggcggtcgctcctgagagcaggcgggaaacaggcgccaagccgcgcgttctcgtgcgcagtgggttttggtccactcgctgccacgccaccacgctcagccccgcaacagggcgcagcccctccctgccgcctgcggttgggcagtgcatgtctgtgtttgtgtgtgtggaggggtctgggggggttggcgagttgcaaagacagccacacagaagcctgtgtgcgtaggggagtgggccgaggtggggaagggcttctgtctgcagaggttcgcctggcaggaggagaggcaccaaacgcccaggctggctcacagaaactagcaggcgtgggattgtatcctgccgcagccactttttggccgaatgactttgggtaccagcgcttaacttttctgagcctcaatttcattgtctgtatgatgggggacaatcacagccttagtcttacaattgcagagaggattaaatgccacaatgcgtgaagagcatttaacactgtgcctgacatttaaggaagacctgtttttttctgtttaaattttgcatatttgtatctatgtatctattcttatttaccattctcttgtgggccgagcgcggtggctcacgcctgtaatcccagcattctgggaggccgaggtgggaggatcacctgaggtcaggagtttgagaccagcctgaccaacatggcaaaacccgctctctactaaaaatacaaaaaattagccaggtgtggtggcaggagcctgtaatcccagctactcgggaggctgaggccggagaatcgcttgaacctgggaggcagaggttgcagtgagccgagatcatgccactgcactccagccgggacgacagagcaagactctatctaaaaaaaaaaaaaaaaagaatctcttgtgtttcccagcaatcccactgtgatgagaattttttaattctgaaacatttcaaacatacacaaaaatagagagattagtaaaataaacctgtaactgtcttccccctccaagtgcctatcacccagaataagagctctgtaaatactgttgcttttctattttccttcctccctccaggctctgacacctccattctctgtccccaagcgccatgagaggccttctttgctggcccgtgttgctgctccttcttcagccctgggaaacccagctccagttgacaggtgaactggggcccagccctcaccagtgggaggaggggagcggaagcaggtcctccctctgcagccagctcctcctgctggggagagggaagcaagggctttggaacatatgggactgggtttaagttccccacttcacctttctgggcctcagtttcttcatctgtaggatgtggcttagttttgggcgcatgcagaactgcccatggggtgtttaatttggaaaaattatttgaaaacatggaaaaaaaccaggaaattttacataaaaatccctgtttagtatttctcttgaaaaaccagggatctgctgacatccaattcgcaggggcatggcctcatttggatgcagctacctgcccaatttaggagtgataggggctctttgggtctccagcgtcctaacccaaccagttcatccatgttccctgcctggtccctgcaggctttgagtttgcgacgcttccttgccccctcgtcaatgggtaataccgcctcagaatagccctcagatctgtaagatgagggaatttgtgaaatctcctagcccaggtgctaggcacatgccgggcgagtgcatctgtctaatctgcgtttgctgtgctgggcgctgttatgtcggcatagcggcatttcccctgggtttcctagggggtctcctcggaggtgaggctttgctgacctaggagagtcctccctgatctccccgcaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtggtgagttaggagggcgctggagtgaagctcgaactctcaatccaaatgcttggattcctttcccaccacagtaaatcccatcccgtgggggtggccccgcgatttccaggtagagttgccctgacctaccgcaggctgtgtcagatttcagctctgaccacttctgctcagcctccatcaacaaggagcaacctataatttcttgccctacccgccacagcttaccacaggcttaatgtcaaattccagcaccaaccccctgcacacacggaaccagtgattctcaaagctaagagggatcggctgctccaaagagtcgtggccctcccacatggggatgacttctcccattatcatcttagctcctcccacaaatgctgcaagatctgttctgatctgttttgagtttattccgcccacctcgacttagcacctctccaccttcctacccactcctgcccctgtgtagtcctgtcccagcccactgacgtgtctaattgagtgtctcctcttctgagcctactcacaggggctccttaagccttattctttccctaagccctctcacttggtacggcccttctcaaattagtcatttccttctgaaagccatttgagggtgatgcctgcctctgaccccatccccatccagctctctcttgttggaggcttctgcccatctgttccctactgattctagtcctgtgtgtcctcagggaaggaccagtgtgctgaggggggacatggttgccagcaccaatgtgtcaatgcctgggccatgttccactgcacctgcaacccaggctacaagctagcagcagataacaagagctgtttggatgacagctatccctgtcctgcaatctcactgctcctgaaccttctttggctctccattgccccaacatcagaccaatgagtctggaagggcctttggcagtaaaagcacacctccatcactttacaggcctaagaaagaaaggtattgcctggggtcacataagtccctggtgggagcccacagttcagtgtgctttctgccctctttctccctgttttcaggccagtctctaatcaacctcccaaacttgtttctgttttcttcttttcttttctctctctcttttttttttttttttttttttgagacagagtctggctctattgcccaagctggagtgcaatggtgcgatcttagctcactgcaacctccgcctcccgggttcaagtgattcttgtgtgtcagcctcccaagtagctgggattacaggtgctggccaccacacccagctattttttgtatttttagtggagatggggtttcaccatgttggctaggctggtctcgaactcctgacctcaagtgatctgcccgccttggcctcccaaagcgctgggattacaggcgtgagccactgcgcccggccatttctgtcttcttacaggcacatccttacagtttctcttcttagatactgttggggggtcttcaattaggtgggtgtcccccctcatgccacccattcttgactctgcacctcagctctttgtgtgctgctcacctgagctgcccttgccactcccctctgcctttgcaaatctttcaagactctctctttttaagagatagggccttgctatgttgcccaggctggtctcacactcctgggctcaagagatcctcccgccttggcctctcaaagtgctgggattacaggtgtgagctgcttcttcatttttgtcttctgaaaagctatggcatagaatacctcgcttattcaattcagttttttactgagtaccaagttagtattagacattgtgctaggagcattacacatgttattatctctcagcctcacaacaacctggaaaaagaaatcatgtaatcccaataacccagatgtcagctggggtcttcttgtttctagaaactaaaagttggcttgaactctgatttgatgactgtttaacattcaaatctctctccaagacctctggaaatcccccaagtgcttatcttctggttgtcacctcttgctgtgagcctctgctaaattcatttgatttatggatcctctctcatttctcaaccctgcacatgctgttcttgttccatgcatgttaatcaacctcttcgttggtttacacacttgtgtatgcaggggcatacacaagcgtgtatgtgctaagtaactcatagcgcgtgcacacacacacgaaaaactcattataattgaatattagacagctttgtttctgaaagtcctcagtcagcctagtacaagggatttttcacaggcagcctcaacccacagagttactcatcttcatactggctctcttgttcttttttttttttttctttcctctctccactctcatctcctttccaggaaccccaaatactcacttttttatacagggtaattatcttctctccagtccagctctcggccatctttgcctatccagatcatcaagatgctcaacagggcaatagttccccatcttccatggaaggaagctgtgaatagcaatcactgtcttccattatattcccattttgcaaatagaaaaatggaggctcaaataggtaaagtggccaaacctgtcctctgtaagtcagagagcatcttgaggacaggggccctgactaattaggtcaggatttttggggttggggcccaggcgtaggtattctttaaaatttccttaggtggttgtgctaccagagctgagaagggcagtcctgggcatagactgaccccatttcttcctcagccattgatctgtgtgctgaagggacccatggatgtgagcaccactgcgtcaattccccaggctcctatttctgtcactgccaagttggctttgtactccagcaggaccagaggagctgcaggggtgagcaacacccccaccctcccaccacaccctggactgtggcctccgagggctccaatcagaggcaacatcttgctgtttcttccctcctgccagccattgactactgcagctttgggaaccatagctgtcagcatgagtgtgttagcacccctggtgggccacggtgccactgcagagagggccatgacttgcagcctgatgggaggagctgtcagggtgaggagggctctcctacatttgtgggaggggtaagagatcttagctggtggggtccatcctgactcatcctgacctgtctctcctttcagtccgggacctttgcaatggcgtggaccatggctgtgagttccagtgtgtgagcgagggcctctcctaccgctgcctgtgccccgaggggcggcaacttcaggcagatggcaagagctgcaaccgtgagtgatgggcgggagggtgttctgttggcttctgccccattgcccacatttggagtgtccttgactttgccattgctgtggcccctaggctgtggtgtgaatgtctgtgtgtgttgtgggggtgacattggagggtgtgccattccctccttccatctctttcctacaatcctctactctgctgtcaatgttaatttaaaaatacatatttgatcacattcctcctttgtgcacaagccttctgtggctcaccaatgactacaggagaaagatcaaatgacttacccctaagtatttcaaatggtgagcagaaccacattaatgaataatgaaatcaaattactgggttacaaccaacattaaaaaaaaaagagtggaagacaatatagagtttactgcctgtagaaagagttatattatttctgaaattttagttctgtgtgaaatgtctcatgatgtattgtcattattattatttttactgtgggctgtgataaaaattttgaaaccactgccttaggtcatcacgatctagcttcagccaactccatctgcccatctcctgccacacttgaacatttcagtcttactggcctgcccctccccggatgtgtcaggatctccccagatcccaagcctctgcacgtgctgcatctcaccttctagactgtcccttactgccttggcaaactcctactgatctttcaagactgtcttagatcattcaggctgctatatcaaagtactgtagactagacatttagttttcacaattctggaggctgaggagtccaagaccaaggtgccagcagatatggtgtctaaagaaggcctgttttctgattcttagatggcacacctttcaaagcctccccacgccaacacacacacacacacacacacccctacacacacacacccacacacaccaattttcttgctgtgtcctcacatggtgaagacaggaagcaagccctcttcgacttttttttttttttttttttttgagactaagtctccctctgtttctcgggctggagtgcagtggcgcgatgtcggctcactgcaacctctgcctctggggctcaactgattctcctgttacagcctctggagtagctgagactacaggtgtgccccaccatgcttggctaatttttgtatttttagtggagatggggttttgccatctcagccaggctggtctcgaactcctaacctcaagtgatctgcccgcctcagcctcccaaagtgctgggagccaccatgcctgacctcttcagactcttacaaggacagtaattttactcataagcgctgtaccctcatgtcctcatctaatcctaattaacctccaaagatctcacctccggagactatcacataaaggcgtagggtttcaataaatgaattttgggaaacacactcattcagttcataacaaagatcagatagaaggccatcatctccatgcagccttccttaacaactccaggaagaatacactattcctaccttgggatccctgcatgatcttctcttctagcactttccttgaccagagcacatagcatgtctgacttgctctgctctgtcctcatggaacaggattatgttttaattatttcaaaacctttgaaaacctccccacgccaacacacaccacattttgggcctagcaactttcctggctcagaataggggaggtgacattgtagagtcattcaggagcatgggttttggagtcagatggacctggcttcatgtcttggctcagtcagtactagctatgaaatctggggcaatcactttatccatcagaacctcaggtcatagaaaatggggacaatattcaagcttattgggaggattgagaatatatataagcacttcacccagtacctaccacatggtaagctgtcggtaaataatgtttttgttattattattgttaatactggtagagtgcttagaagtgtgcctgatacatagtagatgatcaataaatggtagttattgtggtcattactatgattgttgttaaaaaaagatgcttttagcagagtggtttgttctaagcactgaataaatgtcaagggcgatgatgagggtgatgatgatggtgatggtgatgatgatggtgataattattattacttagcacactgcctggcacaggaaggactcaggaaatgttgtctgttatataataaatgtttgcgaatgaacgactagatggatagacagctgctgccagtccagaatctggtccctcaattcaagcttttctggctgtgcagggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggtgggcttggcatgggacacagtgggctggggttgggtcagacgctgggaggcagctttcccgaggcctggggcaccctctgagaccccggccttgcaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccaggtgagcgcatctctctcggggctcctcctctctctcattgcccgtcctctgatatctccccttcctattcactccctgcccactttgtagttatagccagaggttgggctcactagacagagctttgctactccaaatgtggtctgcaggccagcggcagggcggtcacccggtagcttcttagaactgaaacatttctggtgctctccagaccgaatgaatcagaatttccacttcgacaagattctcaggtgatttgtaagcatattaaagtctaagaaatcctagactaggctacctgtcccccaaatcagtggaggttcagaataatttgggaaatttttttgaaggcacaccagacagcatttgtaagtggagccacagcatatatccctgaacttgttagaattcaaccttatgaacttggcaaagtggcaggactgaatatattttaagtatgcaaagactttttttttttttattggggacaacatacctcataagtgcaatccctctacttcatcatctggtgctcagctgaggaaaaagagactgactctacctgtgaagaaggggactcttgaatcgcatgcagtgtactgtgctctaggtgatacagggaatgtctccagggtaacttttaccctagagactttagacactagcccaggcttaagatgtgactcttcttcccatttatcagactgcagctccagaaacagactaagtagggctggtttgggtctggagaatttgcctttttttttttttagatatatgtaggggggctgggcgcagtggctcacacctgtaatcccagcactctgggaggccgaggcggctggatcacttgagatcaggagttcgagaccatccttggcaacatggtgaaaccctgtctttaccaaaaaatacaaaaattagctgggcaaggtggtgggcactgaggcaggagaattgcttgaacctgggaggtggaggttgcagtgagccgagattgcactactgcactccagcctggtgacagagtgagaccctgtctcaaaaaaagtatatataatatactatatatactatattatataatatgtgtttgtgtatgcatgcacatgcacgtgcatgtatatacacatacaaatatacacatacagtccttcccccaactctccttccctccccgctctcagccaattctaattattgtggctctttcagattaggggctctttcagagctcttcctatgtgactcttatgggccctgcagtgtgactttggacgagtcacttaccccacacctaccttaacttttctcttcggtaacaggagaggcactggctgcccaaggttacctctagttctagagttctaagagaagtctgggttttgtggttgaagctctttatcaattggtggtatgactgttccctgtctccaaccctttgtttagagaaacaaatctgtgaagttaggggtctttgctggattccagcagtttgttcatagtacatataagactaagatgaagagacaacttttaaatcattatggcagtgttttcaaaggttaaatggcaggtattgtgcttattatttcaccacgtgtaatcctttttcttttttttcctaaggtacttttattgtagcattttttttttctatgtcattccctgtaatctttttttttttttttttttttttttttgagatggagtctcgctctgtcatccaggctggagtgcagtggtgcgatctcggcttactgcaacctctgcctgccaggttcaagcgattctcctgcctcagcctctcgagtagctgggacaacaggcgcatgccaccacgcccggctaattttttctagttttagtagagatggggtttcaccgtgttagccaggatggtcttgatctcctgacctcgtgatccacccgcctcagcctcccaaagtgctgggattacaggtgtgagccacagcacctggcctccctgtaatcttaacaatggcacatgcttatagaatttcagtgaatctaagataccattcattttaagattcatcactaccttatgtactgctaagaaaaaacatgtgccagttttaattgtaaggcctcctgcccaacccccaagatgttgatgtgtggggagatagagttggatcaggatcagtggttcctaaaaattaggtcacaccagaatcacctggtggacctttaaaaacacaaattgcagctgggcatgatggctcatggctgtaatcccagcactttgggaggccgaggtgggcagatcacaaggtcaggggatcgagaccatcctggctaacacagtgaaaccccgtctctactaaaaatacaaaaaattagcagggcatggtggcacatgcctgtaatcccagctactcgggaggctgaggcaggagaatcacttgaacccaggaggcagaggttacagtgagccaagattgcaccactgcactccagcctgggagacagagctcaaaaaacaaaacaaaaacaaacacaaattgctgggcttcaactctagattttctaattcagcaagtctggggtgttgtctgataattagcatttttgataaattcctacacgatgccgatgctgctggtccaaggaccacactttgagaatcactggtctagttgaaatacactataaagcagtggtttccaacctttttggcaccaggcagtggttttacggaagacaatatttccatgatggtggtggggagaatggttttgggatggttcaagcacattacatttattgtgcactttatttctattattacattgtaatatacaatgaaataattatacaactcaccataatgtataatcagtgggagccctcagcttgttttcctgcagctagatggtgccatccgtgggtgatgggagacagtgacagatcatcaggcattagattttcataagaagcctgcaacctagatccctcacatgcacagtttacaatagggtttgtgctcccatgagaatctaacaatgccactgatctgacaggaaaggagctcaggttgtaataggagcaatgaggagcagctataaatacagatgaagctcccttgcatgctggctgctcacctcctgctgtgtggcccagttcctaacaggccatgggctggtactggtccatgtaatgtgctggtactggtccatggcctggggattggggacccctgctgtaaagtatttacttgaaccaggcagtgttctagatctgtgctttttcaaaaaggtaggcagtacctatttaattacaattgattaaaataaaatacattttagtcctttagtagcaccagtcatatttgaagtgttaaacagccacatgtggcttgtagctactgctttggacagggcagatgtagaacactttcatcattgcataaaattttatttggagagtgctacacaaagtgtggtccacagaccaggagcatcagcatcatttgggagcttattagaaatgtaccttctgagcttcttctccattctgaagcagaatctatattttaacaagctctcctgatgattccaatgagcattaaggtttgagaaacagtcttgtaagttgtgcgtgagcacacacacacacacacacgtacacaggtgaatgaatcctcgaagccactaatgcgtacactctttcattatatccattttatagatgagaaaactgagcttagaaaggttagtgagtttttcagtatctcacagctacttagcttgggactcagcccaggtctctctaaatccaaagcccatatactcaaccataggcccagtgcagggaaatcagagggccaaagctagggcaatttctcatccccctgaccctctgtgtccggcttgcagaggagggcatcagcgcagggacagagcttcggagcccatgcgaatgcgaaagcctcgtggagttccagggccgcacgctgggggcgctcgagagcctgacgctgaaccatatcctttggggctggtggcgcgggctggagggaaagtgaagggacctcggcgaaccccaacggcctccttaaccgctcactggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggggtccgtttttgggtcttgctgcgccgcctgggggaggggaagccagacggagcgtgctgtggcggcgcccgggcggcgtctccttggagaaaggcgcattgtgcgggggtcgggctcgggggcaggagacccggcgctgcttccccctgcttgtttattcagccgagaacagatggctccttatgcaggctgcgggaagggagggggctcaacaggaatccttggggtctgagtaagtctgcgccactccattccccagcggactgaacgcttcgctcccggccacgcctatcccatgatgcccccaaatctggctcaaaagctgctagtactgagcgctggtaaggggtgcgggggtggcgttggtgggaaagtgagaggcagtaattgaacccctaaatggatggggtgggagtggatagatgagctttgaccgattttaactctctcctgcactaggtaggaagagaaggaggtatcagctaggacccctgtctgtccagcctgtggccttccttctgtcatcttatcaacccctcccaaaacacctctatcagcaaagaacacaaaccagtaccatttcccgagtgcatgtaagaaacaacgaagtttaaaatgcttccagtcctagagtgatttggggaaaattattttgtgtttgtttcctcatctgcaaagtggagactggaattgttacccccaagcgtgatggggagaatcaaggacattcttctaaggcatgtgccttgtacctatccctcaattaatggtagctattaactgttcttatagtaacagctaacatatttagtgttgggcattattgtaactgatttgcaggtattttcattttatacttggaaccagtgaaataagaattattgcctttatcatccccattttacagatgaggacactgagacacagaaaggttaagtttccaacagtaacataaccagtacgaagctgaaccaggatgtttcctatggctgctctaataagttaccacaaattgagtggctagcaacacacatttattaccttacagtttttaggtcagaagtctaagatgtgttggcaaggctttattccttctagaggcttttgtttcctggccttttccagcttctagaggctacctgaattccttgggtcatggccctacatcacttcagactcagtttccatcagcacatctctttctctgactctgaccttcccgtctctgtcttataaggacccttctgtttatattggcatgaccttgataatcaaagataatcccatctcaagctatctttttttttttttgagatggagtttttgctcttgttgcccaggctggagtgcaatggtgcgatctcggctcactgcaacctccgcctcctgggttcaagcgattctcctgcctcagcctcctgagtagctgggattacaggtgtatgccaccactcccag

SEQ ID NO: 6451 - DNA, 1425 bp, Homo sapiens
gggttgaccaggacagttccccatctcagctggtgattgggacagagactccttgttctcctgcacacctggctcatggctcttacttggtgtgtggaggaaggaaaaaagaagaccttcaccatcacctctccccattcatttattcacagcacttaccaccctctacagtgatccccttggaagatgagctccatgagggcagggattgtgtgtatcttgtatatcttcatatgctcagtgtttgcacaatgtctggtgcacagcagggtttcaatgtatgaatgtgtgggatagtggcctggtagggcaaggttacacagcaagtccaggacagagcctaactctggagcctcagactatattctgccagtccaagcaagggaatcctgatttcggcctgagagatgcatcttctagcaaagtcaacatcgggatggctcctgagctttccttctcagaggggtgggcttcctacttccccctcccagactcccagtctgcaaggccaagatccatttccaggagaaaatcaatatttgatgttcccttccttccccagcattggttcagagctctggaaatctcctgccctccttacaccacgcagataggaaatctctcctttggcttttaccttctgggcccaggccacccactgctgccgtggattttagccatattattttctgctgctctgagtgccaacagcacactcagcactagacacaaacatgcaaagacgcagctcttgcctgccccaaaggcttgctgggtaagttaaacagactgtaaaatgcagacttcaaatatgccagaggcaaaggcatttaaaattctcagcgggggctggaaagagaacgcttttaaagtcttttcatttctccctcttcctttgccttcagcatcgagctgcctgtgagttgtcctgcctcttctgtctatgaccatttaaggatgactggtccttttgtgagcaggcaaaggctttgagatgttggctgtgaatgtggacagctcttcccaggctgcctgaaagagcggaggcagctaaacttggcaacaaatatttccaagcctgctttccattccatcatgcagaatggtgttattaaattgatgattcaggatctcaaaccagcagagctctgtcctttgggagaaacataatccatatgacaggtttcaccagggctatttctgaataccagaaaccagtgcctaggacagtgtagatcagagagcaggtgagctgggtgctttgggatcagaagccacctgggccagagttttgcaggtaacactctgcagtggacatgcctgggtcaacctggtgcaccgagtccatgctgtgttcactttggtgtccttttctcctgacaagacttaacctggtgccatatctctcctaaagcatgtgaggag

SEQ ID NO: 6452 - DNA, 13216 bp, Homo sapiens
tggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctccatcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgcttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaataaataaataactgtccaggtgtggtggtacagccctgtagtcggagctaatcaagaggctgaggtgggaggatcgcttgagcccaggatatggaggctgcagtgagctatgatctcaccactgcactccagcttaggggacagggcaagtctgtctcaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtgaggtgaaccgacttcaaggaatgggtccttcccttcagagccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccttggcttggggagagactccaggaaaccccagcagggagcatttgacagtggattcgagtgatgcaagggggacctggactgtgacctctgtcacgggaacccggaggaggctgatggcttttgcggttgatgtgggaaggagagagagagaacaaccggaaacgtctgcttgctgggggaagtgtcatgtccgctcctccgctccttttcttctccccttaggagcggttcatggttccttttgttttttgttcttttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaatgagttgagcatggtagcatgtgcctagtcccagctcctcaggaggctaaggaaagaagattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctgagcactttgggaggccaaggcgggtggatcacctgaggtcaggtgttcgggaccaatctggccaacatggcaaaaccccgtctctactaaaaacacaaaaattagccaggcatggtggttcatgtttgtaatcccagctgcttggaggctgaggtgggagaatcgcttgaacccaggaggcatcagctgcagtgagtcaagatcgagacactgccctccagcctgggcaacagagcaagactgtgtctcacaaaaaaaaacaaaaacaaaaacaaaaaaaaactgtaggagcatctggtgggaggtggtggacggagaactgtgggtttggaagctgcgccctctccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccctgagagcagcagggcagcgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatccctcactatggatggaaacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttttgtttcgagacagaatcttgctttgtcacccaggctggagtgtagtggtgcaatctcagctcactgcaacatccatctcccggattccatttattctcctgcctcagcctctcaggtagctgggattacaggtgcctgccataatgcccagctcaattttgtacttttaatagagacagggtttcaccatgttggccaggctggtctcaaactcctggcctcaagtgatctgcctgccttggcttcccaaagtgctgggattacaagtgtgagccactgcacccagcctgaatttctccattcttcccacacaccctccccaggttctccttcctgacctctgacccttcttttgtttcttctttttttttttttttttttttgagatagcatgtcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaatttttttaaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaacaaacaaaaagaacctgtggatgagttcccacatggcttcctaacgggctgcggctctcctaggagtctctcgctcatgggaaaggcacaaactgaatgcggaaggaaatcccattgctatggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacttcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctctttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcacggtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactatgttgaccaggcttgtctcaaactccttgcctcaagcaatccacccacctcagcctcccaagtagctggaactacaggcgcatgccaccacgcctggctaatatgtgtgtgtgtgtgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctca

SEQ ID NO: 6453 - DNA, 39068 bp, Homo sapiens
caggaggcggggcgcctgtgggagccgttgagggcactttcccagtccccgaggcggatccggtgttgcatccttggagagagctgagagctcgaggtgagctgggctcgcggtcgcccctctcgctcgccctctttgagaaccacggcttccgacctccctggaaatggggggaacatggccgaggcgcgtgggaggccgcctcgtggaggccccggagcggcatcctcagcgccccagcgatccggtgcccattaggtgcgccttgaagccgaggcaagctccttcggggtgctgggctgcgggcaaagaattcggccctgtgaagagttgggttcggcctgtctcaggccctgcccacatcccatcacagggccgtggacttgaagccggaacgtgaaatccccatagactgaatgcatttcctttctacctgttctctctccccttttatttttatttttatattattttatttttaatttttattttatttttttgtagagacggggatttcgctatgttgcccaagctggtctggaactccggagctcaagcagtccgcccgccttggccccccaaagctctggaattacaggcgtaatgcactgtgcctggccttttaaaaaaaaattgaggttattttggggacagtagagcgtccagacacatcctaatttgcgtagctgctcagttttaaaaaatgcaatgcatttttacctcttagggtatgtgatttctggctggtaagctacaccgaatcttggctagcacagttgaattccatgtcagatttgtaaacgcaaatttgctctctgcatttaaatatattagatatatttaggtaactacatttaaatgtattgagacatttaaatacacttgccgtctgtatctaaatatctgaagtggaccaggtgcggtggctcacacctataatcccatcactttgggaggccaaggcaagtggatcatgaggtcaggagttcacgaccagcctggccaacatggtgaaatcccatttctactaaaaatacaaaaattagctgggcgtggtggcaggcgcctgtaatcctagctacttgggaggctgaggcaggagaatcgctggaacccaggagacagaggttgcagtgagctgagattgcaccactgcagtctagcctgggtgacacagcaagactccatctcaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaacagtaaagaggtttgtttatttcacaagggtttattgaaggcctacgatgtgttaaatgctgtaggaaatacccactaatttctcttttcatgtaggtttcccgccttctcttaacgagtgatcaattaaactgtttactgggaacttgctaagttaatgaacacacgggatacattctttggatgagcagacattgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaagagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacctgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtactctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgttttttttttctttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaagctgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatatacatatatatacatatatatacatatatatatacatatatatacatatatacatatatatacatatatacatatatacatatatacatatatatatacatatatacatatatatatacatatatacatacatatacatatatatacatatatatatacatatatatatacatatatatgtatatatatatttttttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaatagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaacaagaagtctgggtgtggtggctcgtgcctgtaatcccaggactttgggaggccaagatgggtggatcatgaggtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcacccagctaattttttgtatttttagcagagatggggtttcaccgtattagccaggatggtcttgatctcctgacctcatgatccacccacctcagcctcccaaagtgctgggattacagtcctgagccaccgcgcctggacttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgccgaggtgaaagttgcagggagccgaggttgtgccactgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataatacccatcacacagctttatagaaacagcatctattcaaaaataccagtatttccaaaatatttaaaataatatttaaagtaataataatatttaaataaataaatatatttaataaatatttcagtaaataaaataatatttaaataattctatacccatgtttttcaaaataaaccaataaaatagatagtatatattagacgtgttagtatatatatctgagacatgttaaaaatcacaactgaattctcacaagtcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcaccaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacagcatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttcttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagagttcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatccctcactatggatggagacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctcttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaactcctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcatgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaacaacaaaaaaaaaaaacaaaaagaacctgtggatgagttcccacatggcttcctaacgggctgcggctctcctaggagtctctcgctcatgggaaaggcacaaactgaatgcggaaggaaatcccattgctgtggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcagctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcagcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctttttttttcctaatattttgagacagagttttgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggcaccataatccaagtcagcaagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcactgtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaaatattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacatggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactgtgttgaccaggcttgtctcaaactccttgcctcaagcaatccacccacctcagcctcccaagtagctggaactacaggcgcatgccaccacgcctggctaatgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctgtaatcccaggtactcaggaggctgaggcaggagaattgcttgaacccaggaggcagaggttgcagtgagccgagagcgcaccactccactccagcctggacaacagagcgagactccgtctcaacaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctggacagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtcaataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacctgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtactctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaagggaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcgagagtttgccgacctaactcgggttgaaacttttggctttcaggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattctttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatagacatatatatacatatatatacatatatatacatatatatatacatacatatacatatatacatatatatacatatatacatatatacatatatacatatatacatatatatatacatatatacatatatacatatatatacatatatacatatatatacatatatatatacatatatatatacatatatatgtatatatatatattttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttacataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccactgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctc

SEQ ID NO: 6454 - DNA, 39110 bp, Homo sapiens
ggggcgcctgtgggagccgttgagggcactttcccagtccccgaggcggatccggtgttgcatccttggagagagctgagagctcgaggtgagctgggctcgcggtcgcccctctcgctcgccctctttgagaaccacggcttccgacctccctggaaatggggggaacatggccgaggcgcgtgggaggccgcctcgtggaggccccggagcggcatcctcagcgccccagcgatccggtgcccattaggtgcgccttgaagccgaggcaagctccttcggggtgctgggctgcgggcaaagaattcggccctgtgaagagttgggttcggcctgtctcaggccctgcccacatcccatcacagggccgtggacttgaagccggaacgtgaaatccccatagactgaatgcatttcctttctacctgttctctctccccttttatttttatttttatattattttatttttaatttttattttatttttttgtagagacggggatttcgctatgttgcccaagctggtctggaactccggagctcaagcagtccgcccgccttggccccccaaagctctggaattacaggcgtaatgcactgtgcctggccttttaaaaaaaaattgaggttattttggggacagtagagcgtccagacacatcctaatttgcgtagctgctcagttttaaaaaatgcaatgcatttttacctcttagggtatgtgatttctggctggtaagctacaccgaatcttggctagcacagttgaattccatgtcagatttgtaaacgcaaatttgctctctgcatttaaatatattagatatatttaggtaactacatttaaatgtattgagacatttaaatacacttgccgtctgtatctaaatatctgaagtggaccaggtgcggtggctcacacctataatcccatcactttgggaggccaaggcaagtggatcatgaggtcaggagttcacgaccagcctggccaacatggtgaaatcccatttctactaaaaatacaaaaattagctgggcgtggtggcaggcgcctgtaatcctagctacttgggaggctgaggcaggagaatcgctggaacccaggagacagaggttgcagtgagctgagattgcaccactgcagtctagcctgggtgacacagcaagactccatctcaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaacagtaaagaggtttgtttatttcacaagggtttattgaaggcctacgatgtgttaaatgctgtaggaaatacccactaatttctcttttcatgtaggtttcccgccttctcttaacgagtgatcaattaaactgtttactgggaacttgctaagttaatgaacacacgggatacattctttggatgagcagacattgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaactgttataaaactcttaaagtgggctgggcatggtggctcacgcctgtaatcccagcactttgggaggctgaggcgggcggatcacgaagtcaagagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagatggtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaagctgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatatacatatatatacatatatatacatatatacatatatatatacatatatatacatatatacataaatatatacatatatatacatatatacatatatacatatatacatatatatacatatatatatacatatatatacatatatatatatatatattttttttttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttatatttttagtagagatggggttttgccatgttgcccaggctggtctggaactccaggcctcaagtgatctgccctccttggcctcccaaagtgctggaattacaggcacgagccaccgtaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcaactggtgtttttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcaccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggctttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgggctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcatgaggtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccacccacctcagcctcccaaagtgctgggattacagtcctgagccaccgcgcctggacttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataatacccatcacacagctttatagaaacagcatctattcaaaaataccagtatttccaaaatatttaaaataatatttaaagtaataataatatttaaataaataaatatatttaataaatatttcagtaaataaaataatatttaaataattctatacccatgtttttcaaaataaaccaataaaatagatagtatatattagacgtgttagtatatatatctgagacatgttaaaaatcacaactgaattctcacaagtcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaaattaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtgacaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttctttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatcccccactatggatggagacacttaggtttagcaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaactcctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaaacaaaaaaaacaaaaagaacctgtggatgagttcccacatggcttcctaacgggctgcggctctcctaggagtctctcgctcatgggaaaggcacaaactgaatgcggaaggaaatcccattgctgtggaagtcccattgttaggaagctctgcttttctggagttcaaatttgcattcatgacgctttaaaccgtcagagctgggtgtgtcctcctacaacaaatcactttactctctctcctggttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctttttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggcaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcactgtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagccttccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaaatattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactgtgttgaccaggcttgtctcaaactccttgcctcaagcaatccacccacctcagcctcccaagtagctggaactacaggcgcatgccaccacgcctggctaatgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctgtaatcccaggtactcaggaggctgaggcaggagaattgcttgaacccaggaggcagaggttgcagtgagccgagagcgcaccactccactccagcctggacaacagagcgagactccgtctcaacaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctggacagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaatgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagatggtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatatacatatatatacatatatatacatatatatacatatatatacacatatatacacatatatacatatatatacatatatacatatatatacatatatacatatatacatatatatatacatatatacatatatacatatatatatacatatatacatatatacatatatatacatatatacatatatacatatatatacatatatacatatatatacatatatatatacatatatatgtatatatatatatatatttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacgtgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctc

SEQ ID NO: 6455 - DNA, 24218 bp, Homo sapiens
caggaggcggggcgcctgtgggagccgtggagggcactttcccagtccccgaggcggatccggtgttgcatccttggagagagctgagagctggaggtgagctgggctcgcggtcgcccctctcgcgcgccctctttgagaaccacggcttccaacctccctggaaatggggggaacatggccgaggcgcgtggcgaggtcacctcgtggaggccccggagcggcatcctcagcgccccagcgatccggtgcccattaggtgcgccttgaagccgaggcaagctccttcggggtgctgggctgcgggcaaagaattcggccctgtgaagagttgggttcggcctgtctcaggccctgcccacatcccatcacagggccgtggacttgaagccggaacgtgaaatccccatagactgaatgcatttcctttctacctgttctccctccccttttatttttatttttatattattttatttttaatttttattttatttttttgtagagacggggatttcgctatgttgcccaagctggtctggaactccggagctcaagcagtccgcccgccttggccccccaaagcgctggaattacaggcgtaatgcactgtgcctggccttttaaaaaaaaattgaggttattttggggacagtagagcatccagacatatcctaatttgcgtagctgctcagttttaaaaaatgcaatgcatttttacctgttagggtatgtgatttctggctggtaagctacaccgaatcttggctagcacagttgaattccatgtcagatttgtaaacgcaaatttgctctctgcatttaaatatattagatatatttaggtaactacatttaaatgtattgagacatttaaataaatttgccgtctgtatctaaatatctgaagtggaccaggtgcggtggctcacacctataatcccatcactttgggaggccaaggcaagtggatcatgaggtcaggagttcacgaccagcctggccaacatggtgaaatcccatttctactaaaaatacaaaaattagctgggcgtggtggcaggcgcctgtaatcctagctacttgggaggctgaggcaggagaatcgctggaacccaggagacagagattgcagtgagctgagattgcaccactgcagtctagcctgggtgacacagcaagactccatctcaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataatgtaggggacttgatgaagggaaaggatcggagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcgtggtggctcacgcctgtaatcccagcactttgggaggctgaggcgggcggatcacgaagtcaggagatcgagaccatcctggctaaaacggtgaaaccctgtctctacaaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaacaaaaacaaaaaaaaaaaaactcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagcgtgcaatgctgcaatctcagctcactgcaacctccgcctcccaggtttaagtgattcttctgcctcagcctcccaaatagctgggattacaggcgcccaccaccatgcctggctaattttttgtatttttggtagagacagggtttcacgacgttggccaggctggtctcaaactcctgatctcaagtgatccgcctgcctctgtgtcccaaattgctgggattacaggcatgagccaccacaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagaaccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactgcggtgaagaagatagtagaaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtccggagttcaagaccagcctaaccaacgtggtaaaaccctgtctctactaaaaatacaaaaattagccagatgtgatggtgcatggccgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaggaaagaaaaaaaagaaaatgacaaaattaaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgtgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggtcagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaactttaaaggcttaagtaagttaactttctaatcctattataaaataattgggccacatgtcttagaattttgagtaacactgtcttgggaaacacaaaaacagttttctaaagccagttactagatatcatgtatatttgttgttatagcacttgagatgtcttagtccttactttacagtctctttcagctctgaaacatcacacatctaagattcaagagtttgccgacctaactcgggttgaaacttttggctttcggggggaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacagaacatatagataataaatgatagttaccattggttttcattatcaatttttagggaaacatttcaccaaagcactatttaattatagcacagatactaaatttttataaatgattacatgcacacacacacacacacatatatatatacatatatatatatatatatatatatttttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaattttttaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaaattgactgggcatggtggcatgcacctgtagttccagctacttgggaggctgaagtgggaggatcacctgagctcaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaacaagaagtctgggtgtggtggctcgtgcctgtaatcccaggactttgggaggccaagatgggtggatcatgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggcccacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttctttctttttttttttttttttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccgcccacctcagcctcccaaagtgctgggattacagtcctgagccaccgcgcctggactttttttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaataaatatgttcaaataagcacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctccccttcagcagcacgtgtaataatagatacaaagattgaaaggtaaaagatttaggatgaaaagaatcctctcttaaaaaggaaaacaaaattatatgtatgtgtatacaacagttataacacccatcacacagctttgtagaaacagcatctattcaaaaataccagtatttccaaaatatttaaaataatatttaaagtaataataatatttaaataaataaacatatttaataaatatttcaataaataaaataatatttaaataattctatacccatgtttttcaaaataaaccaataaaatagatagtatatattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccataagaaataggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaatgtgacaacatcacgaaccacgagtccagaagcctaatccataatcctccctcctcatgacaaagtctcatgctctgtgctcaacatggttagctgcacaagatgtaaaccaaagcttcactgaaccctcgacccagatcggtaactcaagtgcatcaatcataatgaacctccccgaactcagtagttatgattatttttgaggcagggtctcactctgtcgcctgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcacggagcaagggtatatgagagcgggtctcctcgtacaggaagtagaagatgttttgtttgggggcctcatcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccatgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacaccagacgcggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaagaggctgaagcataagaattgtgtgaacccaggaggcggaggttgcagtgagccaagattgggcccctccattccagcctgagagacacagcaacactcttgtcttgataaataaataaataaataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaagcaattgaatacactgatattttgccaggaccctgccttctacaggcatctagtctaatgggactgggagtaatcaggggagatgacctaatcccaatgtcacgttataataggatgtaactggagagctacgggcatgcagaagttggaagatgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctgaactgtggcctctgtcatgggaacccggaggaggctgatggcttttgcggttgatgtgggaaggagagagagagaagaaccggaaacgtctgcttgctgggggaagtgtcatgtccgctcctccgctccttttcttctccccttaggagcggttcatggttccttttgttttttgttcttttttttttttttttttttttttttttttgagacggagtctcattctgtcgcccaggctggagtgcagtggtgcgatctcggctcactgcaagctccgcctcccaggttcacgccattctcctccctcagtcctcagagtagctgggactacaggcgcccgccaccacacccggctaatttttgtatttttttttttttaagtggagacagggtttcaccatgttagccaggatggtcttgctctcctgaccttgtgatccgcccacctcggcctcccaaactgttgagattacaggcgtgagccaccgcacctggcctgttttactcttgtatttgtacactggcattggagtttggtttttttgcctggtttttttttttttttttggcttttttttttttttttttgagaaaaagtctcactctgttgcccaggctggagtgcagtggctcaaccttagcatactgcaacctccacctcctgggttcaaggggttctcttgcctcagcctcccaagtagcttggattacaggtgcacaccaacatgcccgactgatttttctatttttagtagagacggggttttgccatgttggccaggctggtctcaaactcctgacctcaggtgatccgcttgcctcagcctcccaaagtgctgggattacaggcctgagccaccatgcacagcctgagtttctttttagaaataacagtctaagatactataatcctgtcttttttgtacacagagtaaagaggacaaataggtgaaagaataaatgaaaggctggaatcccacttcccccgctgtcccagggcattggatattgatggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggagatagtggaatgggggtctggggaggggctgcccatcagagaagggacctcagcattggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggactcataggggaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctacgaaggtttcaaaaattagttgagcatggtagcatgtgcctagtcccagctcctcaggaggctaaggaaagaggattgcttgagcccaggaattagagtgagctatgatcatgccactgtactccatcctggggagcagagctggactcttgtctcagaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgcccttcagcctgggcaacagagcaagactgtgtctcacaaaacaaaaacaaaaacaaaaacaaaaaaaaactgtaggagcatctggtgggaggtggtggagggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagtgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatccctcactatggatggagacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaactcctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttttttttgagatagcatctcacgctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctctgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgaatgtctactgacattcactgtccgagattctgtactgggggtacacgcgtcctctgccctaaggcatctttgagtccaagagatactttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattacggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttctggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcgcaccattgcactccagcctgggcaacaagagcaaaactacatctcaaaaaaaaaaaacaaaaaaaaaacaaaaagaacctgtggatgagtt

SEQ ID NO: 6456 - DNA, 4418 bp, Homo sapiens
tttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacactccctcttccttttgcagccaagggacctacgtggggggctgggatctaccccaggggctgagtaaagaaaccaggccaccgtgtaatgcttctgcaactgatcacgttagaccccgaccccaaaccccaaaccattctccatcctccccagcctctcagactgctggcttctccaagccacctttctgactttctcctctgctcaaccccatgtgccactccttcccctccccattcttccctctctctgtcctcagaacactgcgtcatatcgttccctggtccctggctctctgaggccctctttttttttttttgtttcgagacagaatcttgctttgtcacccaggctggagtgtagtggtacaatctcagctcactgcaacatccatctcccggattccagttattctcctgcctcagcctctcaggtagctgggattacaggtgcctgccataatgcccagctcaattttgtacttttagtagagacggggtttcgccatgttggccaggctggtctcaaactcttggcctcacgtgatccgcctgccttggcttcccaaagtgctgggattacaggtgtgagccactgcacccagcctgaatttctccattcttcccacacaccctccccaggttctccttcctgacctctgacccttcttttttttcttcttctttttttttttttttttttgagacagcgtctcactctctcacccagactggagtgcagtagcacgatctcggctcactgcaccctcttcctcccaggctcaagcgattctcctgtctcagcctcccgagtagctgggattataggcacacaccactaccgcctggctaatttttgtacttttagtagagatggggtttcaccatgttggccaggctggtcttgaactgctgacctcaggtgatctgcccgcctcggcctcccaaagtgttggtgttacaggggtgagctaccgcacctggcccccttccttcgtcttagtcaatcctatgccacctcttcttcctccagtcccctcacctgatggtcccgacacttcatcatccaccacctcctggagggggtaccctgaggtgctccgctgggggctctgctcttcctggggctgcggttgatggctcgtcatgatctttcccaaaatctgtccaatctcaccgaagctagtctctgttctgtccttggtcttcttctggacactgctgggatccagaagagtgtgttatcaattctcgaggctgggagaagtcaggagtggagaacagctctgagaagttactgttgttcacctgaactgccaggcgccgacagagtccggtccttccaatcaggaaggtcggaatctctgatgtcataggtcattccaacctggcaaccagtttgaacaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaactagggtaagcagaaacgatgaaaccttataagagtgagagtatcatgtacaagagatcccaggaacattgacttgatgaaaaagtcacatcagagcactcaatttggcagagcttttctgccgaatgtttactgatattcactgtccgagattctgtactgggtgtaacgtgtcctctgccctaaggcatctttgagtccaagagatattttgaggactggaaatcatcggaaactgcccatgagctcacacatatttccaatggtgtccccagtttcagggagtccacggatcacctaaagccagcccctccagtttggctaagaaactctatatatcaagttttgtatcatatgtattgctcttaactcagaaattccaccatttatagcagtggtttatttatttatactattgaaggaaatggtttatttatgaatctatattatggatattctataagatactgggtgtacaaaaagactaagtcgaaaaatctcagctgtgcacagtggctcatgcttgcaatcccatctctttgggtggccaagggaggaagactgcctgaggccagcagttcaagaccagtgtaggcaacatagcaagaccccatctcaaacaaaacaaaacaaaacagaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcgggggcagcagaatggcttaaacttgggaggcggaggttgcagtgagccaaggtcgcaccattgcactccagcctgggcaacaagagcaaaactacatctcaaaaaaaaaaaaaaaacaaacaaaaagaacctgtggatgagttcccacatggcttcctaacgggctgcggctctcctaggagtctctcgctcatgggaaaggcacaaactgaatgtggaaggaaatcccattgctgtggaagtcccattgttaggaagctctgcttttctggagttcaaatttgcattcatgacgctttaaaccgtcagagctgggtgtgtcctcctacaacaaatcactttactctctctctctcctagttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggcgcggtggctcacacttgtaatcccagcacttttggaagccgatgccgacagataaccagaggtgaggaggttgagatcagcctggccaacatggtgaaacctgtctgtttttctgtaaaaatacagaaacaatgagctgggtgtgggagtgcacttctgtaattccagctacttgcggggctgaggcaggagaatcacttgaaccgggatggtggaggttccagtgagccgagatcacgacactacactccagcctgggcgacagagtgagactccgactcaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatctaccactgcattccaggctgggcatcagagtgaggcctgtctctaaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaa

SEQ ID NO: 6457 - DNA, 45300 bp, Homo sapiens
tttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacctgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaagggaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcgagagtttgccgacctaactcgggttgaaacttttggctttcaggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattctttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatagacatatatatacatatatatacatatatatacatatatatacatatatacatatatatacatatatacatatatatacatatatacatatatacatatatatatacacatatatacatatatacatatatatacatatatacatatatatacatatatatacatatatatatacatatatatacatatatatacatatatatatacatatatatgtatatatatatatatatattttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgtggtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaacaagaagtctgggtgtggtggctcgtgcctgtaatcccaggactttgggaggccaagatgggtggatcatgaggtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccacccacctcagcctcccaaagtgctgggattacagtcctgagccaccgcgcctggacttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgccgaggtgaaagttgcagggagccgaggttgtgccactgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataatacccatcacacagctttatagaaacagcatctattcaaaaataccagtatttccaaaatatttaaaataatatttaaagtaataataatatttaaataaataaatatatttaataaatatttcagtaaataaaataatatttaaataattctatacccatgtttttcaaaataaaccaataaaatagatagtatatattagacgtgttagtatatatatctgagacatgttaaaaatcacaactgaattctcacaagtcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcaccaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacagcatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttctttttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatccctcactatggatggagacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctcttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtttcaaactcctggcctcaagtgatccgcctgccttggcttcccaaagtgctgggattacaagtgtgagccactgcacccagcctgaatttttccattctttccaaacaccctccccaggttttccttcctgacctctgacccctcttttttttcttcttttttttttttttttttttttttttttttttttttttgagatagcatctcactctgtcacccagactggagtgcagtagcacgatctcggctcactgcaacctcttcctcccaggctcaagtgattctcctgttttagcctcccaagtagctgggattataggcacacaccactaccgcctggctaatttttgtacttttagtagagatggggtttcaccatgttggccaggctggtcttgaactactgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctgcggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaacaacaaaaaaaaaaaacaaaaagaacctgtggatgagttcccacatggcttcctaacgggctgcggctctcctaggagtctctcgctcatgggaaaggcacaaactgaatgcggaaggaaatcccattgctgtggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaaaaaaaaaaaaaaaaagtgccagacagcccaggtttggtctgatatgttcagaaaaaagcaaaacagtcacctctcaccttttcttttcctgcaatgatgccgtttaatacaacaagggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctttttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggcaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaagtcactagaggccaggcactgtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaaatattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactgtgttgaccaggcttgtctcaaactccttgcctcaagcaatccacccacctcagcctcccaagtagctggaactacaggcgcatgccaccacgcctggctaatgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctgtaatcccaggtactcaggaggctgaggcaggagaattgcttgaacccaggaggcagaggttgcagtgagccgagagcgcaccactccactccagcctggacaacagagcgagactccgtctcaacaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctggacagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtcaataataataataataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacctgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcgagagtttgccgacctaactcgggttgaaacttttggctttcaggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattctttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatagacatatatatacatatatatacatatatatacatatatatacatatatacatatatatacatatatacatatatatacatatatacatatatacatatatatacacatatatacatatatacatatatatatacatatatacatatatatacatatatacatatatatatacatatatatacatatatatacatatatatatacatatatatgtatatatatatatatatttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgtggtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcatgaggtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgctgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgtgcccagctaattttttgtatttttagcagagatggggtttcaccgtattagccaggatggtcttgatctcctgacctcatgatccacccacctcagcctcccaaagtgctgggattacagtcctgagccaccgcgcctggactttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgccgaggtgaaagttgcagggagccgaggttgtgccactgcactccagcctgggagacagagcgagactgtctccaaaacaaacaaacaaacaaacaaaaaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataatacccatcacacagctttatagaaacagcatctattcaaaaataccagtatttccaaaatatttaaaataatatttaaagtaataataatatttaaataaataaatatatttaataaatatttcagtaaataaaataatatttaaataattctatacccatgtttttcaaaataaaccaataaaatagatagtatatattagacgtgttagtatatatatctgagacatgttaaaaatcacaactgaattctcacaagtcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacagcatcacgaaccatgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcagagctaatcaagaggctgaggtgggaggatcgcttgagcccaggatatggaggctgcggtgagctatgatctcaccactgcactccagcttaggggacagggcaagtctgtctcaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttctttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacagagggaccactgcagagtcataaaggaattcccatcatttcctcatgagacagtcacacatcagggtgtgaccatggccttgggatccctcactatggatggagacacttaggtttagaaaagtcagtaagaaacattaagtttcagagggcacagctgaaaccacttttttgatttttgattttgtttttctttatttgatttttatttttatttatttattaatttattttgagacaga

SEQ ID NO: 6458 - DNA, 4713 bp, Homo sapiens
cagactggagtgcagtagcacgatctcggctcactgcaccctcttcctcccaggctcaagcgattctcctgtctcagcctcccgagtagctggaactacaggcatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctcctaagtgtccctcatgagtgatcacttcagagtcctcccgcatggagagctcacccactggggcatatttttcccattggaaaagtgtggttattggaagtttcctctttttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacactccctcttccttttgcagccaagggacctacgtggggggctgggatctaccccaggggctgagtaaagaaaccaggccaccgtgtaatgcttctgcaactgatcacgttagaccccgaccccaaaccccaaaccattctccatcctccccagcctctcagactgctggcttctccaagccacctttctgactttctcctctgctcaaccccatgtgccactccttcccctccccattcttccctctctctgtcctcagaacactgcgtcatatcgttccctggtccctggctctctgaggccctctttttttttttttgtttcgagacagaatcttgctttgtcacccaggctggagtgtagtggtacaatctcagctcactgcaacatccatctcccggattccagttattctcctgcctcagcctctcaggtagctgggattacaggtgcctgccataatgcccagctcaattttgtacttttagtagagacggggtttcgccatgttggccaggctggtctcaaactcttggcctcacgtgatccgcctgccttggcttcccaaagtgctgggattacaggtgtgagccactgcacccagcctgaatttctccattcttcccacacaccctccccaggttctccttcctgacctctgacccttcttttttttcttcttctttttttttttttttttttgagacagcgtctcactctctcacccagactggagtgcagtagcacgatctcggctcactgcaccctcttcctcccaggctcaagcgattctcctgtctcagcctcccgagtagctgggattataggcacacaccactaccgcctggctaatttttgtacttttagtagagatggggtttcaccatgttggccaggctggtcttgaactgctgacctcaggtgatctgcccgcctcggcctcccaaagtgttggtgttacaggggtgagctaccgcacctggcccccttccttcgtcttagtcaatcctatgccacctcttcttcctccagtcccctcacctgatggtcccgacacttcatcatccaccacctcctggagggggtaccctgaggtgctccgctgggggctctgctcttcctggggctgcggttgatggctcgtcatgatctttcccaaaatctgtccaatctcaccgaagctagtctctgttctgtccttggtcttcttctggacactgctgggatccagaagagtgtgttatcaattctcgaggctgggagaagtcaggagtggagaacagctctgagaagttactgttgttcacctgaactgccaggcgccgacagagtccggtccttccaatcaggaaggtcggaatctctgatgtcataggtcattccaacctggcaaccagtttgaacaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaactagggtaagcagaaacgatgaaaccttataagagtgagagtatcatgtacaagagatcccaggaacattgacttgatgaaaaagtcacatcagagcactcaatttggcagagcttttctgccgaatgtttactgatattcactgtccgagattctgtactgggtgtaacgtgtcctctgccctaaggcatctttgagtccaagagatattttgaggactggaaatcatcggaaactgcccatgagctcacacatatttccaatggtgtccccagtttcagggagtccacggatcacctaaagccagcccctccagtttggctaagaaactctatatatcaagttttgtatcatatgtattgctcttaactcagaaattccaccatttatagcagtggtttatttatttatactattgaaggaaatggtttatttatgaatctatattatggatattctataagatactgggtgtacaaaaagactaagtcgaaaaatctcagctgtgcacagtggctcatgcttgcaatcccatctctttgggtggccaagggaggaagactgcctgaggccagcagttcaagaccagtgtaggcaacatagcaagaccccatctcaaacaaaacaaaacaaaacagaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcgggggcagcagaatggcttaaacttgggaggcggaggttgcagtgagccaaggtcgcaccattgcactccagcctgggcaacaagagcaaaactacatctcaaaaaaaaaaaaaaaacaaacaaaaagaacctgtggatgagttcccacatggcttcctaacgggctgcggctctcctaggagtctctcgctcatgggaaaggcacaaactgaatgtggaaggaaatcccattgctgtggaagtcccattgttaggaagctctgcttttctggagttcaaatttgcattcatgacgctttaaaccgtcagagctgggtgtgtcctcctacaacaaatcactttactctctctctctcctagttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggcgcggtggctcacacttgtaatcccagcacttttggaagccgatgccgacagataaccagaggtgaggaggttgagatcagcctggccaacatggtgaaacctgtctgtttttctgtaaaaatacagaaacaatgagctgggtgtgggagtgcacttctgtaattccagctacttgcggggctgaggcaggagaatcacttgaaccgggatggtggaggttccagtgagccgagatcacgacactacactccagcctgggcgacagagtgagactccgactcaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatctaccactgcattccaggctgggcatcagagtgaggcctgtctctaaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaa

SEQ ID NO: 6459 - DNA, 20991 bp, Homo sapiens
gggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggctttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacggcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacggtcaaggccttgtcctctcttaggtccagagctcaggtgaatacagattttcccggccgtctgtgctgaagtccctgtggggaggctcctggctggtttcctgtaggtagacagctacacgtcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggcggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcaggggctggtggccttaacctgtggcatttgatgtaacatcagggagttgacatcagaattacgtcacacaggccaggtgcagtggctcatgcttataatcccaggaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttctttttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccgcccacctcagcctcccaaagtgctgggattacagtcctgagccaccgcgcctggactttttttttttttttttttttttgagaggggttggggagacatattctctgctagtgattctcctgcctggtctcgaactcctgctgggatcacaggcgtgagccaccacgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattgtcttccaaagctaataaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactgagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataacacccatcacacagctttatagaaacagcatctattcaaaaataccagtatttccaaaatatttaaaataatatttaaagtaataataatatttaaataaataaatatatttaataaatatttcaataaataaaataatatttaaataattctatacccatgtttttcaaaataaaccaataaaatagatagtatacattagacgtgttagtatatatatctgagacatgttaaaaatcacaactgaattctcacaattcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataaaagatttaggataaaaagaattgtctcttaaaaatgaaaagaaaattatctttatgtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccataagaaacaggacctccaggttccggcccagggaggttggcattcagcaatataaaaagggaggtggtgccgcaggaaagggtggaactggaaacactcctgttttcttacttttctccaaggactcctagaagtaccccaccccacccctgctccttggaggacaacgtgatcactgtattcagctcttgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctgtaccctgcttctgaaccatcgtgttcaactgtgaaactcacactttggtgaccctgactccaaaacttaatacacccaaggtcagccccagtgatctgcttcatagcaaggactttgggtgggtcttcccagggagtagggcaccctcagagaatgtggctttggacttcatcacagctggggccttttgtgtcacttcagatctaaacttgtaaccgtgctagatctgtttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccaaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaagtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataaataaataactgtccaggtgtggtggtacagccctgtagtcggagctaatcaagaggctgaggtgggaggatcgcttgagcccaggatatggaggctgcagtgagctatgatctcaccactgcactccagcttaggggacagggcaagtctgtctcaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagagccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccttggcttggggagagactccaggaaaccccagcagggagcatttgacagtggattcgagtgatgcaagggggacctggactgtgacctctgtcacgggaacccggaggaggctgatggcttttgcggttgatgtgggaaggagagagagagaacaaccggaaacgtctgcttgctgggggaagtgtcatgtccgctcctccgctccttttcttctccccttaggagcggttcatggttccttttgttttttgttctttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggttttcggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctgagcactttgggaggccaaggcgggtggatcacctgaggtcaggtgttcgggaccaatctggccaacatggcaaaaccccgtctctactaaaaacacaaaaattagccaggcatggtggttcatgtttgtaatcccagctgcttggaggctgaggtgggagaatcgcttgaacccaggaggcatcagctgcagtgagtcaagatcgagacactgccctccagcctgggcaacagagcaagactgtgtctcacaaaaaaaaacaaaaacaaaaacaaaaaaaaactgtaggagcatctggtgggaggtggtggacggagaactgtgggtttggaagctgcgccctctccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggctgcgggtgaggtggatgggagaggggagaatgactttcactgggcaagggagagaggctcctgctctgagactcccctgagaagaggccgaaggaggccctgggtgtgagaatctacaggacgtagagctgggaatcagccaggaccccctccagcagacacggagggaccactgcagagtcataaaggaattcccatcatttcctcatgagacagtcacacatcagggtgtgaccatggccttgggatccctcactatggatggaaacacttaggtttagaaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttttttttgtttcgagacagaatcttgctttgtcacccaggctggagtgtagtggtgcaatctcagctcactgcaacatccatctcccggattccatttattctcctgcctcagcctctcaggtagctgggattacaggtgcctgccataatgcccagctcaattttgtacttttaatagagacagggtttcaccatgttggccaggctggtctcaaactcctggcctcaagtgatctgcctgccttggcttcccaaagtgctgggattacaagtgtgagccactgcacccagcctgaatttctccattcttcccacacaccctccccaggttctccttcctgacctctgacccttcttttgtttcttcttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaatttttttaaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaacaaacaaaaagaacctgtggatgagttcccacatggcttcctaacgggctgcggctctcctaggagtctctcgctcgtgggaaaggcacaaactgaatgcggaaggaaatcccattgctatggaagtcccattgttaggaagctctgcttttctggagttcaaatttgcattcatgacgctttaaaccgtcagagctgggtgtgtcctcctacaacaaatcactttactctctctcctagttaacaggctttcaaatattagaacatccatgttctgacttcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagtctccgactcaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctcttttttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccagctaatttttgtattttagggtttcatcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggtaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcacggtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagcctcccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaattattcgatgagacttacatgtattacttaaatgaggttaaatttaaccttttaaaaatgatttattgtggctgggcacagtggctcacacctgtaatcccagcactttgggaggccaaggcagatggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactatgttgaccaggcttgtctcaaactccttgcctcaagcaatccacccacctcagcctcccaagtagctggaactacaggcgcatgccaccacgcctggctaatatgtgtgtgtgtgtgtgtgtgtgtgtgtgtgtgtgtgtgtgtgtgtagaaacaaggtcttactgtgttgtttaaactgctctcaaactcctgggctcaagtgatcctcccacctcggcctcccaaatcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctca

SEQ ID NO: 6460 - DNA, 8923 bp, Homo sapiens
gcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgcgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttctttttttttttttttttttgagactataatcctgtcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatcccccactatggatggagacacttaggtttagcaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctcttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaacccctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccacctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaaacaaaaaaaacaaaaagaacctgtggatgagttcccacatggcttcctaacgggctgcggctctcctaggagtctctcgctcatgggaaaggcacaaactgaatgcggaaggaaatcccattgctgtggaagtcccattgttaggaagctctgcttttctggagttcaaatttgcattcatgacgctttaaaccgtcagagctgggtgtgtcctcctacaacaaatcactttactctctctcctggttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaa

SEQ ID NO: 6461 - DNA, 30724 bp, Homo sapiens
gggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaaacaaaaaaaacaaaaagaacctgtggatgagttcccacatggcttcctaacgggctgcggctctcctaggagtctctcgctcatgggaaaggcacaaactgaatgcggaaggaaatcccattgctgtggaagtcccattgttaggaagctctgcttttctggagttcaaatttgcattcatgacgctttaaaccgtcagagctgggtgtgtcctcctacaacaaatcactttactctctctcctggttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaaaaaaaaaaaaaaaaagtgccagacagcccaggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgaggcctgtctctaaaaaaacccttcactccccaaaaaaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctggcaaggttttctgagcgtggtgaaatatgatctgggcctcgcttgggagggctgtggccaggccttgagtccgtggctcagtgggaccttctgaaacagcctccaatccgtgcccccacttcatttgctagtggatgaccccctccagcggctttggtgctgatgggaataagtcaacctgcagcggaagttcagcccaagtttcagcccagcagcttctacacacctgtccgtggtctggtcatgctgccatctctgcggttctctgcggttctctgcggagtcgtggtttctgtaccttgaagagaacttcccctctgggacccagaaacccagtgaatcctcaggaaaaaagggaatgaaattactgaagacaactctgtggcggggagatggaaaagaggctctctctctttttttttcctaatattttgagacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctctgttgccttggctggggtgcagtggtacaatcagctctctgttgcctcggctggggtgcagtggtacaatcagctctctgttgcctcctgggctcaagcaatcctcttctctcagcctcccaagtagctgagactacaggtgcatgcctgtagtagatatagcatcttgctctgttgcccagactggtcttgaactcttggtcacaagcgatcctcttgccttggcctctcaaagtgctggaattacacgcgtgagccattgagcccaaccagataagatgatctttaagggcccttcccatggcaccataatccaagtcagcgagactgtggctatagcaagtttaacataaccagatacgctagtattatgggctgcatggtgtgccccccacccctaattcatgtattgaagccatgaccctccagaccttagaggtgaccttattggaaccagagtctttacagaggtgatcaagttaaaatgaggtcactagaggccaggcactgtggctcacacctgtaatcccagcacttcgggaggccgaggcaggcagataatgagcccaagagaccgagaccatgatgtccaacatggtgaaaccctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacagagtgagactctatctcaaaaaaataaaaattaaaaaactaaaaacctacagtaccgccttttacataatgcaatggtttggtaagcacatgcaccccagggaggtagtggcagattcagtcaaccttcccagcagcgtggagacgcagtcaggcatagcaggtgttgatgtggtttgaacccacagcttggctcaaatccacactcccctacttagtaccgagtgaagccacttaccctctaagtgccttacttttcttttcttttcttttttcttttttcgagacagagtctcgctctgtcacccaggctggagtgcagtggcatgatcttggctcactgcaaacttcgccttccaggttcaagcaattctcctgcctcagccttccaagtagctgggattacaggcgcccaccaccatgccgggctaatatttgtatttttgatagagatggggtttcaccatattgcccaggctggtctcgaactcctgacctcaagtgatctgtctgcctcggcctcccaaagtactaggattagaggcatgagccaccacacctggccacttttcttatctatatttgttatgtggatgacttgtgttaacgcaaataagatgctgctcgtcatctttaaagaaaataggtggcaacctgttatagcaagtcctgtttttatttgtacttatgaggctttaattaaacgctaagaattaaaatgcacataataatagactttacctcacaaactggcttcaaatattcgatgagacttacatgtattacttaaatgaggttaaatttaaccttttaaaaatgatttattgtggctgggcacagtggctcacacctgtaatcccagcactttgggaggccaaggcagacggatcacttgaggccaggagttgaagaccagcctgaccaacacggcaaaaccccatctccgctaaaaatacaaaaattagccaggcatggtggtgcacacctgtaatcctagctactcaggaggctgagacacaagaatcgcttgaacccgggaggcagaggttgcaaggaggtgagatcacaccactgcactccagcctgggcaatagagtgaggctctgccttaaaacaaagaaaaatgattttgggggatgatggggtgtcactgtgttgaccaggcttgtctcaaactccttgcctcaagcaatccacccacctcagcctcccaagtagctggaactacaggcgcatgccaccacgcctggctaatgtgtgtgtgtgtgtgtgtgtgtgtgtgtgtgtgtgtagaaacaaggtcttactgtgttgtttaagctgctctcaaactcctgggctcaagtgatcctcccacctcggcctcccaaagcattggaattacaggtgtgagccacctcactgagccctccacctttcagctgaacgcagaaaagtacaatcttttaacccaaagcgttcctcacacttagggtcaggaagagcccttcatgccctggaggcaactactaaccctctgctaaacactctgactctgggtgtgagaaacacacctactgtgccccacatatttttccaaatacaacttaatttagccttcacgacaaccctggagtgaaggatcattaactttatttcatagatgtggaaactgagactcagaggcaggaaatgacctccttctggaggctgcaaattctttgatgctcctttgatcaacaggtgggagctggccagaggtggtggctcacacctataatcccagcactttgggaggccaaggtgggaggattgactgaggccaggagtttgaaactagcctgggcaacatagcaagacctcatctctacaaaaaatacacaaattagcagggtgtggtggtgcacacctgtagtcgcagccactcgggaggctgaagtggtagcattgcttgagcccaggaggttgaggctggagtgagccatgatcaagccactgcactccagccgaggagatggagatagaccctgtctcaaacaacaacaaaaaaataggtgaggatcagccaggcatggtggctcacgcctgtaatcctagaactttgggaggccaaggtgggaggattgcttgaggccaggacttcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctgtaatcccaggtactcaggaggctgaggcaggagaattgcttgaacccaggaggcagaggttgcagtgagccgagagcgcaccactccactccagcctggacaacagagcgagactccgtctcaacaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctggacagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaaaagaaaaaaaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaatgagtgatcaattaaactgtttactgggaacttgctaagttaatgaacacacgggatacattctttggatgagcagacattggttgggcagaggggcaagaggagagcagtttagacagagacctgcttatacactgtagtgtctaagagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataataataataatgtaggggacttgatgaagggaaaggatcagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcgacagagcaagaatccgtctcaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccacctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccggtggtactgagtctaagcactgcggtgaagaagatagtaggaaacagtctggatgctggtgccactaatattggtaagtttgggagagttttaagccacaagaaatgatcagtgaatgttgttgtagtcaagaaacatttgttattgaaataagactatcaagtgttgatgtagtaataaactattatttttaagttaaagttagcacctattatgtgcctagtacttagctaggtagtaataataataacgacagcttttcttgtgttcttatggtgtgccaggcaggtgttatgctaagaattgcacagaaatatctcatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagatggtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatacaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattacaaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgagaaaatatttttatccattcacttgaccccttagaaaaacctctctgaaaattaattggaatcattattatttacaattttctatctcaatatctcagcttctagcttctgaattctgttttgtctcactgccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattacagcacagatactaaatttttataaataattacatgcacacacacatatatatacatatatatacatatatatacatatatacatatatatatacatatatatacatatatacataaatatatacatatatatacatatatacatatatacatatatacatatatatacatatatatatacatatatatacatatatatatatatatattttttttttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttatatttttagtagagatggggttttgccatgttgcccaggctggtctggaactccaggcctcaagtgatctgccctccttggcctcccaaagtgctggaattacaggcacgagccaccgtaccctgccctacatatacattttaattataatatcttttggattctttaaaaaaaattttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcatggatctctcactgaacacaccatgcctggtattctctcacagtgatgtcaccatttctacctgccacgtatcggcgaaggttgggactcaactggtgtttttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacatgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcactacacttcagactgtgagacagagtaagaccctgtctggaaaaatatatatacatatatatacattttttttattttttatttttatctttttttgagatggagtctcactttggcaccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtcttgaattcctgccctcaggtgatccgcccacctcggcctctcaaagtgctgggattacaggcgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggctttttttttttaaagcttttttgtaagtcagccagcaagaacacaggaggaagtactcaaatctcccttacacagctgggggctgtgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacagaacagtggccacgaggggccccaacagaggaagaaaccaggtgaggtgtggtatagtggactcgactgccttctaaatctcagtggttgtccgggtgcggtggctcacgcctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtccaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagtttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcatgaggtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaagagaaagtatcatgcttttcagagttctgtgggttgttatggtgaattatcaaacctgaggacgtggtgggaacctccaaatttgcagccagttggtgagaagtacatgcggtctgtggacacccaagcttgcagctgcatctgaagcgagggcagcctagcgggggctggtggccttaacctgtggcatttgatgtaacatcagggagttgacatcagaattacgtcacacaggccaggtgcagtggctcatgcttataatcccagcaattagaaaggcaagataagaagattgcttgagcttgagtctgagcccacagtgagctatgaccgcaccactgcaccccagtctgggtgacagcacaagaccccgactccaaaaataaaaaagaaaaatcacaaagaattgcatggcagagtgcctgtctttcacagcttgaactgttgcaggaactttctttttttttttttcttttgtgatggagtctcgcgctttcacccaggctggagtgcagtggcgcgatctctgctcactgcaggctccgcctcctgggttcacaccattctcctgcctcagcctccggagtagctgggactacaggcgcctgccaccgcgcccagctaattttttgtatttttagcagagatggggtttcaccgtattagccaggatggtcttgatctcctgacctcatgatccacccacctcagcctcccaaagtgctgggattacagtcctgagccaccgcgcctggacttttttttttttttttgagaggggttggggagacatattctctgctagtgattctcctgcctggtctcgaactcctgctgggatcacaggcgtgagccaccatgcccagccacctttagagttttcttaccacctggttttcctctctcaatatctttctctcatttcctgctttaaaactctagcttggggtctgggcacagtagctcatgcctataatcccagcactttgggagactgaggcgggtggatcacttgaggtcaggagtttgagaccagcctggccaacatggtgaaaccttgtctctactatttttacaaaagttagtcagacgtacaggcggatgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaacaaacaaaaaaaccctgtagcttgggatcagccttctcttctgttgtttttctttaaaaaataaaaattaaaaataggcttcaagtgatcctcccgccatgacctccaaaactgctgggattgtaggtgtgagcactgcacccagccgtatgtttttttctacataaaaaacagcacaggattatcttccaaagctaacaaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatatgttaactaagtatcatagataaaaaccatgctcccttcagcagcacgtgtaataatagatacaaagattgaaaggtaaaagatttaggatgaaaagaatcctctcttaaaaaggaaaacaaaattatatgtatgtgtatacaacagttataatacccatcacacagctttatagaaacagcatctattcaaaaataccagtatttccaaaatatttaaaataatatttaaagtaataataatatttaaataaataaatatatttaataaatatttcagtaaataaaatatttaaataattctatacccatgtttttcaaaataaaccaataaaatagatagtatatattagacgtgttagtatatatatctgagacatgttaaaaatcacaactgaattctcacaagtcagtcacaaacctaaacagcaaataaaaatttctatcaccagaattatgtttttttctggtggggaactaccaatagctataaatagaagagattattatggaagtatcatagataaaaagagtgctcgcttcaggagcacatataataatacagaaaaaaatttaaagataataaaagatttaggataaaaagaattctcacttaaaaatgaaaagaaaattatctttaggtatatataacaactataactctcatcaaaaaactctacaggaacagcatgttttcaaaagtacaacaatttccaaactatttgaaataaacctattaataattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccataagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggttcctctcctccttcctgatgtctgccattagcattggaataaagttcctgctgaaaatccacatctcccctgggtccggtgttctggaagtgagagagacaatgtcacacttcaaggaggcagctctctagacaggaaggttattcacgtcccatgtcaagtctagctagagttcagagcaattgagaagtgcaattttatctcctgcctttcattctataccctgcttctgaaccatcgtgttcaactgtgaaactcacactttggtgaccctgactccaaaacttaatacacccaaggtcagccccagtgatctgcttcatagccaggactttgggtgggtcttcccagggagtagggcaccctcagagaatgtggctttggacttcatcacagctggggccttttgtgtcacttcagatctaaacttgtaaccgtgctagatctgtttctaacgtgacaacatcacgaaccacgagtccagaagcctaatccataatcctccctcctcatgacgaagtctcatgctctgtgctcaacatggttagctgcacaagatgtaaaccaaagcttcactgaaccctcgacccaaatcggtaactcaagtgcatcaatcataatgaacctccccgaactcagtatttatgattatttttgaggcagggtctcactctgtcgcccgggctggagtgcagtggcaggatcagggctccctgcagccccgacctcccaggctccagcgatcctcccgcctcagcctcctgagtagttgggagtagagatgcctcccacatcgcctggctaatttttgtatttttgtggagaggggatctcgccacgttgcccaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaacgcgctttgagaagacggggactccccaggatacccctctctcccctcgtccagcctccagcccacccgattcctccccacatcctccacgtccccaggccccacccacctcttccaactcctccagggaaacccaagccctgcagcgcatggaacaaaagaagtggaaccgatacttccggaacaaggctatctgagagcagttcttcctggccctcgggttcatgtaacggcataactggaaccaaagctcactgagcaagggtatatgagagcgggtctcctcgtacaggaagtagaagatgttttgtttgggggcctcgtcgtcctcctccatgtcattggccagatagctgaggacagaaatcaggttgctgctcaggggcaccaccaggagagacctccggctgaggtcagcttctcagagaggaaggtaagggaccgtccctagctcaggactggcacccaccctgcagagagccacgccttcctcaggagggctctgctggacagagacctgatcaagggcgtctcccactccttcaggatggagacaaaaacccaactggtgaccaagagtggtggcttatgcctggaatcccagcacactgggaggccgaagcaggaggatcacttgaggccaggagtttgagacaggcctgggcaacatagcaagaccctcgtctctattaaaaatataaaaaatacgccagacgtggtggctcatgcctgtaatcccagcgctttggaaggctgaagcaggtggattgcttgagaccaggagtttgagaccagcctggtcaacacagagaaaccccatctatactaaaaatacaaaaatcagcctggtgcggtggcacacccattagtcctagctactcaggaggctgaagcataagaattgtgtgaacccaggaggcggaggttgcagtgagccaagattgggcccctccattccagcctgagagacacagcaacactcttgtcttgataaataaataaataaataaataactgtccaggtgtggtggtacagccctgtagtcggagctaatcaagaggctgaggtgggaggatcgcttgagcccaggatatggaggctgcggtgagctatgatctcaccactgcactccagcttaggggacagggcaagtctgtctcaaaaaaaaaaaaaaaagcaattgaatacactgatattttgccaggaccctgccttctacaggcatctagtctaatgggactgggagtaatcaggggagatgacctaatcccaatgtcacattataataggatgtaactggagagctacgggcatgcagaagttggaagacgagggaaggcatcacagaggctgtggggtgaaccgacttcaaggaatgggtccttcccttcagaaccacatgtgtgtgggacacccagacagaaaacacaaatgcaaagtcaagtggagggcatttggaaggagcagtgaagccaagccaggaaacaccaagatggcgagccagtgtggttgtagagattgtagagagggtggaattggcactgtggaccctggcctcgatagagaaagacatcagctaaggaagttgttcaggtgggcagtgaggttgtcgtgctttggaaagatgttcaggctgcactaggaagccccctggcttggggagagactccaggaaaccccagcagggagcatttgacagtggattcgagtgatgcaagggggacctggactgtgacctctgtcacgggaacccggaggaggctgatggcttttgcggttgatgtgggaaggagagagaacaaccggaaacgtctgcttgctgggggaagtgtcatgtccgctcctccgctccttttcttctccccttaggagcggttcatggttccttttgttttttgttcttttttttttttttttttgagactataatcctgtcttttttgtacacagagtaaagaggacaaataggtgaaagaataaatgaaaggctggaatcccacttcccccgctgtcccagggcattggatattgatggataggaggcagcaaaccactcacagagccaggaagaaatgaatgcgttggtattgccaggaggggaggccggcccggctgaaatacgctatgaccatagccaggagatactgatggagagaaaggaacacagagagggagaggtcacatcttgggagaggaagattgtggatatagtggaatgggggtctggggaggggttgcccatcagagaagggacctcagtgttggggtgactgtgctcatgtggaaattgcggggtggaggggtattcgaaggtcggatgcaaatccgagaagccggaggaagggtttttggtgatgctcccaggatggtgggctccgatgggatctttggagggggtgtgtctaggtcggctggtgtcaggagggtcttttgtgtgccaggcagagaactgtcccaaggagctgagagtagagggcccaggagcttcagggctgcagccagactgtggcccagggctcagatcccaaaggacccataggagaggcaggggccactcattcactctgcaagagaccagcagaatcctgacggagatgctgacaaatcataaaaagacaaagaatagccgggagtggcagctcaagcctgtgatcccagtactttttgagaggtggagacaggaggatcatgtgagcccaacagttggagaacaacctgggcaacacagcgagaccctgtttctaagaagatttcaaaaattagttgagcatggtagcatgtgcctagtcccagctcctcaggaggctaaggaaagaggattgcttgagcccaggaattagagtgagctatgatcatgccactgtactccatcctggggagcagagctggactctgtctcagaaaaaaaaatgtgtgggtgccaagactcaagaccatgggagctggtcagacacagtgctgacgtctgtaatctcagcactttgggaggccaaggcgggtggatcacctgaggtcaggtgttcgggaccaatctggccaacatggcaaaaccccgtctctactaaaaacacaaaaattagccaggcgtggtggttcatgtttgtaatcccagctgcttggaggctgaggtgggagaatcgcttgaacccaggaggcatcagctgcagtgagtcaagatcgagacactgccctccagcctgggcagcagagcaagactgtgtctcacaaaaaaaaacaaaaacaaaaacaaaaaaaaactgtaggagcatctggtgggaggtggtggacggagaactgtgggtttggaagctgcgccctccccctggccgtgcgttagaacaggaacacagttacatagagaacaaccttaccttgtccgacaccctcagatctttgtcccaggccaggagtcttttaatgacaggatcctctgtgattagagagcagatgtcagtgtgagaagcaggacagggtttccgtgagagcagcagggcagcgaggagaagtgtgcctcccgggggaaagtctcaggattgtggccgcgggtgaggtggatgagagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttgggatcccccactatggatggagacacttaggtttagcaaagtcagtaagaaacattaagtttcagagggcacagctgaaaccacttttttgatttttgattttgtttttctttatttgatttttatttttatttatttattaatttattttgagacagagtcttgctctgtgggccaggctggaatgcattggcctgatcttggctcactgcaacctctgcctcctgggtttaagcagttctcctgtctcagcctcccgagtagctggaactacagggatgagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattctctcttccttttccagccaagggacctacgtggggggctgggatctacccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctctttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaacccctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctccgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaagagcagcctggccaacatggtgaaaccccatctcttctaaaaatacaaaaaattagtcaggcatggtggtgggtgcctgtaatcccagccactcaggaggcggggacagcagaatggcttaaacttgggaggcggaggttgcagtgagccaaggtcacaccattgcactccagcctgggcaacaagagcaaaactacatctcaaaaaaaaaaaaaaaacaaaaaaaacaaaaagaacctgtggatgagttcccacatggcttcctaacgggctgcggctctcctaggagtctctcgctcatgggaaaggcacaaactgaatgcggaaggaaatcccattgctgtggaagtcccattgttaggaagctctgcttttctggagttcaaatttgcattcatgacgctttaaaccgtcagagctgggtgtgtcctcctacaacaaatcactttactctctctcctggttaacaggctttcaaatattagaacatccatgttctgacctcattaaaattgctcttttgtggaatgaaaagctctgatttaacccgtctttaagcctggtatgcatattcctctctgttccggccaccttgtctagacacactacactgaggcagtgcccatcttagatgatgttgatacattgtcaaaaaatgggcaaaccaggtgcggcggctcacacttgtaatcccagcacttttggaagctgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaa

SEQ ID NO: 6462 - DNA, 12247 bp, Homo sapiens
tcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctataatcccaggtactcaggaggctgaggcaggagaattgcttgaacccaggaggcagaggttgcagtgagccgagagcgcgccactccactccagcctggacaacagagcgagactccgtctcaaaaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagcctccaatttacagtctaaaacatgtcttgggtaaacacagcaagactccatctcaaaaaaaaaaagaaaaagaatcagaagtgaacctgtagcctgtagtgtgttgccaaataaacttatttttagagatacttctttccattttctgtgaggtcatctgcagtttcacatggtagacagacttaggtgagattcttagcaacatagaatgaagagtaaagaggtttgtttatttcacaagggtttattgaaggcctacgatgtgttaaatgctgtaggaaatacccactgatttctcttttcatggaggtttcccgccttctcttaacgagtgatcaattaaactgtttactgggaacttgctaagttaatgaacacacgggatacattctttggatgagcagacattggttgggcagaggggcaagaggagagcagtttagacagagacctgcttatacactgtagtgtctaaaagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctactaaaaacacaaaaattagctgagtgtaatggtggatgcctataatcccagcaacttgggaggctgagacaggagaatcacttgaacttgggaggtggaggttgcagtgagccgagatcatgccattgcactctagcccaggtgacagggtgagactctgtctcaaataataataataataataataataataataataataataataataatgtaggggacttgatgaagggaaaggattagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagtgggctgggcatggtggctcacgcctgtaatcccagcactttgggaggctgaggcgggcggatcacgaagtcaggagatcgagaccatcctggctaaaacggtgaaaccctgtctctactaaaaatacaaaaaattagctgggcatggtggtgggcgcctgtagtcccagccactcaggaggctgaggcaggagaatggtgtgaacccgggaggcagagcttgcagtgagctaagattgtgccactgcactccagcctgggcgacagggcgacagagcaagaatccgtctcaaaaaaaaaaaaaaaaaaaaaaaaaaaaaaaaaaaacctcttaaaacaagtacagcaagaactttgagggtctttgctaagacagcagctggcagcttcaatttggagtagggtatcaaaggcaactgtgtataaggaatagttatataactggtatccaatttctgagatgattttgacttaaacattgtgtatttcccagcatactgttggtttttctaattatgtgggaaattatgttgcttttacttttttttttgctcattgcccagcctagggtgcaatgctgcaatctcagctcactgcaacctccgcctcccaggtttaagtgattcttctgcctcagcctcccaagtagctgggattacaggcgcccaccaccatgcctggctaattttttgtatttttggtagagacagggtttcacgacgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactagatagtaaggatgtgttgaatttgaagtgtctatccagaagtattttgggtacttgtttaaggattgtaaaacaatgtttccatttctggatataataaatgtatttgttaatataataaatgaatagattagacccataaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggcaggtggtactgagtctaagcactggatgaagaagatagtagaaaacagtctggatgctggtgccactaatgttggtaagtttgggagagttttaagccacaagaaatgatcagtgaatgttgttgtagtcaagaaacatttgttattgaaataagactatcaagtgttgatgtagtaataagttattatttttaagttaaagttagcacctattatgtgcctagtacttagctaggtagtaataataataacgacagcttttcttgtgttcttatggtgtgccaggcaggtgttatgctaagaattgcacagaaatatttaatttgcagaatagctgggcgtggtgtctgacgcctgtaatcctagccctttgagaggctgaggtggggggattgcttgaagccaagagttcaagaccaacctggccaacatggggagacctcgtctctattaaaaaataaagcaggccgggtgtggtggctcacgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaatttgggaggtggaggttgcagtgaaccgagattgtgccactgcacgccagcctggggacagagcaagactctgtctcaaaaaaataaaataaaataaaataaaataaatcctggagtagtggctcacatctgtaatcccagcactttgggaggctgaggggggctgatgctttgaggtcaggagttcaagaccagcctaaccaatgtggtaaaaccctgtctctactaaaaatacaaaaattagccagatgtgatggtgcatggttgtaatctcagctcctcagaaggctgagggaggagaattgcttaaacctgggaggtggaggttgcagtgagccaagatcgattgtgccactgcattccagcctgggtgacaagagcaaaagtccatctcaaaaaattaaaaaaaaaaaaaaaaaaaggaaagaaaaaaaagaaaatgacaaaattaaaaaaaaattattaatctgccaaataactttatgagatagaacttattacctccattttacagttgaggaaattaagggacagtaaatttcctttttttgagattataaagctaataaaatagaatctaggaagtctgattccagaaccagttctgtttttttttcttttttttttttttttgagatagagttttgctcttgttgccgaggctgcggtgcaatggcacgatctcaactcactgcaacctccacctcccaggttcaagcgattctcctgcctcagcctcacaagtagctgggattacaggcatgcaccaccacgcctggctaattttgtatttttagtagagatagagtttctctacgttggtcaggctggtctcgaactactgacctcaggtgatccgctcgctttggtctcccaaagtgctgggattacaggcatgaaccactgcgcccggcccccgttctccttactgggtatgttaaaattatttctttcaaaggaaaaggctggtcaaagtgcaacggtctttacaactaattgatcacaaccagttacagatttttttgttccttctccactccaactgcttcacttgactagtgtaaggaaaaaaaaaaaaaaagaggaaagaaagaaaatgctaaactatttaatctgggctagtaaatggccagaaagaactttataaaaatgaaatatacaaaatgacactagtatgtttaactaaaggtatagttacgacacttaaatttgcacgttataaataatatcaatataaaaactgatagcgtgggtccatttttaataaatatataaatattttaaactttctagatctaaagcttaaggactatggaatggatctcattgaagtttcaggcaatggatgtggggtagaagaagaaaacttcgaaggcttaagtaagttaactttctaatcctattataaaataattgggccacatgtcttagaattttgagtaacactgtcttgggaaacacaaaaacagttttttaaagccagttactagatatcatgtatatttgttgttatagcacttgagatatcttagtccttactttacagtctctttcagctctgaaacatcacacatctaagattcaagagtttgccgacctaactcgggttgaaacttttggctttcgggggaaagctctgagctcactttgtgcactgaggtgataaaatatttttatccattcacttgaccccttagaaaaacctctctgaaaattaattggaatcattattatttacaattttctatctcaatatctcagcttctagcttctgaattctgttttgtctcacagccaatctaagtcctagtacttctgaaatgtgagcaataaatgaatgaaatgaagcaaatagtattgtttaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattacatgcacacacacatatatacatatatatacatatatatacatatatatacatatatgtatacatatatatacatatatgtatacatatatatacatatatacatatatacatatatatacatatatacatatatatatacacacacacatatatatatatatatatatatttttttttttttagacagagtcgcactctgtcacccaggctggagtgcagtggcacagtctcagctcactgcagtctctgcctcccaggttcaagtgactttcgtgactcagcctcctgaagagctgggactatagcgtgcaccaccactcctggctaatttttgtatttttagtagagatggggttttgccatgttgcccaggctggtctggaactccaggcctcaagtgatctgccctccttggcctcccaaagtgctggaattacaggcacgagccaccgcaccctgccctacatatacattttaattataatatcttttggattctttaaaaaaatttttaaaaattttaaaaaattctttaaaaaaattcttttaaaaaattttgtttgaagagtaataacaaaacaaatctctatttgagaatcaataaatcttgagatcatttatggttttgcaattcaacctgaaaaatgaagtcagagcttttatcaaaacaaagcatgtttagtgctctctgtctcactgtcttttagatgccagaccttagattttgtgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccacgtatcggcgaaggttgggactcgactggtgtttgatcacgatgggaaaatcatccagaaaaccccctacccccaccccagagggaccacagtcagcgtgaagcagttattttctacgctacctgtgcgccataaggaatttcaaaggaatattaagaaggtacagtaaattaatcctggttttcaagagtattggttaatgcacacgagcaaaagatttactaaagatgtttattcttcagttgattctcttcccataatttattgagaaatgctttatttgcatttctcattaaagacttaacttcaggatgatttacttttttctttttatcacataatgtttattaggactgggaaacatagtgagactctgtctctatgaaaaattaaaaaaaaaattgactgggcatggtggcatgcacctgtagttccagctacttgggaggctgaagtgggaggatcacctgagcccaggaacttgagactgcagtgagctatgattgcgtcaccacacttcagactgtgagacagagtaagaccctgtctggaaaaatatatatacatatatatacattttttttattttttatttttatctttttttgagatggagtctcactttggcgccctggctgcagtgcagtggcgcgatctcagttcactgcaacctccacctgccaagttcaagcgattctcctgcttcagccttctgagtagctaccattacaggcgcgcgccaccacgcccggctaatttttgtattttcagtggagacggggttccaccatgttgtccaggctggccaggctggtctcgaattcctgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaacaggcctaaatgtgtatagtataaagactgaagagtcagcacttccatgttctcagcggttatccttggatgtgagatctcatgcactttttgctctcttctttgtgcctttccattttgcatgcgtatttcttataatctaaaaagttacttaaacatatgcagctaaaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctggggttacaggcgtgagccaccacgcctggcttttttttttaaagcttttttgtaagtcagccagcaagaacacaggaggaagtactcaaatctcccttacacagctgggggctatgtcaggttttataagcatagggtaatgaggtgtgatttgattggatcttgcaataaagtaatgctgggaggtgtgatctgactggatcctgccatggggtgacaccaaaactcaatctgattggatcctggctcctgcctgggggtgtctggttcttaaatcggtccgagctcttcaggctgagctcttaggttccactccacggtggcacgcgtggttaacctgggcatgcacagggtacatgaccttcaacctgcaggtcgatggcaattggaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagtgaaactccatcaaaaaaaaaaaaagttgaactagatttggtctgatgcagttacagatttacaaaccgcgtcccaccctcctgccaacaccttccactcctcattcttgagggattagggatggaggtcatgcttctgtatcgacttcatgctgaccaggggcacttagtcccctaaagtgagaggaatgaaactcttgggcttctgagttcagatgagttctggggtcacccggagtagcttgaaaggctggtattgttgtaatacaagctgaaggtggaagtgttggatcctggaggacaaacagctcaccatccatttaaataaataggaccaaaaagtaacggaacagtggccacgaggggccccaacagaggaagaaaccaggtgaggtgtggtatagtggactcgactgccttctaaatctcagtggttgtccgggtgcggtggctcacacctgtaattccagcaaaagaagagccgaggcagggtgatcacgaggtcaggagttcaagaccagccgggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcaggaccccatctcagtcaatcaatcaatctcagtggttgaactacccttgatatggttcagctctgtatccccaaccaaatctcatgtcaaattgcaattcccagtgttgagggagggacctggtgggagatgattggctcatggcggctgacgtcccccttgctggtctcgtgatagtgagtgagcgctcatgggatctggttgtttagaagcatgcagcacctcctgcttcactctctctgtctctcctgctccaccatggccagaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaatggacccttctggttgaaggaatgtagccattctgcttgtttaagtatttcctttctattcatctctatttcccgggaggtgtttatccaagtgcaataggagatattggtgactgcagagtcccctcagtgttctgctagtaaatagttgaaggttgatcagtgatctccagcattttcagtctggcatggaaaagcccccatgtaactggtaaaggtatcagtaagcaccaggaggtatctaaatccaccaggagccataggcatcatgttgatgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagtcagcggggtttggtgttgggtgcctgtaatcccagctactcgggaggctgaggcaggataatcacttgaacctgggaggaggaggtggcagtgagctgagatctcgccattgcactccagcctgggcaacaagagcgaaacttcatctcaaaaaataaaaaaagaagtctgggtgtggtggctcgtgcctgtaatcccaggactttgggaggccaagatgggtggatcacgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatacagattttcccagctgtctgtgctgaagtccctgtggggaggctcctggctggtttcctgtaggtagacagctacacgtcctgcccttcattggcttcttttcatgaagctcctgccatctacaaaacatgtctcccttcttgaatcacatctctgttattgaaactctagaagtcgaccgggcatggtggctatgcctataatcccagcattttgggatgccaaagcgggtggatcacctgaggtcaggagttcaagaccagcctggccaacatggcgaaatcccgtctctaatacaaatacaaaaattagccaagcatggtggccactgtactccagcctgggcgacagagcaagactccgtctcaaaaaaaaaaaaaaaaaaaaaaaaaaagagaaagaaagtatcatgcttttctgcattctgtgaattgttttagtgagttatcgaacttcagggcatggtgggaacctccaaatttgcagccagttggtgagaagtacatgtggtctgaggacacccaagcctgcaggtgtgtctaaagcgagggcagcctagtgggggctggtggccttaacctgtggcatttgaggtaacatcagggagttgacatcagaattgcatcacataggctgggcgcagtggctcacgcctgtaatcctagcactttgggaggccaaggcggagagatcacgaggtcaggagatcgagaccatcctggctaacacagtgaaaccccgtctctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgag

SEQ ID NO: 6463 - DNA, 979 bp, Homo sapiens
gtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaagaaa

SEQ ID NO: 6464 - DNA, 14426 bp, Homo sapiens
cccaccacacttggggaggcctccggatggatatgtccttccagctgatggacctcaggattgggagaaagatcggggacaagagacgggcacaacagtcacctggtttctttttcttcctttattttttgagactgagtctcgctttatcacctaggctagagtgcagtgacacgatcttggctcactgcaacctccacttcccaggttcaaatgattctcctgcctcagccttccgagtatctgggattacaggcgtgcactgccatacccgactaatttttggattttagtagagatggggttttgccatgttggccaggctggtcttgaactcctgacctcaagtgatctgcccaccttggcctcccaacgtgttgggattacaggtgtgagccaccgtgcccagccacatggtgtcttccgtgacagctccctctctgctgaaatagcatttcccacccccacccatggcatcactcttctgctgccattttcatcaaagactgatgtcacttggcatgtttttaggtttttttctggtggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaatttttttttttttttttttaagacggagtctcattctgtcacccaggctgaagtgtagtggtgcgatcttggctcactgcaatcccgggttcaagcaattctcctgcctcagcctcccgagtagctgggattacaggcgtgagccactgtgcccggcctttatttaagatttgcctccttaaccattacacctgtaatcccagccctttgggaggctgaggtgggcagatcacctgagttcaggtgttcaagaccagccaggccaagatggtgaaaccacatctctactaaaaattccaaaattagccaggcgtggtggcaggcacctgtagtcccagctaatcagaaggctgaggcaggggaattgcttgaacctgggaggtggaggttgcagtgagccaagattgcaccactgcactccagcctgggcagcagagtgagactgtctcacaaaaaaaaaaaaaaagaagtgtcaggtgctggcagagacactgcttttccctaattgacccgtttggtcctcacattaaccatattttacagctactctcatttacagataaggaaactgggccaatgaggaggtgagaaatcgctcaaggctgccaggtacagtggctcatccctgtaatcccagcactttgggaggccaagggaggaggattaattgaggccaggagtttgagaccagcctaggcaacataatgagactctgtctctacaaaaaatttaaaaattagtggggtgtggtgatgcatgtgtagtcccagctactccggaggctgaggtgggaggatcgcttgatcccaggtgtctgagacagtagtgagctacgactgcaccactgcactacaacctcggtgatgcaatgagatgctgtctcaaaaaaaaaacacacacacacacaaaacaacaaaaaaacaaattgttcaaggcgagcctggtgtgccaagcccttgttctgggcacttggcttatattatctcccttaatccttcccaccaccccaagtgctagatactgggattaatttagttgagctgtaatacatcaatactgtgtgaaatgctatgcaacatctaaaaggaagacaggtggagcttttatttattttttattttatttattttttgagacgcagtctcgctgcattacccaacctggagtgcagtggcacaatcacagctcactgtagcctcaacctcctgggttcaaacaatcctcccacctcagcctctcaagtagctgggactacaggcttacaccaccaagcttggctaatttttttttttttttaagagatggtgttttgctaagttgcccacactgatctcaaaatccttttgtttttgctttggaatggtctggaactcctgagctcaagtgatcctcccaccttggcctcccaaaggcctgggattacacgtatgagccaccgcaccaagcccaggttgagcttttaaggtattaaagatccactaggtgaaaaaaaagagtgaaagatacatatgccatttaagggaagcacaggaaaactcctattttgtttatatgtgaatagaggcgcatagatgcctagaaaagtgtctgggagggaatgaaaccagattggccacaaaaatcacctctggaaaaaggaaaagaatggggactttcactttttgcttcatatgtttcatgcacctttttttttttttttttttgagatggagtttcactcttattgcccaggctggggtgcagtggtgcaatctcagctcactgcaacctctgcctcctaggttcaagcgattctcctgcctcagcctcccgagtagctgggattacaggcatgcgccaccacgcccggctaattttttgtgtttttagtagagacgaggtttctccatgttggtcaggctggtctcgaactcctgacatcaggtgatccgcccaccttggcctcccaaagtgctgggattacaggcgtgagccaccgcgcccagccgctttttctttttaaaaagtaaaatataacagagaaaactgcacaaaacagaagtgttcaaattaaattttttttttttgagacagggtcttgccctgttgcccaggctggagtgcagtggctcattcatagctcactgcagcctcaaactcctgggttcaagcgatcctcccaccccagcctcctgagtggctggaaggccaagggaggatcgcttgagcccaggagtttgaggctgtgccaccacacgcagctgggtttttttttttttttttaattttttgtagagacagggtctcgctatgtcacccacgctggtctcaaactcacgggctcaagcaatcctcccatctttggcctcccaaagtactgagactacaaacatgagccatcttgcccagcccctagaacgtgttatcaaataaacaccgatgcaaccctcactcagccgagaagtaaaacattgccagccaatccctaaatgcttctgcttgccgcttcccaatcctaaccaatgccttctcctgacaattatgatggtcatgtctttgcatttctctaatgtttcccatcacgatcaaactagttttgttttgcctgtgtccaaactttgcataaatgagcagcatgtgtctggtggacctggcttcttccactcaacattatgataagaagattgaccatttggtgcccatagctattgctcttgcattttcattgctctatagattcttactcaacataccttaaaattttttttattctgaaataagagcgggatgctattaaaaaaagaaaaaagaagagaacaaaaaagtcctccagtaaatttaaaatatggtagtcaaggccgggcacggtggctcacacctgtaatcccagcactttgggaggctgaggtgggtggatcacccgaggtcaggagttcgagaccagcccggccaacatggcaaaaccctgtctctacgaaaaaaatacataaatcagccaggtgtggtggtgtgcacccgtaatcccagctacttgggaggctgagacatgagaattgcttgagcccgggaggcagaggtttcggtgagctgagaactgccactgcactccagcctgggtgacagaatgagactataaaagaaagaaagagagaaagagagagagaaaggaaggagagaagggaagggaggggaggagaggggaagggaggggaggggaggggagagaaggggaagggaagggaaggagaagggaaagggaagggaagaaaattagagattaattcaggagattcaacatccgcctaatagaaattctagaaagaggaaggagagaatagagaggccaggtgcagtggctcacacctataatctcagcactttgggaggctgaagtaggaggattgcttaaggccaggagtttgaggctgcagtgagctatgattgagccactgtactccagcctggaaaacaaagcaagacctcgtctctaaaagtaataatacgccgggacggtggctccccacactttgggagcctaaggtgggcggatcacttgaggtcaggctttcgagatcagcctggccaacatgatgaaacccaatctccactaaaaataaaaaaattagccaggtgtggtgctgcacacctgtaaccccagctacctggaggagacaggagaattgcttgaacccgggagatggaggttgcatgaggcgagattgcctcattgcactccagcctgggtgatagaatgagactctgtctcaaaataataataataataataaagttaaatataaataaataaaagcaaatgaatataatgagttttattcatttgttttgctgttgttattgttttggagacagagttttgttcttgtcgcccaggctggagtacaatgatgcgatctggtctcactgcaaccttcgcttcctgggttcaagcgattctcctgccttagtctcctgagtagctgggattagaggcgtgtgacaccacgcccgggtaatttttgtatttttagtagagatggggtttcaccatgttggccaggctggtctcgaactcctgacctcaggtgatccaccaacctgggcctcccaaagtgctgggattacaggtatgagctatcatgcctggccccatttcttttaaaatcagaaggaaaaaatatatataacttttaggccaaaaatgtcttcacgtatattaatagattgatcttttcccaatgcaaccataaatatcattttttaaaattattattattttagaaacagggtctcactctgacgcccaggctgaagtgcagtggtatgatcttagctcactgcagcctccaattcctgggctcaagcgatcctcccacatcagcttcttgaatgtgacctcaggcagacgtcaccgtgcccagctaatttttaatgtaattttatttttttggtaaagatgggttctcattatgttgcccaggccagtcttgaactcctggcctcaagtgatcctcctgccttggcctcctaaggtgctggtattataggattgagccaccaagcccggcccgaatataatttttaatttttttttttaagacagagtttcactcttgttgcctaggctggagtgcagtggcatgatctcggctgaccgcaacctccacctcccgggttcaagcgattctcctgcctcagcctcctgagtagctgggattacaggcatgcaccaccacacccaaataattttctatttttagtagggacggggtttctccacattggtcaggctggtcttgaactcccgacctcaggtgatcctcccatctcggcctcataaagtgctgggattacaggcatgtgccaccacgcccggcctaattttctaatttttttttttaactgaagaaggaccccaggaagtcaaaagtgcctataacccatgaaagtctaaatgaggacaacggaggctgggcatggtggctcactcctgtaatcccagcactttgggaggccaaggtgggcggatcacctgaggtcaggagtttgagaccagcctggccaacatagtgaaaccctgtctctactaaaaaacacaaaaattagtcgggtgtggtggcgggcacctatgatcacagctactcaggagggtgaggcaggagaatcgcttgaacctaggaggcggaggctgcagtgggctgagatcgcaccactgcactccagcctgggggacagagcgagaccccgtctcaaacaaacaaaacaaaacaaaatgaggacaatggggcttccaatggcaactcgagacgttagtttactccagagtcatggagacagtgaatggagtgtgtgtgtgtgtgtgtgtgtgtgtgtgtgcgtgtgcgtgagtgagagagagagagaggaagaagggagggagggagggttacaggagtgtgggaaagtcaacaggaaaaggagggaaggttcactgtgaactgacagtaactgtgacatcacaggcatgtgcggagtccccgcccccccaggcactgtgccaaggccagtaccttcatgtcatgagaccctctcagcaactctgtaaccttgtccccaccagaatattcctttcacagctgagaaaacaacagcacagagaggatgaattaaaaattgtctaacatgctgggcgcagtggctcacgcctgtaatcccagcactttgggatgatgaggcaggtggatcacaaggtcaagagatcaagaccatcctggctaacacggtgaaaacccgtctctactaaaaatacaaaaaagttagccaggcgtggtggcgggcgcctgtagtcccagctgctcgggaggctgaggcaggagttgctgggcactggacacaaggatttctatcagtgtgctctcctgcacatcacccaggtctggagtgccaggaggatcaaaaacatagaatcaaagattagccaccttccaactccaagtttcccccaccccatgccaccgttcctgccttgtacaagtgaagcaagcaatctctcctggtttcaccctaggaggtggaaggtccctggccctggctccatgtggcacgtgctctggtccttctccagcagcaggcttgtcagaccctcccagtccttcagctgagtccctgcacagtcccacaggttgtctactaagtaagcagcgtggtcgtggagctggggaaggaggtgcatggggatttagtgatggcatgttaaaataccctaggaagtggttactgattaaatatcgctctccttcctacagtgtacacccccatccttctccatctgtctttttttttttttttttttttggtagagacagggtctcactatgttgcccaagctggtctcaaactcctgggctcaaaggatcctcccacctcagcctcccaaagtgttgggcttacaggcgtgaaccaccaaccccagcccacttgtaggtcctatgcacaacagccagagttatctctgtgtatgtcaccttgctctccacaaagaaggacagcagaagctggaagaaagtcctctgggcacctgggctctggcgttgctctcttccacccatcgttcttatctcgcactcagggtagaaaagtctggtggaatggacacaaggaaagggctcagcacaggaggaaacaaggaggtgtaatgatgaccacagagggaggagatggcccaaggagatgataaaggaaaaggaggtgcagagctaaggaaagccccaaggagctgagagaggaaaagagacagcagagagacttccacggagatggggaggccttaagtagggcagcagcacatgtgggagagaaaccgagagggtggtgttaaagaaacgtaaaaggagccccactcacttccagtacagaaattcacccacagcagaggccaggcctcaattagaggcctacacaatggggtagacgctctcacagtccacgtccatcagcaccccttccatgttcctgcccacagaaaagcagaaagagtgtgtgaatagggacattgtcttctggcacaatcaaggctagaaagaaaaagaggcaaaagcaacaaggacataactcacaaaaaactcctaaatggagagtggaagacaagggagtatggggagttagagaagacagaaatattaccctctcaacatactgcaactcaggaatgacctcagtcaacctgcacagatggaagagtcagctgtgacaggtggagggagatgaccctggaagggcaaaggtctgagacactggcctcccctcttcccaggactcacttaaggataagtatcagtaatctgacggcctccactgccacactgtactctctgtccacgatcatggaaaccatccagtcctgcagaaaggagaaagtcactcaatatctcattacgcccattccaaatattctgttctcttagaatcagagcctcctaaagagagtgcctacgtagaggcagatgctgggatagccaagacatcttagagcatgaagggtagaaagatacaaggtggggaaacgggaaccacgacaaagagccaagccaaggagcaccacccgtctcaccttgaagcggccagtgaagagctccaggcgtgcggtcaggtcccggttaccgtacagccctttcagagccttcacgcacttcacgcggacttctcggtgctggtgaggagggaaaaccaagagaatggaaataagaccaaccacactctactcgcccctactgagcgtccagactcccctctccgatccctcattctagcttgggtgtcccctctactgaggactctaagatgtcagaaacaatgaacagctgtcttcatacttaaaaaaaaaaaaggatcacagcagtactcatgatgagaaggatcctttggctgccccttagcacctgcattaccatccatcaataactgtcttccattgtaaagtctctctccccgtacctcatgttttgagtcatttcatctcctgggtatgtctctctctaccttatcctaccctccccagtgctagcggagtttcaaggttcagcgccttgatgggttaatcattggtcactaggtaaaatatctcagtggcaggcccaggaaaaggtgaagtgtcctaggacaggaaaaagatgaaggaaacggaaagggaaactgactcgaatcccaccttatcatgcagagtccaaccaatatattttaaatagctgtcggtgaggaaagacgtgctgtagctttgcatccaacacccaatttcctcaatgcagatagcacggatctcaggaaggacatccctagacacagacagataagttgactcttagagccaccctctctccaaactcactttccatcctaccagttaactccctctcatggaagaatttattttcttgaaatgccatgtaccccatgcctttcatttcttcctcccgatgtaaatactatatatatagtaaaatacatgtaaatattttttctcttttttttaagggatggggtctcttgctgtgttgcccaagctggccttgaactcctgggttcaagtcatcttcccactttggcctctcaagtagctaggactacaaaaatgtgccatacccagttagtaaatattttctttctgttaccaaaccataaaatagttaaacaccagccttgtacagcctaattctccactccacctgttgcccaggctggagtgcagcggcacaatctcagctcactgcaacctctacctctcgggttcaagtgattctcctgcttcagcctcctgagtagctgggattacaggtgcaccaccacgcccagctacctttttgtatttttagtagagatggggtttcaccatgttggccaggctggtctcgaacttctgacctcaagtgatctgcccgtcttggcctcccaaagtgctggagttacaggtgtgagccactgcacccggcctccatacctcttttaaaaaccaattttgaaagttcattcaggctgggcatggtggccaaaaattagccaagcatggtggcgggtgcctgtagtcccagctacttggcaggctgaggcaggagaatcgcctgaacccgggaggcggaggtgcagtgagccaagatcgcgtcactgcactccagcctggtgacagagcaagactccgtttcaaataaaaaactaacacactgtacaactgcatgtaaggtggaaaagacaactggaattaaaatgtgctcaggtccttgtagaagataagaaatccagaggaaagcaagcaaagggggaaaaagaaacagaaaagataaaatgattgtgccaactcaatactaggccataaggctaagtctccataaatgtctttttttttttttttttttttttgagacagagtatcactctgtcacccaggctggagtgccgtggcacaatctcagctcactgcaacctccacctcctgggttcaagcaattctcatgcctcagcctcccaagtggctgggattacagacaaatgccaccacatgcagctaatttgtgtatttttagtagagatggggtttcgccatgttggccaggctggtctcgaactcctggcctcaagtgatctgcctgcctcagcctccccaagtgctgggatcacagatgtgagccactgtgcccagcccctacataaatttcaaacaccacattccctgactacaacacaataaagttagaaatcaaataacgaaaatataactagcaaaattctgtatgtttgaaaattttaaatattttcccagaaactataaaactacatgttaatgtggataaatctcaaacaatcttaactgaaataattaaatcacagaagcctgaataatggattcatttacataattaaagaacacattcatagtggtaacactataatgaaagatgagaaagattaacacaaagttcaccctagtgtttacctatgggtaataaggggactgtgaggtagggtagaaagaaggtacacaaaggatctctacagcactattaatgtttcatttcttgagctggggctagagatctgggtgatatctcatttttattttttaaactacatatacgctttgtacactttcagatattagaacttcaataaaattataaaaaaagaaacagagagggaaaaaataattaagtataattgtcaagatggagctaaaaaataacacgggtgaacaaggtgccacccacatctaagcttccttcccatgtcatgcaatgcctctcctcatctgctccatcaatcaataaaggcataatcactcctgtgatacctttaagaaaagaacacgctttaagaaaagaaacgctctctcgaagccgagtgcggtggctcacacctgtaatcccagcactttgggaggccgaggcaggcggatcacctgaggtcaggagttggagaccagcctggccgacatggcgaaaccccatctctactaaaaatacaaaaattagctaggcatggtggcacatgcctgtaagcccagctacttgggaggcctcagcctcccaagaccatgagaatcgcttgaacccaggaggcagaggctgcagtgagctgagactgtgccactgcactccagcctgggcaacagaaagagactgtctcaaaaaaaaaaaaaaaaaaaaagaacatgctctcttattcaaggttacccttctatcactccaaggattcaccccataatcttatctttcttgatatgttacactcactaaaatgttcacatcaaatcaagtttgtagacacttgtccttaccaccttacaaaaagtgagatggtatcaacagaggtaagacactgcttttacctgcatgtcacttttggcagctttcgcagcattgaaaagatcattggctggtggctctgactgtttccggctatgacgatgtaccgcttgggaccctttctttggatattttgccacctgatacacataaaaagatcagaaatatgaaaaaaaggtaatagtgacattaacacttggtttcatcattatcacacaagtaggcttacgctgccaattccacagcagtctgagttagactcagtcctgaaataattgatttttgtattatgaagtttattaacttttttccctttaaaaaaaaaattccttgagtctccttcccgtatctctataaccaaacatccttttcttttcttttctcttcgaaatttctcttcttcctatttccgtcccttaatactttgtaaatcttgtccttttttgaaccatatcacctgaacctcttaggttttctcttttttttgagacggagtctcgctctgtcgcccaggctggcgtgcagtggcgtgatctcggctcactgccagctctgcccccggggttcgtgccattctcctgcctcagcctcccgaatagctgggctgcttcccccacaagattcaaaaacaaaagaaaactggctgactcaccggcgttgttttcagtggtcgttttgctgctttcttcttcacaccgcgattgaagctgtcctcaaatcattttcttgtcttcttgtctatttgtatgaattactgagttacattctcattgctacttatttaagcaaagtattcttagtttgttaagaacaaagaactacaaattgtgttcattttctgtcctttcctgttcttagactaaattacctgaaatacatcaaaatatatgctgtatgcttacctatatcaaaactatgttgtttaggtgccgggcacagtggctcacacctgtaatccagcactttgggagttcaaggcgggcggatcgcctgaggtcaggagttcaagaccagcctggtcaacatggcaaaaccccgtctctactaaaaatacaaaaattagccaggtgcagtggacagtgcctgtaatctcagctactcatgaggctgaggcctgagaattgcttgaacccaggaggccaaggtggcagtgagctgagatcatgccactgcactccagcctgggtgacagagtgaaactccgtctgaaaaaaacaaaacaaacaaacaaacaaaaaaccagaccatattgtttagggatacttagctgacaaaataatagagacaagcatgacataattaccataaaaatcaggccctggggtgctggtggggaaggtttaagtggaaagaatggagcggtgacaatgtgtgtcaacctgggaggtggtgaccctggggttcgctttgtaattcctcaaaatgagcatttatgtgctattcacttttcagaggatagaattctgaactaaaatgtttaagcagccatacgcaaaaaaaaaagaaaaaatatggatagatttttattttaattaaaacatttaaaaaatagagacaaggcagctgggcgtggtggctcacgcctgtaatcccagcaatttgggaggccgaggcaggcgaatcacgaggtcaagagatcgagaccatcctggctaacacggtgaaaccaagtctctactaaaaatacaaaataaagttagccaggcgtggtggcgggcgcctgtagtcccagctactggggaggctgaggcaggagaatggcgtgaacccgggaggtggagcttgcagtgagtcgagatcaggccactgcattccagcctgggcgacagagcaagactccaactcaaaaaaaaaaaaaaaacatagagacaagggtcttgctatgttgctcagggtggtctcaaactctccgggctcaagcaatcctcccgcttcggtctcccaaagcgctgagattccaggcgtgaaccaccgcgctcgaccaggaaaaaaatatatatatatataatatacaatatattttataatatattatgtcatatattacacataatatacaatatgtataatacgcataataaaggtatatttaatatatataaagatatatatgtatataataatttttttttttgagacggagtttcactcttgctgcccaggctcgagtgcaatggctcgatctcagctcactgcaagctccgcctccagggttcaaaccattctcctgcctcagcctcccgagtagctgcgattacaggcgcccgacacacgcccggctaatttttgcatttttagtagacacggggtttcaccatgttggccagactggtctcgaactcctgatctcaggtgatccgcccgcctcggcctcccaaagtgccgggattacaggcgtgagccacggcgcccggcctgaataaatcttttaaaacataaaaatctgggtgagcccctggccggccggcacagatgccggggtggggccgcgaatcggttgggaagcactctatccggcctaggggcacccgggccagcacccggccgccgcgcgtgcgcagtgggcggggtgccccgcgctcctacctgcaagtggccagtgccaagtgctgggccgccgctcctgccgtgcatgttggggagccagtacatgcaggtgggctccacacggagaggggcgcagacccggtgatagggctttacctggtacatcggcatggcgcaaccaaagcaagagagggtggcgcgtgccagacaccaacggtcggaaaccgccagacaccaacggtcggaaaccgccagacaccaacgctcggaaaccgccagacaccaacgctcggaaaccgccagacaccaaggctcggaatacacgccagaccacgacggagggcgaccacctcccttctgaccctgct

SEQ ID NO: 6465 - DNA, 14417 bp, Homo sapiens
cccaccacacttggggaggcctccggatggatatgtccttccagctgatggacctcaggattgggagaaagatcggggacaagagacgggcacaacagtcacctggtttctttttcttcctttattttttgagactgagtctcgctttatcacctaggctagagtgcagtgacacgatcttggctcactgcaacctccacttcccaggttcaaatgattctcctgcctcagccttccgagtatctgggattacaggcgtgcactgccatacccgactaatttttggattttagtagagatggggttttgccatgttggccaggctggtcttgaactcctgacctcaagtgatctgcccaccttggcctcccaacgtgttgggattacaggtgtgagccaccgtgcccagccacatggtgtcttccatgacagctccctctctgctgaaatagcatttcccacccccacccatggcatcactcttctgctgccattttcatcaaagactgatgtcacttggcatgtttttaggtttttttctggtggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaatttttttttttttttttttaagacggagtctcattctgtcacccaggctgaagtgtagtggtgcgatcttggctcactgcaatcccgggttcaagcaattctcctgcctcagcctcccgagtagctgggattacaggcgtgagccactgtgcccggcctttatttaagatttgcctccttaaccattacacctgtaatcccagccctttgggaggctgaggtgggcagatcacctgagttcaggtgttcaagaccagccaggccaagatggtgaaaccacatctctactaaaaattccaaaattagccaggcgtggtggcaggcacctgtagtcccagctaatcagaaggctgaggcaggggaattgcttgaacctgggaggtggaggttgcagtgagccaagattgcaccactgcactccagcctgggcagcagagtgagactgtctcacaaaaaaaaaaaaaaagaagtgtcaggtgctggcagagacactgcttttccctaattgacccgtttggtcctcacattaaccatattttacagctactctcatttacagataaggaaactgggccaatgaggaggtgagaaatcgctcaaggctgccaggtacagtggctcatccctgtaatcccagcactttgggaggccaagggaggaggattaattgaggccaggagtttgagaccagcctaggcaacataatgagactctgtctctacaaaaaatttaaaaattagtggggtgtggtgatgcatgtgtagtcccagctactccggaggctgaggtgggaggatcgcttgatcccaggtgtctgagacagtagtgagctacgactgcaccactgcactacaacctcggtgatgcaatgagatgctgtctcaaaaaaaaaacacacacacacacaaaacaacaaaaaaacaaattgttcaaggcgagcctggtgtgccaagcccttgttctgggcacttggcttatattatctcccttaatccttcccaccaccccaagtgctagatactgggattaatttagttgagctgtaatacatcaatactgtgtgaaatgctatgcaacatctaaaaggaagacaggtggagcttttatttattttttattttatttattttttgagacacagtctcgctgcattacccaacctggagtgcagtggcacaatcacagctcactgtagcctcaacctcctgggttcaaacaatcctcccacctcagcctctcaagtagctgggactacaggcttacaccaccaagcttggctaatttttttttttttttaagagatggtgttttgctaagttgcccacactgatctcaaaatccttttgtttttgctttggaatggtctggaactcctgagctcaagtgatcctcccaccttggcctcccaaaggcctgggattacacgtatgagccaccgcaccaagcccaggttgagcttttaaggtattaaagatccactaggtgaaaaaaaagagtgaaagatacatatgccatttaagggaagcacaggaaaactcctattttgtttatatgtgaatagaggcgcatagatgcctagaaaagtgtctgggagggaatgaaaccagattggccacaaaaatcacctctggaaaaaggaaaagaatggggactttcactttttgcttcatatgtttcatgcacctttttttttttttttttttgagatggagtttcactcttattgcccaggctggggtgcagtggtgcaatctcagctcactgcaacctctgcctcctaggttcaagcgattctcctgcctcagcctcccgagtagctgggattacaggcatgcgccaccacgcccggctaattttttgtgtttttagtagagacgaggtttctccatgttggtcaggctggtctcgaactcctgacatcaggtgatccgcccaccttggcctcccaaagtgctgggattacaggcgtgagccaccgcgcccagccgctttttctttttaaaaagtaaaatataacagagaaaactgcacaaaacagaagtgttcaaattaaattttttttttttgagacagggtcttgccctgttgcccaggctggagtgcagtggctcattcatagctcactgcagcctcaaactcctgggttcaagcgatcctcccaccccagcctcctgagtggctggaaggcgaagggaggatcgcttgagcccaggagtttgaggctgtgccaccacacgcagctgggtttttttttttttttttaattttttgtagagacagggtctcgctatgtcacccacgctggtctcaaactcacgggctcaagcaatcctcccatctttggcctcccaaagtactgagactacaaacatgagccatcttgcccagcccctagaacgtgttatcaaataaacaccgatgcaaccctcactcagccgagaagtaaaacattgccagccaatccctaaatgcttctgcttgccgcttcccaatcctaaccaatgccttctcctgacaattatgatggtcatgtctttgcatttctctaatgtttcccatcacgatcaaactagttttgttttgcctgtgtccaaactttgcataaatgagcagcatgtgtctggtggacctggcttcttccactcaacattatgataagaagattgaccatttggtgcccatagctattgctcttgcattttcattgctctatagattcttactcaacataccttaaaattttttttattctgaaataagagcgggatgctattaaaaaaagaaaaaagaagagaacaaaaaagtcctccagtaaatttaaaatatggtagtcaaggccgggcacggtggctcacacctgtaatcccagcactttgggaggctgaggtgggtggatcacccgaggtcaggagttcgagaccagcccggccaacatggcaaaaccctgtctctacgaaaaaaatacataaatcagccaggtgtggtggtgtgcacccgtaatcccagctacttgggaggctgagacatgagaattgcttgagcccgggaggcagaggtttcggtgagctgagaactgccactgcactccagcctgggtgacagaatgagactataaaagaaagaaagagagaaagagagagagaaaggaaggagagaagggaagggaggggaggagaggggaagggaggggaggggaggggagagaaggggaagggaagggaaggagaagggaaagggaagggaagaaaattagagattaattcaggagattcaacatccgcctaatagaaattctagaaagaggaagtagagaatagagaggccaggtgcagtggctcacacctataatctcagcactttgggaggctgaagtaggaggattgcttaaggccaggagtttgaggctgcagtgagctatgattgagccactgtactccagcctggaaaacaaagcaagacctcgtctctaaaagtaataatacgccgggacggtggctccccacactttgggagcctaaggtgggcggatcacttgaggtcaggctttcgagatcagcctggccaacatgatgaaacccaatctccactaaaaataaaaaaattagccaggtgtggtgctgcacacctgtaaccccagctacctggaggagacaggagaattgcttgaacccgggagatggaggttgcatgaggcgagattgcctcattgcactccagcctgggtgatagaatgagactctgtctcaaaataataataataataataaagttaaatataaataaataaaagcaaatgaatataatgagttttattcatttgttttgctgttgttattgttttggagacagagttttgttcttgtcgcccaggctggagtacaatgatgcgatctggtctcactgcaaccttcgcttcctgggttcaagcgattctcctgccttagtctcctgagtagctgggattagaggcgtgtgacaccacgcccgggtaatttttgtatttttagtagagatggggtttcaccatgttggccaggctggtctcgaactcctgacctcaggtgatccaccaacctgggcctcccaaagtgctgggattacaggtatgagctatcatgcctggccccatttcttttaaaatcagaaggaaaaaatatatataacttttaggccaaaaatgtcttcacgtatattaatagattgatcttttcccaatgcaaccataaatatcattttttaaaattattattattttagaaacagggtctcactctgacgcccaggctgaagtgcagtggtatgatcttagctcactgcagcctccaattcctgggctcaagcgatcctcccacatcagcttcttgaatgtgacctcaggcagacgtcaccgtgcccagctaatttttaatgtaattttatttttttggtaaagatgggttctcattatgttgcccaggccagtcttgaactcctggcctcaagtgatcctcctgccttggcctcctaaggtgctggtattataggattgagccaccaagcccggcccgaatataatttttaattttttttttaagacagagtttcactcttgttgcctaggctggagtgcagtggcatgatctcggctgaccgcaacctccacctcccgggttcaagcgattctcctgcctcagcctcctgagtagctgggattacaggcatgcaccaccacacccaaataattttctatttttagtagggacggggtttctccacattggtcaggctggtcttgaactcccgacctcaggtgatcctcccacctcggcctcataaagtgctgggattacaggcatgtgccaccacgcccggcctaattttctaatttttttttttaactgaagaaggaccccaggaagtcaaaagtgcctataacccatgaaagtctaaatgaggacaacggaggctgggcatggtggctcactcctgtaatcccagcactttgggaggccaaggtgggcggatcacctgaggtcaggagtttgagaccagcctggccaacatagtgaaaccctgtctctactaaaaaacacaaaaattagtcgggtgtggtggcgggcacctatgatcacagctactcaggagggtgaggcaggagaatcgcttgaacctaggaggcggaggctgcagtgggctgagatcgcaccactgcactccagcctgggggacagagcgagaccccgtctcaaacaaacaaaacaaaacaaaatgaggacaatggggcttccaatggcaactcgagacgttagtttactccagagtcatggagacagagaatggagtgtgtgtgtgtgtgtgtgtgtgtgtgtgtgtgcgtgtgcgtgagtgagagagagagagaggaagaagggagggagggagggttacaggagtgtgggaaagtcaacaggaaaaggagggaaggttcgctgtgaactgacagtaactgtgacatcacaggcatgtgcggagtccccgcccccccaggcactgtgccaaggccagtaccttcatgtcatgagaccctctcagcaactctgtaaccttgtccccaccagaatattcctttcacagctgagaaaacaacagcacagagaggatgaattaaaaattgtctaacatgctgggcgcagtggctcacgcctgtaatcccagcactttgggatgatgaggcaggtggatcacaaggtcaagagatcaagaccatcctggctaacacggtgaaaacccgtctctactaaaaatacaaaaaagttagccaggcgtggtggcgggcgcctgtagtcccagctgctcgggaggctgaggcaggagttgctgggcactggacacaaggatttctatcagtgtgctctcctgcacatcacccaggtctggagtgccaggaggatcaaaaacatagaatcaaagattagccaccttccaactccaagtttcccccaccccatgccaccgttcctgccttgtacaagtgaagcaagcaatctctcctggtttcaccctaggaggtggaaggtccctggccctggctccatgtggcacgtgctctggtccttctccagcagcaggcttgtcagaccctcccagtccttcagctgagtccctgcacagtcccacaggttgtctactaagtaagcagcgtggtcgtggagctggggaaggaggtgcatggggatttagtgatggcatgttaaaataccctaggaagtggttactgattaaatatcgctctccttcctacagtgtacacccccatccttctccatctgtcttttttttttttttttttttttggtagagacagggtctcactatgttgcccaagctggtctcaaactcctgggctcaaaggatcctcccacctcagcctcccaaagtgttgggcttacaggcgtgaaccaccaaccccagcccacttgtaggtcctatgcacaacagccagagttatctctgtgtatgtcaccttgctctccacaaagaaggacagcagaagctggaagaaagtcctctgggcacctgggctctggcgttgctctcttccacccatcgttcttatctcgcactcagggtagaaaagtctggtggaatggacacaaggaaagggctcagcacaggaggaaacaaggaggtgtaatgatgaccacagagggaggagatggcccaaggagatgataaaggaaaaggaggtgcagagctaaggaaagccccaaggagctgagagaggaaaagagacagcagagagacttccacggagatggggaggccttaagtagggcagcagcacatgtgggagagaaaccgagagggtggtgttaaagaaacgtaaaaggagccccactcacttccagtacagaaattcacccacagcagaggccaggcctcaattagaggcctacacaatggggtagacgctctcacagtccacgtccatcagcaccccttccatgttcctgcccacagaaaagcagaaagagtgtgtgaatagggacattgtcttctggcacaatcaaggctagaaagaaaaagaggcaaaagcaacaaggacataactcacaaaaaactcctaaatggagagtggaagacaagggagtatggggagttagagaagacagaaatattaccctctcaacatactgcaactcaggaatgacctcagtcaacctgcacagatggaagagtcagctgtgacaggtggagggagatgaccctggaagggcaaaggtctgagacactggcctcccctcttcccaggactcacttaaggataagtatcagtaatctgacggcctccactgccacactgtactctctgtccatgatcatggaaaccatccagtcctgcagaaaggagaaagtcactcaatatctcattacgcccattccaaatattctgttctcttagaatcagagcctcctaaagagagtgcctacgtagaggcagatgctgggatagccaagacatcttagagcatgaagggtagaaagatacaaggtggggaaacgggaaccacgacaaagagccaagccaaggagcaccacctgtctcaccttgaagcagccagtgaagagctccaggcgtgcggtcaggtcccggttaccgtacagccctttcagagccttcacgcacttcacgcggacttctcggtgctggtgaggagggaaaaccaagagaatggaaataagaccaaccacactctactcgcccctactgagcgtccagactcccctctccgatccctcattctagcttgggtgtcccctctactgaggactctaagatgtcagaaacaatgaacagctgtcttcatacttaaaaaaaaaaaaggatcacagcagtactcatgatgagaaggatcctttggctgccccttagcacctgcattaccatccatcaataactgtcttccattgtaaagtctctctccccgtacctcatgttttgagtcatttcatctcctgggtatgtctctctctaccttatcctaccctccccagtgctagcggagtttcaaggttcagcgccttgatgggttaatcattggtcactaggtaaaatatctcagtggcaggcccaggaaaaggtgaagtgtcctaggacaggaaaaagatgaaggaaacggaaagggaaactgactcgaatcccaccttatcatgcagagtccaaccaatatattttaaatagctgtcggtgaggaaagacgtgctgtagctttgcatccaacacccaatttcctcaatgcagatagcacggatctcaggaaggacatccctagacacagacagataagttgactcttagagccaccctctctccaaactcactttccatcctaccagttaactccctctcatggaagaatttattttcttgaaatgccatgtaccccatgcctttcatttcttcctcccgatgtaaatactatatatatagtaaaatacatgtaaatattttttctcttttttttaagggatggggtctcttgctgtgttgcccaagctggccttgaactcctgggttcaagtcatcttcccactttggcctctcaagtagctaggactacaaaaatgtgccatacccagttagtaaatattttctttctgttaccaaaccataaaatagttaaacaccagccttgtacagcctaattctccactccacctgttgcccaggctggagtgcagcggcacaatctcagctcactgcaacctctacctctcgggttcaagtgattctcctgcttcagcctcctgagtagctgggattacaggtgcaccaccacgcccagctacctttttgtatttttagtagagatggggtttcaccatgttggccaggctggtctcgaacttctgacctcaagtgatctgcccgtcttggcctcccaaagtgctggagttacaggtgtgagccactgcacccggcctccatacctcttttaaaaaccaattttgaaagttcattcaggctgggcatggtggccaaaaattagccaagcatggtggcgggtgcctgtagtcccagctacttggcaggctgaggcaggagaatcgcctgaacccgggaggcggaggtgcagtgagccaagatcgcgtcactgcactccagcctggtgacagagcaagactccgtttcaaataaaaaactaacacactgtacaactgcatgtaaggtggaaaagacaactggaattaaaatgtgctcaggtccttgtagaagataagaaatccagaggaaagcaagcaaagggggaaaaagaaacagaaaagataaaatgattgtaccaactcaatactaggccataaggctaagtctccataaatttttttttttttttttttttttttgagacagagtatcactctgtcacccaggctggagtgccgtggcacaatctcagctcactgcaacctccacctcctgggttcaagcaattctcatgcctcagcctcccaagtggctgggattacagacaaatgccaccacatgcagctaatttgtgtatttttagtagagatggggtttcgccatgttggccaggctggtctcgaactcctggcctcaagtgatctgcctgcctcagcctccccaagtgctgggatcacagatgtgagccactgtgcccagcccccacataaatttcaaacaccacattccctgactacaacacaataaagttagaaatcaaataacgaaaatataactagcaaaattctgtatgtttgaaaattttaaatattttcccagaaactataaaactacatgttaatgtggataaatctcaaacaatcttaactgaaataattaaatcacagaagcctgaataatggattcatttacataattaaagaacacattcatagtggtaacactataatgaaagatgagaaagattaacacaaagttcaccctagtgtttacctatgggtaataaggggactgtgaggtagggtagaaagaaggtacacaaaggatctctacagcactattaatgtttcatttcttgagctggggctagagatctgggtgatatctcatttttattttttaaactacatatacgctttgtacactttcagatattagaacttcaataaaattataaaaaaagaaacagggaaaaaataattaagtataattgtcaagatggagctaaaaaataacacgggtgaacaaggtgccacccacatctaagcttccttcccatgtcatgcaatgcctctcctcatctgctccatcaatcaataaaggcataatcactcctgtgatacctttaagaaaagaacacgctttaagaaaagaaacgctctctcgaagccgggtgcggtggctcacacctgtaatcccagcactttgggaggccgaggcaggcggatcacctgaggtcaggagttggagaccagcctggccgacatggcgaaaccccatctctactaaaaatacaaaaattagctaggcatggtggcacatgcctgtaagcccagctacttgggaggcctcagcctcccaagaccatgagaatcgcttgaacccaggaggcagaggctgcagtgagctgagactgtgccactgcactccagcctgggcaacagaaagagactgtctcaaaaaaaaaaaaaaaaaaaaaaagaacatgctctcttattcaaggttacccttctatcactccaaggattcaccccataatcttatctttcttgatatgttacactcactaaaatgttcacatcaaatcaagtttgtagacacttgtccttaccaccttacaaaaagtgagatggtatcaacagaggtaagacactgcttttacctgcatgtcacttttggcagctttcgcagcattgaaaagatcattggctggtggctctgactgtttccggctatgacgatgtaccgcttgggaccctttctttggatattttgccacctgatacacataaaaagatcagaaatatgaaaaaaaggtaacagtgacattaacacttggtttcatcattatcacacaagtaggcttacgctgccaattccacagcagtctgagttagactcagtcctgaaataattgatttttatattatgaagtttattaacttttttccctttaaaaaaaaaattccttgagtctccttcccgtatctctataaccaaacatccttttcttttcttttcgaaatttctcttcttcctatttccgtcccttaatactttgtaaatcttgtccttttttgaaccatatcacctgaacctcttaggttttctcttttttttgagacggagtctcgctctgtcgcccaggctggcgtgcagtggcgtgatctcggctcactgccagctctgcccccggggttcgtgccattctcctgcctcagcctcccgaatagctgggctgcttcccccacaagattcaaaaacaaaagaaaactggctgactcaccggcgttgttttcagtggtcgttttgctgctttcttcttcacaccgcgattgaagctgtcctcaaatcattttcttgtcttcttgtctatttgtatgaattactgagttacattctcattgctacttatttaagcaaagtattcttagtttgttaagaacaaagaactacaaattgtgttcattttctgtcctttcctgttcttagactaaattacctgaaatacatcaaaatatatgctgtatgcttacctatatcaaaactatgttgtttaggtgccgggcacagtggctcacacctgtaatccagcactttgggagttcaaggcgggcggatcgcctgaggtcaggagttcaagaccagcctggtcaacatggcaaaaccccgtctctactaaaaatacaaaaattagccaggtgcagtggacagtgcctgtaatctcagctactcatgaggctgaggcctgagaattgcttgaacccaggaggccaaggtggcagtgagctgagatcatgccactgcactccagcctgggtgacagagtgaaactccgtctgaaaaaaacaaaacaaacaaacaaacaaaaaaccagaccatattgtttagggatacttagctgacaaaataatagagacaagcatgacataattaccataaaaatcaggccctggggtgctggtggggaaggtttaagtggaaagaatggagcggtgacaatgtgtgtcaacctgggaggtggtgaccctggggttcgctttgtaattcctcaaaatgagcatttatgtgctattcacttttcagaggatagaattctgaactaaaatgtttaagcagccatacgcaaaaaaagaaaaaatatggatagatttttattttaattaaaacatttaaaaaatagagacaaggcagctgggcgtggtggctcacgcctgtaatcccagcaatttgggaggccgaggcaggcgaatcacgaggtcaagagatcgagaccatcctggctaacacggtgaaaccaagtctctactaaaaatacaaaataaagttagccaggcgtggtggcgggcgcctgtagtcccagctactggggaggctgaggcaggagaatggcgtgaacccgggaggtggagcttgcagtgagtcgagatcaggccactgcattccagcctgggcgacagagcaagactccaactcaaaaaaaaaaaaaaaacatagagacaagggtcttgctatgttgctcagggtggtctcaaactctccgggctcaagcaatcctcccgcttcggtctcccaaagcgctgagattccaggcgtgaaccaccgcgctcgaccaggaaaaaaatatatatatatataatatacaatatattttataatatattatgtcatatattacacataatatacaatatgtataatacgcataataaaggtatatttaatatatataaagatatatatgtatataataatttttttttttgagacggagtttcactcttgctgcccaggctcgagtgcaatggctcgatctcagctcactgcaagctccgcctccagggttcaaaccattctcctgcctcagcctcccgagtagctgcgattacaggcgcccgacacacgcccggctaatttttgcatttttagtagacacggggtttcaccatgttggccagactggtctcgaactcctgatctcaggtgatccgcccgcctcggcctcccaaagtgccgggattacaggcgtgagccacggcgcccggcctgaataaatcttttaaaacataaaaatctgggtgagcccctggccggccggcacagatgccggggtggggccgcgaatcggttgggacgcactctatccggcctaggggcacccgggccagcacccggccgccgcgcgtgcgcagtgggcggggtgccccgcgctcctacctgcaagtggccagtgccaagtgctgggccgccgctcctgccgtgcatgttggggagccagtacatgcaggtgggctccacacggagaggggcgcagacccggtgatagggctttacctggtacatcggcatggcgcaaccaaagcaagagagggtggcgcgtgccagacaccaacggtcggaaaccgccagacaccaacggtcggaaaccgccaagacaccaacgctcggaaaccgccagacaccaacgctcggaaaccgccagacaccaaggctcggaatacacgccagaccacgacggagggcgaccacctcccttctgaccctgct

SEQ ID NO: 6466 - DNA, 975 bp, Homo sapiens
gtcaggagttcaagaccagcctggcctagatggtgaaaccctgtctcgagtgaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactccgtctcgaaagaaagaaagagaaaggaaattccccagggaagtacctcggcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgtgtcaatgccgatatttctgtctgttgcacatttgatttccttgttgttggcatttagaaggccccctgtttcccagatcacaccacgggcatggaccgcagagattgcatcttgtgagtctgtagaaacagtcaaggccttgtcctctcttaggtccagagctcaggtgaatgcagattttcccggccatctgtgctgaagtccctgtggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacagtggctatgcctgtaatcccagcactttgggaggccaaggtgggtggatcacctgaggtcaggagttcaagaccagcctggccaacatggcgaaaccctgtctctaatacaaatactaaaattagccaagcatggtggccactgcactccagcctgggtgacagagcaagactctgtctcaaataaa

SEQ ID NO: 6467 - DNA, 14426 bp, Homo sapiens
cccaccacacttggggaggcctccggatggatatgtccttccagctgatggacctcaggattgggagaaagatcggggacaagagacgggcacaacagtcacctggtttctttttcttcctttattttttgagactgagtctcgctgtatcacctaggctagagtgcagtgacacgatcttggctcactgcaacctccacttcccaggttcaaatgattctcctgcctcagccttctgagtatctgggattacaggcgtgcactgccatacccgactaatttttggattttagtagagatggggttttgccatgttggccaggctggtcttgaactcctgacctcaagtgatctgcccaccttggcctcccaacgtgttgggattacaggtgtgagccaccgtgcccagccacatggtgtcttccgtgacagctccctctctgctgaaatagcatttcccacccccacccatggcatcactcttctgctgccattttcatcaaagactgatgtcacttggcatgtttttaggtttttttctggtggcttttatttttttaattttagagatgaggtctcactatgttgcccagcctagtctcaaattcctaagctcaagggatccacctgcctctatctcccaaagtgctggggttacaggcatgcaccaccacgcctggaccacattgcatgcattttatttaaattttttttttttttttttaagacggagtctcattctgtcacccaggctgaagtgtagtggtgcgatcttggctcactgcaatcccgggttcaagcaattctcctacctcagcctcccgagtagctgggattacaggcgtgagccactgtgcccggcctttatttaagatttgcctccttaaccattacacctgtaatcccagccctttgggaggctgaggtgggcagatcacctgagttcaggtgttcaagaccagccaggccaagatggtgaaaccacatctctactaaaaattccaaaattagccaggcgtggtagcaggcacctgtagtcccagctaatcagaaggctgaggcaggggaattgcttgaacctgggaggtggaggttgcagtgagccaagattgcaccactgcactccagcctgggcagcagagtgagactgtctcacaaaaaaaaaaaaaagaagtgtcaggtgctggcagagacactgcttttccctaattgacctgtttggtcctcacattaaccatattttacagctactctcatttacagataaggaaactgggccaatgaggaggtgagaaatcgctcaaggctgccaggtacagtggctcatccctgtaatcccagcactttgggaggccaagggaggaggattaattgaggccaggagtttgagaccagcctaggcaacataatgagactctgtctctacaaaaaatttaaaaattagtggggtgtggtgatgcatgtgtagtcccagctactccggaggctgaggtgggaggatcgcttgatcccaggtgtctgagacagtagtgagctacgattgcaccactgcactacaacctcggtgatgcaatgagacgctgtctcaaaaaaaaaaaaccacacacacacaaaacaacaaaaaaacaaattgttcaaggcgagcctggtgtgccaagcccttgttctgggcacttggcttatattatctcccttaatccttcccaccaccccaagtgctagatactgggattaatttagttgagctgtaatacatcaatactgtgtgaaatgctatgcaacatctaaaaggaagacaggtggagcttttatttattttttattttatttattttttgagacgcagtctcgctgcattacccaacctggagtgcagtggcacaatcacagctcactgtagcctcaacctcctgggttcaaacaatcctcccacctcagcctctcaagtagctgggactacaggcttacaccaccaagcttggctaattttttttttttttttttttagagatggtgttttgctaagttgtccacactgatctcaaaatccttttgtttttgctttggaatggtctggaactcctgagctcaagtgatcctcccaccttggcctcccaaaggcctgggattacacgtatgagccaccgcaccaagcccaggttgagcttttaaggtattaaagatccactaggtgaaaaaaaagagtgaaagatacatatgccatttaagggaagcacaggaaaactcctattttgtttatatgtgaatagaggcacatagatgcctagaaaagtgtctgggagggaatgaaaccagattggccacaaaaatcacctctggaaaaaggaaaagaatggggactttcactttttgcttcatatgtttcatgtacctttttttttttttttttgagatggagtttcactcttattgcccaggctggggtgcagtggtgcgatctcagctcactgcaacctctgcctcctaggttcaagcgattctcctgcctcagcctcccaagtagctgggattacaggcatgcgccaccacgcccggctaattttttgtgtttttagtagagacgaggtttctccatgttggtcaggctggtctcgaactcctgacatcaggtgatctacccactttggcctcccaaagtgctgggattacaggcgtgagccaccgcgcccagctgctttttctttttaaaaagtaaaatataacagagaaaactgcacaaaacagaagtgttcaaattaaatttttttttttttgagacagggtcttgccctgttgcccaggctggagtgcagtggctcattcatagctcactgcagcctcaaactcctgggttcaagcgatcctcccaccccagcctcctgagtggctggaaggccaagggaggatcgcttgagcccaggagtttgaggctgtgccaccacacgcagctggtttttttttttttttttaattttttgtagagacagggtctcgctatgtcacccacgctggtctcaaactcacgggctcaagcaatcctcccatctttggcctcccaaagtactgagactacaaacatgagccatcttgcccagcccctagaacgtgttatcaaataaacaccgatgcaaccctcactcagctgagaagtaaaacattgccagccaatccctaaatgcttctgcttgccgcttcccaatcctaaccaatgccttctcctgacaattatgatggtcatgtctttgcatttctctaatgtttcccatcacgatcaaactagttttgttttgcctgtgtccaaactttgcataaatgagcagcatgtgtctggtggacctggcttcttccactcaacattatgataagaagattgaccatttggtgcccatagctattgctcttgcattttcattgctctatagattcttactcaacataccttaaaaatttttttattctgaaataagagcgggatgctattaaaaaaagaaaaaagaagagaacaaaaaagtcctccagtaaatttaaaatatggtagtcaaggccgggcacggtggctcacacctgtaatcccagcactttgggaggctgaggtgggtggatcacccgaggtcaggagttcgagaccagcccggccaacatggcaaaaccctgtctctacgaaaaaaatacataaatcagccaggtgtggtggtgtgcacccgtaatcccagctactcgggaggctgagacatgagaattgcttgagcccgggaggcagaggtttcggtgagctgagaactgccactgcactccagcctgggtgacagaatgagactataaaagaaagaaagagagaaagagagagagaaaggaaggagggaagggaagggaggggaggggaggggaagggaggggaggggaggggagagaaggggaagggaagggaaggagaagggaaagggaagggaagaaaattagagattaattcaggagattcaacatccgcctaatagaaattctagaaagaggaagtagagaatagagaggccaggtgcagtggctcacacctataatctcagcactttgggaggctgaagtaggaggattgcttaaggccaggagtttgaggctgcagtgagctatgattgagccactgtactccagcctggaaaacaaagcaagacctcgtctctaaaagtaataatacgccgggacagtggctccccacactttgggaggctaaggtgggcggatcacttgaggtcaggctttcgagaccagcctggccaacatgatgaaacccaatctccactaaaaataaaaaaattagccaggtgtggtgctgcacacctgtaaccccagctacctgggaggagacaggagaatcgcttgaacccgggagatggaggttgcatgaggtgagatcgcctcattgcactccagcctgggtgatagaatgagactctgtctcaaaataataataataataataaagttaaatataaataaataaaagcaaatgaatataatgagttttattcatttgttttgctgttgttattgttttggagacagagttttgttcttgtcgcccaggctggagtacaatgatgcgatctggtctcactgcaaccttcgcttcctgggttcaagcgattctcctgccttagtctcctgagtagctgggattagaggcgtgtgacaccacgcccgggtaatttttgtatttttagtagagacggggtttcaccatgttggccaggctggtctcgaactcctgacctcaggtgatccaccaacctgggcctcccaaagtgctgggattacaggtatgagctatcatgcctggcctcatttcttttaaaatcagaaggaaaaaatatatataacttttaggccaaaaatgtcttcacatatattaatagattgatcttttcccaatgcaaccataaatatcattttttaaaattattattattttagaaacagggtctcactctgacgcccaggctgaagtgcagtggtatgatcttagctcactgtagcctccaattcctgggctcaagcgatcctcccacatcagcttcttgaatgtgacctcaggcagacgtcaccgtgcccagctaatttttaatgtaattttatttttttggtaaagatgggttctcattatgttgcccaggccggtcttgaactcctggcctcaagtgatcctcctgccttggcctcctaaggtgctggtattataggattgagccaccaagcccggcccgaatataatttttaaatttttttttttaagacagagtttcactcttgttgcctaggctggagtgcagtggcacgatctcggctgaccgcaacctccacctcccgggttcaagcgattctcctgcctcagcctcctgagtagctgggattacaggcatgcaccaccacacccaaataattttctatttttagtagagacagggtttctccacattggtcaggctggtcttgaactcccgacctcaggtgatcctcccacctcggcctcataaagtgctgggattacaggcatatgccaccacgcccggcctaattttctaatttttttttttaactgaagaaggaccccaggaagtcaaaagtgcctataacccaggaaagtctaaatgaggacaacggaggctgggcgtggtggctcactcctgtaatcccagcactttgggaggccaaggtgggcggatcacctgaggtcaggagttcgagaccagcctggccaacatagtgaaaccctgtctctactaaaaaacacaaaaattagtcgggtgtggtggcgggcacctatgatcacagcttctcaggagggtgaggcaggagaatcgcttgaacctaggaggcagaggctgcagtgggctgagatcgcaccactgcactccagcctgggggacagagcgagaccccgtctcaaacaaacaaaacaaaacaaaatgaggacaatggggcttccaatggcaactcgagacgttagtttactccagagtcatggagacagtgaatggagtgtgtgtgtgtgtgtgtgcgtgtgcgtgagtgagagagagaggaagaagggagggagggacggttacaggagtgtgggaaagtcaacaggaaaaggagggaaggttcgctgtgaactgacagtaactgtgacatcacaggcatgtgcggagtccccgcccccccaggcactgtgccaaggccagtaccttcatgtcatgagaccctctcagcaactctgtaaccttgtccccaccagaatattcctttcacagctgagaaaacaacagcacagagaggatgaattaaaaattgtctaacatgctgggcgcagtggctcacgcctgtaatcccagcactttgggatgatgaggcaggtggatcacaaggtcaagagatcaagaccatcctggctaacacggtgaaaacccgtctctactaaaaatacaaaaaagttagccgggcgtggtggcgggcacctgtagtcccagctgctcgggaggctgaggcaggagttgctgggcactggacacaaggatttctatcagtgtgctctcctgcacatcacccaggtctggagtgccaggaggatcaaaaacatagaatcaaagattagccaccttccaactccaagtttcccccaccccatgccaccgttcctgccttgtacaagtgaagcaagcaatctctcctggtttcaccctaggaggtggaaggtccctggccctggctccatgtggcacgtgctctggtccttctccagcagcaggcttgtcagaccctcccagtccttcagctgagtccctgcacagtcccacaggttgtctactaagtaagcagcgtggtcgtggagctggggaaggaggtgcatggggatttagtgatggcatgttaaaataccctaggaagtggttactgattaaatatcgctctccttcctacagtgtacacccccatccttctccatttgtctttttttttttttttttttggtagagacagggtctcactatgttgcccaagctggtctcaaactcctgggctcaaaggatcctcccacctcagcctcccaaagtgctgggcttacaggcgtgagccaccaaccccagcccacttgtaggtcctatgcacaacagccagagttctctctgtgtatgtcaccttgctctccacaaagaaggacagcagaagctggaagaaagtcctctgggcgcctgggctctggcgttgctctcttccacccatcgttcttatctcgcactcagggtagaaaagtctggtggaatggacacaaggaaagggctcagcacaggaggaaacaaggaggtgtaatcatgaccacagacggaggagatggcccaaggagatgataaaggaaaaggaggtgcagagctaaggaaagccccaaggagctgagagaggaaaagagacagcagagagacttccacggagatggggaggccttaagtagggcagcagcacatgtgggagagaaaccgagagggtggtgttaaagaaacgtaaaaggagccccactcacttccagtacagaaattcacccacagcagaggccaggcctcaattagaggcctacacaatggggtagacgctctcacagtccacgtccatcagcaccccttccatgttcctgcccacagaaaagcagaaagagtgtgtgaatagggacattgtcttctggcacaatcaaggctagaaagaaaaagaggcaaaagcaacaaggacataactcacaaaaaactcctaagtggagagtggaagacaagggagtatggggagttagagaagacagaaatattaccctctcaacatactgcaactcaggaatgacctcagtcaacctgcacagatggaagagtcagctgtgacaggtggagggagatgaccctggaagggcaaaggtctgagacactggcctcccctcttcccaggactcacttaaggataagtatcagtaatctgacggcctccactgccacactgtactctctgtccacgatcatggaaaccatccagtcctgcagaaaggagaaagtcactcaatatctcattacgcccattccaaatattctgttctcttagaatcagagcctcctaaagagagtgcctacgtagaggcagatgctgggatagccaagacatcttagagcatgaagggtagaaagatacaaggtggggaaacgggaaccacgacaaagagccaagccaaggagcaccacccgtctcaccttgaagcggccagtgaaggcgtgcggtcaggtcccggttaccgtacagccctttcagagccttcacgcacttcacgcggacttctcggtgctggtgaggagggaaaaccaagagaatggaaataagaccaaccacactctactcgcccctactgagcgtccagactcccctctccgatccctcattctagcttgggtgtcccctctactgaggactctgagatgtcagaaacaatgaacagctgtcttcatacttaaaaaaaaaaaaggatcacagcagtactcatgatgagaaggatcctttggctgccccttagcacctgcattaccatccatcaataactctcttccattggaaagtctctctccccgtacctcatgttttgagtcatttcatctcctgggtatgtctctctctaccttatcctaccctccccagtgctagcggagtttcaaggttcagcgccttgatgggttaatcattggtcactaggtaaaatatctcagtggcaggcccaggaaaaggtgaagtgtcctaggacaggaaaaagatgaaggaaacggaaagggaaactgactcgaatcccaccttatcatgcagagtccaaccaatatattttaaatagctgtcggtgaggaaagacgtgctgtagctttgcatccaacacccaatttcctcaatgcagatagcacggatctcaggaaggacatccctagacacagacagataagtcgactcttagagccaccctctctccaaactcactttccatcctaccagttaactccctctcatggaagaatttattttcttgaaatgccatgtaccccatgcctttcatttcttcctcccgatgtaaatactatatatatagtaaaatacatgtaaatattttttctcttttttttaagggatggggtctcttgctgtgttgcccaagctggccttgaactcctgggttcaagtcatcttcccactttggcctctcaagtagctaggactacaaaaatgtgccatacccagttagtaaatattttctttctgttaccaaaccataaaatagttaaacaccagccttgtacagcctaattctccactccacctgttgcccaggctggagtgcagcggcacaatctcagctcactgcaacctctacctctcgggttcaagtgattctcctgcctcagcctcctgagtagctgggattacaggtgcaccaccacgcccagctacctttttgtatttttagtagagatggggtttcaccatgttggccaggctggtctcgaactcctgacctcaagtgatctgcccgtcttggcctcccaaagtgctggagttacaggtgtgagccactgcacccggcctccatacctcttttaaaaaccaattttgaaagttcattcaggctgggcatggtggccaaaaattagccaagcatggtggcgggtgcctgtagtcccagctacttggcaggctgaggcaggagaatcgcctgaacccgggaggcggaggtgcagtgagccaagatcgcgtcactgcactccagcctggtgacagagcaagactccgtttcaaataaaaaactaacacactgtactactgcatgtaaggtggaaaagacaactggaattaaaatgtgctcaggtccttgtagaagataagaaatccagaggaaagcaagcaaagggggaaaaagaaacagaaaagataaaacgattgtgccaactcaatactaggccataaggctaagtctccataaatgtcttttttttttttttttttttttttgagacagagtatcactctgtcacccaggctggagtgccgtggcacaatctcagctcactgcaacctccacctcctgggttcaagcaattctcatgcctcagcctcccaagtggctgggattacagacaaatgccaccacatgcagctaatttttgtatttttagtagagatggggtttcgccatgttggccaggctggtctcgaactcctggcctcaagtgatctgcctgcctcagcctccccaagtgctgggatcacagatgtgagccactgtgcctagcccctacataaatttcaaacaccacattccctgactacaacacaataaagttagaaatcaaataacgaaaatataactagcaaaattctgtatgtttgaaaattttaaatattttcccagaaactataaaactacatgttaatgtggataaatctcaaacaatcttaactgaaataattaaatcacagaagcctgaataatggattcatttacataattaaagaacacattcatagtggtaacactataatgaaagatgagaaagattaacgcaaagttcaccctagtgtttacctatgggtaataaggggactgtgaggtagggtagaaagaaggtacacaaaggatctctacagcactattaatgtttcatttcttgagctggggctagagatctgggtgatatctcatttttattttttaaactacatatacgctttgtacacttccagatattagaacttcaataaaattataaaaaaagaaacagagagggaaaaaataattaagtataattgtcaagatggagctaaaaaataacatgggtgaacaaggtgccacccacatctaagcttccttcccatgtcatgcaatgcctctcctcatctgctccatcaatcaataaaggcataatcactcctgtgatacctttaagaaaagaacacgctttaagaaaagaaacgctctctcgaagccgggtgcggtggctcacacctgtaatcccagcactttgggaggccgaggcaggcggatcacctgaggtcaggagttggagaccagcctggccgacatggtgaaaccccatctctactaaaaatacaaaaattagctaggcatggtggcacatgcctgtaagcccagctacttgggaggcctcagcctcccaagaccatgagaatcgcttgaacccaggaggcagaggctgcagtgagctgagactgtgccactgcactccagcctgggcaactgtctcaaaaaaaaaaaaaaaaaaaaaaaagaacatgctctcttattcaaggttaccttctatcactccaaggattcaccccataatcttatctttcttgatatgttacactcactaaaatgttcacatcaaatcaagtttgtagacacttgtccttaccaccttacaaaaagtgagatggtatcaacagaggtaagacactgcttttacctgcatgtcacttttggcagctttcgcagcattgaaaatatcattggctggtggctctgactgtttccggctatgacgatgtaccgcttgggaccctttctttggatattttgccacctgatacacataaaaagatcagaaatatgaaaaaaaggtaacagtgacattaacacttggtttcatcattatcacacaagtaggcttatgctgccaattccacagcagtctgagttagactcagtcctgaaataattgatttttatattatgaagtttattaacttttttccctttaaaaaaaaaattccttgagtctccttcccgtatctctataaccaaacatccttttcttttcttttctcttcgaaatttctcttcttcctatttccgtcccttaatactttgtaaatcttgtccttttttgaaccatatcacctgaacctcttaggttttctcttttttttgagacggagtctcgctctgtcgcccaggctggcgtgcagtggcgtgatctcggctcactgccagctctgcccccagggttcgtgccattctcctgcctcagcctcccgaataactgggctgattcccccacaagattcaaaaacaaaagaaaactggctgactcaccggcgttgttttcagtggtcgttttgctgctttcttcttcacaccgcgattgaagctgtcctcaaatcattttcttgtcttcttgtctatttgtatgaattactgagttacattctcattgctacttatttaagcaaagtattcttagtttgttaagaacaaagaactacaaattgtgttcattttctgtcctttcctgttcttagactaaattacctgaaatacatcaaaatatatgctgtatgcttacctatatcaaaactatgttgtttaggtgccgggcacggtggctcacacctgtaatccagcactttgggagttcaaggcgggcggatcgcctgaggtcaggagttcaagaccagcctggtcaacatggcaaaaccccgtctctactaaaaatacaaaaattagccaggtgcagtggacagtgcctgtaatctcagctactcatgaggctgaggcctgagaattgcttgaacccaggaggccaaggtggcagtgagctgagatcatgccactgcactccagcctgggtgacagagtgaaactccgtctgaaaaaaacaaaaaaaacaaacaaacaaaaaacctgaccatattgtttagggatacttagctgacaaaataatagagacaagcatgacataattaccacaaaaatcaggccctggggtgctggtggggaaggtttaagtggaaagaatggagcggtgacaatgtgtgtcaacctaggaggtggtgaccctggggttcgctttgtaattcctcaaaatgagcatttatgtgctattcacttttcagaggatagaattctgaactaaaatgtttaagcagccatacgcaaaaaaaaaaaaaaatatggatagatttttattttaattaaaacatttaaaaaatagagacaaggcagctgggcgtggtggctcacgcctgtaatcccagcaatttgggaggccgaggcaggcgaatcacgaggtcaagagatcgagaccatcctggctaacacggtgaaaccatgtctctactaaaaatacaaaataaagttagccaggcgtggtggcgggcgcctgtagtcccagctactggggaggctgaggcaggagaatggcgtgaacccgggaggtggagcttgcagtgagccgagatcaggccactgcattccagcctgggcgacagagcaagactccaactcaaaaaaaaaaaaaaaacatagagacaagggtcttgctatgttgctcagggtggtctcaaactctccgggctcaagcaatcctcccgcttcggtctcccaagcaatcctcccgcttcggtctcccaaagcgctgagattccaggcgtgaaccaccgcgctcgaccaggaaaaaaaatatatatatatataatatataatatattttataatatattatgtcatatattacacataatatacaatatgtataatacgcataataaaggtatatttaatatatataaagatatatatgtatataataatttttttttttgagacggagtttcactcttgctgcccaggctcgagtgcaatggctcgatctcagctcactgcaagctccgcctccagggttcaaaccattctcctgcctcagcctcccgagtagctgcgattacaggcgcccgacacacgcccggctaatttttgcatttttagtagacacggggtttcaccatgttggccagactggtctcgaactcctgatctcaggtgatccgcccgcctcggcctcccaaagtgccgggattacaggcgtgagccacggcgcccggcctgaataaatcttttaaaacataaaaatctgggtgagcccctggccggccggcacagatgccggggtggggccgcgaatcggttgggacgcactctatccggcctaggggcacccgggccagcacccggccgccgcgcgtgcgcagtgggcggggggccccgcgctcctacctgcaagtggccagtgccaagtgctgggccgccgctcctgccgtgcatgttggggagccagtacatgcaggtgggctccacacggagaggggcgcagaccccgtgatagggctttacctggtacatcggcatggcgcaaccaaagcaagagagggtggcgcgtgccagacaccaacggtcggaaaccgccagacaccaacggtcagaaaccgccagacaccaacgctcggaaaccgccagacaccaacgctcggaatacacgccagaccacgacggagggcgaccacctcccttctgaccctgctgcgggcgttcggaaaaaaaaacgcagtcc

SEQ ID NO: 6468 - DNA, 937 bp, Homo sapiens
cacttgtaatcccagcacttttggaagccgatgccgacagataaccagaggtgaggaggttgagatcagcctggccaacatggtgaaacctgtctgtttttctgtaaaaatacagaaacaatgagctgggcgtgggagtgcacttctgtaatcccagctacttgtggggctgaggcaggagaatcacttgaaccgggaaggtggaggttccagtgagccgagatcacgacactacactccagcctgggcgacagagtgagactccgactcaaaaaaaaaaaaaaaaaagtgccagacagccctggtttggtctgatatgttcagaaaaaagcaaaacagtcacctctcaccttttcttttcctgcaatgatgccgtttaatacaacaatggctgtaggtctgcggcagaaatatcattcaagtgaaacagaagggctttcctggctggacacagtggtcactcctgcaatcccaacactttggttggctaaggtgggaggatttcttgcggccaggagttcgaggctgcagtgagctgtgatccaccactgcattccaggctgggcatcagagtgagacctgtctctaaaaaaacccttcactccccaaataaagggattttcaaataccagcctttcagcatgaggatcacatggaggaacattaagacacagatgctgggacccagccctattgattgtaattaaaaaactgaggtgaggcctgatttagctccatcattggaatccattcagatttgaaattctctgagttggacagtgcaagagagatcctaaagaaagcaaagtcactgtggactgaaatgagctgacaaggttttctgagcgtggtgaaatatgatctgggcctcgtttgggagggctgtggccaggccttgagtccgtggctcagtgggaccttctgaaacagcctccaa

SEQ ID NO: 6469 - DNA, 300 bp, Homo sapiens
gacagagtttcgctcttgtcacccaggctgcagtgcagtggctccatctcggctcactgcaacctctgcctcccaggttcaagtgattctcctgcctcagcctcccgagtagctgagattacaggcacccaccaccactcccggctaatttttgtattttagggtttcgtcatgtttgccaggctgatcttgaacacctgacttcaaatgatccacctgcctctgcctgtcaaagtgctgggaatacaggcataagacactgcacctggcctgtttttgttttttagagacaaggtctct

SEQ ID NO: 6470 - DNA, 319 bp, Homo sapiens
agattcatccaaacactccctcttccttttgcagccaagggacctacgtggggggctgggatctaccccaggggctgagtaaagaaaccaggccaccgtgtaatgcttctgcaactgatcacgttagaccccgaccccaaaccccaaaccactctccatcctccccagcctctcagactgctggcttctccaagccacctttctgactttctcctctgctcaaccccatgtgccactccttcccctccccattcttccctctctctgtcctcagaacactgcgtcatatcgttccctggtccctggctctctgaggccc

SEQ ID NO: 6471 - DNA, 255 bp, Homo sapiens
ctcacgcctgtaatcccagcactttgggaggctgaggcgggcggatcacgaagtcaggagatcgagaccatcctggctaaaacggtggaaccctgtctctactaaaaatacaaaaaattagctgggcatggtggtgggcgcctgtagtcccagccactcaggaggctgaggcaggagaatggtgtgaacccgggaggcagagcttgcagtgagctaagatcgtgccactgcactccagcctgggcgacagggcga

SEQ ID NO: 6472 - DNA, 3038 bp, Homo sapiens
tcaggcgggagccacagcgcctggcccaaaaccaagctttcttatcccaagcaccgacctttatcaagtctacctaatcctctgttgtctccttaagtgtccctcatgagtgatcacttcagagtcctcccgcatggagagctcacccactggggcatatttttcccattggaaaagtgtggttattggaagtttcctctttagaaagaacaggattggaggtgctctctggggtgtcctcctaccaagcagcctgttgaaggcctcgtagtactcagggagcacgagcgacactcgccgtcgcttcgccttcatcttgaggccacacagcgtctccgccacccaggtctcctcaggctcaggggcgagctccttctctggctcatcatcagattcatccaaacattccctcttccttttccagccaagggacctacgtggggggctgggatctaccccaggggctgagtaaagaaaccaggccaccgtgtaatgcttctgcaactgatcacgttagaccccgaccccaaaccccaaaccactctccatcctccccagcctcgcagactgctggcttctccaagccacctttctgactttctcctctgctcaaccccatgtgccactccttcccctccccattcttccctctctctgtcctcagaacactgcctcatatccttccctggtccctggctctctgagtccctcttttttttttttttttttgtttcgagacagaatcttgctttgtcacccaggctggagtgtagtggtgcaatctcagctcactgcaacatgcatctcccggattccagttattctcctgcctcagcctctcaggtagctgggattacaggtgcctgccataatgcccagctccattttgtacttttaatagagacagggtttcaccatgttggccaggctggtctcaaactcctggcctcaagtgatccgcctgccttggcttcccaaagtgctgggattacaagtgtgagccactgcacccagcctgaatttctccattcttcccacacaccctccccaggttctccttcctgacctctgacccttcttttttttcttcttttttttttttttttttttttttttttttttttttgagatagcatctcactctgtcacccagactggagtgcagtagcacgatctcggctcactgcaacctcttcctcccaggctcaagtgattctcctgtcttagcctcccaagtagctgggattataggcacacaccactaccgcctggctaatttttgtacttttagtagagatggggtttcaccatgttggccaggctggtcttgaactcctgacctcaggtgatctgcccgcctcagcctcccaaagtgttggggttacaggggtgagccaccacgcctggcccccttccttcatcttagtcaatcctatgccacctcttcttcctccagtcccctcacctgatggtcccgacacttcatcatccaccacctcctggagggggtaccctgaggtgctctgctgggggctccgctcttcctggggctgcggttgatggctcatcatgatctttcccaaaatctgtcccatctcaccaaacctagtctctgttctgtccttggtcttcttctggacactgctgggatccagaagagtgtgttatcaattctcgaggctgggagaagtcaggagtggagaacagctctgagaagttactgttgtccaactgaactcccaggtgccgacagagtccggtccctccaatcaggaaggtcggaatctctgatgtcatcgctcatgccaacctggcaaccagtttgaaaaaaaacacatgtaactgccaggctgatctcttgtcctggagatcctgggtgaatggtatctcctgccactgtcccaacctcagaccactgtccaaaagcatcttcagggtctccgcatccctctgttccctgtcccagcagaggctgtgtcctctccactcaaagcttgaagcgtgttggggtctcctcttctctgtacatgcccgtttcagagtccagtctggtgggagagggatcaggatgggaaagaaaagtagggtaagcagaaacgatgaaaccttacaagagtgagattatcatgtacaagagatcccaggaacattgacttgatgaaaaagtcacatcagagcactcaatttggcagaggttttctgccgagtgtctactgacattcactgtccgagattctgtactgggggtacacgcgtcctctgccctaaggcatctttgagtccaagagatattttgaggactggaaatcataggaaactgcccatgagttcacacatatttccaatggtgtccccaatttcagggagtccacggatcacctaaagccagcccctccagtttggctaagaaactctatatatcaagttttgtatcatatgtattgctcttaactcagaaaattccaccatttatagcagtggtttatttatttataccattgaaggaaatggtttatttatgaatctatattatggatattctataagatactgggtgtacaaaaagactaagtcgaaaaatctcagctgtgcacagtggctcatgcttgtaatcccatctctttgggtggccaagggaggaagactgcctgaggccagcagttcaagaccagtataggcaacatagcaagagcccatctctaaaacaaaacaaaacaaaacaaaacaaaattagccaggtgtcgtggctggcacctgtgttccaacaacttgagagactgaggtggcaggaggattgcttgagcctaggagttaggggctgcagtgagctgtgatcgtgacaccgcactccagtctgggcaacacagcaagaccttgtgtcaaaaaaatttttttaattaaatataaaagagtttcatgacattcagagaccatccaaagaacctgtgggttccggccaggcacagtggctcacgcctgtaatcccagcgctttgggaggccatagcaggtggatcgcttgaggtcaggagtttaaga

SEQ ID NO: 6473 - DNA, 257 bp, Homo sapiens
gttattctcctgcctcagcctctcaggtagctgggattacaggtgcctgccataatgcccagctcaattttgtacttttagtagagacgggggtttcaccatgttggccaggctggtctcaaactcctggcctcacgtgatccgcctgccttggcttcccaaagtgctgggattacaggtgtgagccactgcacccagcctgaatttctccattcttcccacacaccctccccaggttctccttcctgacctctgac

SEQ ID NO: 6474 - DNA, 300 bp, Homo sapiens; identical to SEQ ID NO: 6469

SEQ ID NO: 6475 - DNA, 614 bp, Homo sapiens
tcaagaccagcctgggcagcctagcaagatcccatcccttaaaaaaaagtttttaggctgggcatggtcactcatgcctgtaatcctagcactttgggaggccaaggcaggcgggttgcctgagctgaggagtttgagaccagcctgggcaacatggtgaaatcctgtctctactaaaatacaaaaaattagccaggtgtggtgttgggcacctataatcccaggtactcaggaggctgaggcaggagaattgcttgaacccaggaggcagaggttgcagtgagccgagagcgcgccactccactccagcctggacaacagagcgagactccgtctcaaaaaaaaaatgtttttaattagccagctgtgatgatgcatgcccatgtcccagctacttgggaggctgaagcaggaggattgcttgagcctgggaggtcaaggctgcagtgagctatgattgcgcccctgcactccagcctgggcagcggagggagaccctgtctgaaaataaaaaaagaggtgggggcctatgaccccccctttaattttggcccaaccttagtaacaggatagtcattgagtagggcaaaagtgatgttatgatgtttttcagc

SEQ ID NO: 6476 - DNA, 300 bp, Homo sapiens
gacagagtttcgctcttgtcacccaggctgcagtgcagtggctccatctcggctcactgcaacctctgcctcccaggttcaagcgattctcctgcctcagcctcccgagtagctgagattacaggcacccaccaccactcccggctaatttttgtattttagggtttcgtcatgtttgccaggctggtcttgaacacctgacttcaaatgatccacccgcctctgcctctcaaagtgctgggaatacaggcataagacactgcacccggcctgtttttgttttttagagacaaggtctct

SEQ ID NO: 6477 - DNA, 10119 bp, Homo sapiens
gggcctccagggaaccctgatcctgccattcacttcaggtcgggggaacagagtgaagcccctgcctcaaaaataatcataaaaattgaggtcggggaaggttcataaagattgatgcacctggagttaccaatttgggtcaagggtccaatgaagctttggtttacatcttgtgcagctaaccatttgagcccagagcctgagacttcgtcataaggagggaggattatggattaggcttctggactcgtggttcgtgatgttgtcacgttagaaacagatctagcgcggttacaagtttagatctgaagtgacacaaaaggccccagctgtgatgaagtccaaagccacattctctgagggtgccctactccctgggaagacccacccaaagtcctggctatgaagcagatcactggggctgaccttgggtgtattaagttttggagtcagggtcaccaaagtgtgagtttcacagttgaacacgatggttcagaagcagggtatagaatgaaaggcaggagataaaattgcacttctcaattgctctgaactctagctagacttgacatgggacgtgaataaccttcctgtctagagagctgcctccttgaagtgtgacattgtctctctcacttccagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttatggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaattattaataggtttatttcaaatagtttggaaattgttgtacttttgaaaacatgctgttcctgtagagttttttgatgagagttatagttgttatatatacctaaagataattttcttttcatttttaagtgagaattctttttatcctaaatcttttattatctttaaatttttttctgtattattatatgtgctcctgaagcgagcactctttttatctatgatacttccataataatctcttctatttatagctattggtagttccccaccagaaaaaaacataattctggtgatagaaatttttatttgctgtttaggtttgtgactgacttgtgagaattcagttgtgatttttaacatgtctcagatatatatactaacacgtctaatatatactatctattttattggtttattttgaaaaacatgggtatagaattatttaaatattattttatttactgaaatatttattaaatatatttatttatttaaatattattattactttaaatattattttaaatattttggaaatactggtatttttgaatagatgctgtttctataaagctgtgtgatgggtattataactgttgtatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtggtagttcccctaaattcttgtaaaaataaatttttatttgatatttagtgtatgtttgaaatgtgagaattcagatggaattttttatcttgttttggcatgtttgtatgttactttaaagaggatgtgtgttctaaaggaggacatgagctgtgtgttttcaagagaacagtgcagtgcatctcttggggaaacataataaagatgaacttttctcaccttcacagtgagtgtgatcatattgtggtctggattgattatttgctgtcaagtgacatttttccttaatggggttgtggttatttgaacatatttgttagctttggaagataatcctgtgctgttttttatgtagaaaaaaacatacggctgggtgcagtgctcacacctacaatcccagcagttttggaggtcatggcgggaggatcacttgaagcctatttttaatttttattttttaaagaaaaacaacagaagagaaggctgatcccaagctacagggtttttttgtttgtttgtttgtttgtttgttttggagacagtctcgctctgtctcccaggctggagtgcagtggcacaacctcggctccctgcaactttcacctccgcgttcaagcaaattctcctgcctcagcctcccaagtagctgggactacaggcatccgcctgtacgtctgactaacttttgtaaaaatagtagagacaaggtttcaccatgttggccaggctggtctcaaactcctgacctcaagtgatccacccgcctcagtctcccaaagtgctgggattataggcatgagctactgtgcccagaccccaagctagagttttaaagcaggaaatgagagaaagatattgagagaggaaaaccaggtggtaagaaaactctaaaggtggctgggcatggtggctcacgcctgtgatcccagcaggagttcgagaccaggcaggagaatcactagcagagaatatgtctccccaacccctctcaaaaaaaaaaaaaaaagtccaggcgcggtggctcaggactgtaatcccagcactttgggaggctgaggcgggtggatcatgaggtcaggagatcaagaccatcctggctaatacggtgaaaccccatctctgctaaaaatacaaaaaattagctgggcgcggtggcaggcgcctgtagtcccagctactccggaggctgaggcaggagaatggtgtgaacccaggaggcggagcctgcagtgagcagagatcgcgccactgcactccagcctgggtgaaagcgcgagactccatcacaaaagaaaaaaaaaaaaagaaagttcctgcaacagttcaagctgtgaaagacaggcactctgccatgcaattctttgtgatttttcttttttatttttggagtcggggtcttgtgctgtcacccagactggggtgcagtggtgcggtcatagctcactgtgggctcagactcaagctcaagcaatcttcttatcttgcctttctaattgctgggattataagcatgagccactgcacctggcctgtgtgacgtaattctgatgtcaactccctgatgttacatcaaatgccacaggttaaggccaccagcccccgctaggctgccctcgcttcagatgcagctgcaagcttgggtgtccacagaccgcatgtacttctcaccaactggctgcaaatttggaggttcccaccacgtcctcaggtttgataattcaccataacaacccacagaactctgaaaagcatgatactttctctttctttatttgagacagagtcttgctctgtcacccaggctggagtgcagtggccaccatgcttggctaattttagtatttgtattagagacagggtttcgccatgttggccaggctggtcttgaactcctgacctcaggtgatccacccaccttggcctcccaaagtgctgggattacaggcatagccactgtgcctggctgacttctagagtttcaataacagagatgtggttcaagaagaaaagggagacatgttttgtagacagcaggagcttcatgaaaagaagccaatgaagggcaggatgtgtagctgtctacctacaggaaaccagccaggagcctccccacagggacttcagcacagatggccgggaaaatctgcattcacctgagctctggacctaagagaggacaaggccttgactgtttctacagactcacaagatgcaatctctgcggtccatgcccgtggtgtgatctgggaaacagggggccttctaaatgccaacaacaaggaaatcaaatgtgcaacagacagaaatatcggcattgacacgggccatggagaggcctaaacagatgactgcagtccactgccaaggtcatcaaaggggtgactctgaaataagaaatttcagacgccacggcccaaatagctgcacgaggtggggaagtcctccacatgcctctgcttccttcagtacctcttcatgaaataagccgaggtacttccctggggaatttcctttctctttctttctttcgagacggagtcttgctctgtcgcccaggctagagtgcagtggcgcgatctcggctcactgcaacctctccctcccgggttttggcaattcttctgtctcagacttctgagtagctgagattacaggtgtgtgccaccatgcccagctaatatttgtattttcactcgagacagggtttcaccatctaggccaggctggtcttgaactcctgacctcatgatccacccatcttggcctcccaaagtcctgggattacaggcacgagccaccacacccagacttctttttttattttttgagatgaagtttcgctcttgttgcccaggctggagtgcaatggcgagatctcagctcactgccacctcctcctcctcccaggttcaagtgattatcctgcctcagcctcccgagtagctgggattacaggcacccaacaccaaaccccgctgactttttgtatttttagtagagatggaatgtcaccatgttggccaggatggtcttgaacccctgacctctaatgatctacccgaattggtctcccaaaatgctgggattacaggcgtgagccactgtgcccagcccctcccatacctcttttggccaaggcagtacaattcagagaatcttgccagggaagactggtaaatggacatcaacatgatgcctatggctcctggtggatttagatacctcctggtgcttactgatacctttaccagttacatgggggcttttccatgccagactgaaaatgctggagatcactgatcaaccttcaactatttactagcagaacactgaggggactctgcagtcaccaatatctcctattgcacttggataaacacctcccgggaaatagagatgaatagaaaggaaatacttaaacaagcagaatggctacattccttcaaccagaagggtccattagtctgttttcacactgctataaagaactactggaaactggggaatttatgaagaaaagaggtttaattgactcacagttttgcaggctgtacaggaagcatggctggggagccctcaagaaactgacaatcacggcagaaggcgaaggggaagcaggcacgtttctggccatggtggagcaggagagacagagagagtgaagcaggaggtgctgcatgcttctaaacaaccagatcccatgagcgctcactcactatcacgagaccagcaagggggacgtcagccgccatgagccaatcatctcccaccaggtccctccctcaacactgggaattgcaattggacatgagatttggttggggatacagagctgaaccatatcaagggtagttcaaccactgagattgattgattgactgagatggggtcctgctctgttacctaggctggagtgcagtggcacaatctcggctcactgcaacctccgcctcccaggttcaagcaattctcctgcctcagcctccctagtagctgggactacagcacacgccaccacacctggctaatttttgtattttcagtagagacggggtttcaccatgtttgcccggctggtcttgaactcctgacctcgtgatcaccctgcctcggctcttcttttgctggaattacaggcgtgagccaccgcacccggacaaccactgagatttagaaggcagtcgagtccactataccacacctcacctggtttcttcctctgttggggcccctcgtggccactgttctgttactttttggtcctatttatttaaatggatggtgagctgtttgtcctccaggatccaacacttccaccttcagcttgtattacaacaataccagcctttcaagctactccgggtgaccccagaactcatctgaactcagaagcccaagagtttcattcctctcactttaggggactaagtgcccctggtcagcatgaagtcgatacagaagcatgacctccatccctaatccctcaagaatgaggagtggaaggtgttggcaggagggtgggacgcggtttgtaaatctgtaactgcatcagaccaaatctagttcaactttttttttttttgatggagtttcactcttgtcacccaggctggagtgcaatggcacgatctcagctcactgcaacctccacgtcctaggttcaagcattctgctgcctcagcctctggggtagctgggattacaagggtgcgccaccacgcctggctaatatttatatttttagtagagacggggtttcaccattttggccaggctggtcttgaactcctcgacctcaggtgatccacctgccttggcctcccaaagtgctgggattacaggcgtgagtcaccgcacccgaatcagttcaacttttatgtaatgaagttgtcagttgttttccaattgccatcgacctgcaggttgaaggtcatgtaccctgtgcatgcccaggttaaccacgcgtgccaccgtggagtggaacctaagagctcagcctgaagagcccggaccgatttaagaaccagacacccccaggcaggagccaggatccaatcagattgagttttggtgtcaccccatggcaggatccagtcagatcacacctcccagcattactttattgcaagatccaatcaaatcacacctcattaccctatgcttataaaacctgacacagcccccagctgtgtaagggagatttgagtacttcctcctgtgttcttgctggctgacttacaaaaaagctttaaaaaaaaaagccaggcgtggtggctcacgcctgtaatcccagcactttgggaggctgaggtgggcagatcacttgaggtcaggggtgcaagaccagcctggccaacatggtgaaaccccatctctactaaaaatacaaaaattagctgggtgtggtgacacacacctataatcccagctacttgggaggctgaggtaggagaatcacttgaacccaggaggcggaggttgcagtgagccaagatcacaccactgcactccagcctgggcgacagagtgagaagactccgtctaaaaaaaaaagttaaaattagcaccaaacgctttacaagtaaaaaaagtttttagctgcatatgtttaagtaactttttagattataagaaatacgcatgcaaaatggaaaggcacaaagaagagagcaaaaagtgcatgagatctcacatccaaggataaccgctgagaacatggaagtgctgactcttcagtctttatactatacacatttaggcctgttttgtttttataaaactgtaatcatataatacagacagttttataatctgctttttaaacacaacaattatataacatttagctgtttcatttgcattcaaattcataagggttccagtaactcatttatcagaaaaccaagagaaatattctcataaaaatataagtacataaggtcaggcatggtggctcacgcctgtaatcccagcactttgagaggccgaggtgggcggatcacctgagggcaggaattcaagaccagcctggccagcctggacaacatggtggaaccccgtctccactgaaaatacaaaaattagccgggcgtggtggcgcgcgcctgtaatggtagctactcagaaggctgaagcaggagaatcgcttgaacttggcaggtggaggttgcagtgaactgagatcgcgccactgcactgcagccagggcgccaaagtgagactccatctcaaaaaaagataaaaataaaaaataaaaaaaatgtatatatatgtatatatatttttccagacagggtcttactctgtctcacagtctgaagtgtagtgacgcaatcatagctcactgcagtctcaagttcctgggctcaggtgatcctcccacttcagcctcccaagtagctggaactacaggtgcatgccaccatgcccagtcaattttttttttaatttttcatagagacagagtctcactatgtttcccagtcctaataaacattatgtgataaaaagaaaaaagtaaatcatcctgaagttaagtctttaatgagaaatgcaaataaagcatttctcaataaattatgggaagagaatcaactgaagaataaacatctttagtaaatcttttgctcatgtgcattaaccaatactcttgaaaaccaggattaatttactgtaccttcttaatattcctttgaaattccttatggcgcacaggtagcgtagaaaataactgcttcacgctgactgtggtccctctggggtgggggtagggggttttctggatgattttcccatcgtgatcaaaaacaccagttgagtcccaaccttcgccgatacgtggcaggtagaaatggtgacatcactgtgagagaataccaggcatggtgtgttcagtgagagatccatgatgttgggcactgactactcttttcttcacttgcttttctctcaaaattttcttaaaaagctgatgatccctctgagataaccgagatctaaacggttgaggagtcatcacaaaatctaaggtctggcatctaaaagacagtgagacagagagcactaaacatgctttgttttgataaaagctttgacttcatttttcaggttgaattgcaaaaccataaatgatctcaagatttattgattctcaaatagagatttgttttgttattactcttcaaacaaaattttttaaaagaatttttttaaagaattttttaaaatttttaaaattttttttaaagaatccaaaagatattataattaaaatgtatatgtagggcagggtacggtggctcgtgcctgtaattccagcactttgggaggccaaggagggcagatcacttgaggcctggagttccagaccagcctgggcaacatggcaaaaccccatctctactaaaaatataaaaattagccaggagtggtggtgcacgctatagtcccagctcttcaggaggctgagtcacgaaagtcacttgaacctgggaggcagagactgcagtgagctgagactgtgccactgcactccagcctgggtgacagagtgcgactctgtctaaaaaaaaaaaaaaaaaaaatatatatatatatatatgtatatatatgtatatatatatgtatatatatgtatatatgtatatatgtatatatgtatatatatgtatatatttatgtatatatgtatatatatgtatatatatatgtatatatgtatatatatgtatatatatgtatatatatgtgtgtgtgcatgtaattatttataaaatttagtatctgtgctgtaattaaatagtgctttggtgaaatgtttccctaaaaattgataatgaaaaccaatggtaactatcatttattatctatatgttatgttcaaattgagaagttactgttttaataagggtaaccaattttttaaacaatactatttgcttcatttcattcatttattgctcacatttcagaagtactaggacttagattgcgcagtgagacaaaacagaattcagaagctagaagctgagatattgagatagaaaattgtaaataataatgattccaattaattttcagagaggtttttctaaggggtcaagtgaatggataaaaatattttctcacctcagtgcacaaagtgagctcagagctttcccccgaaagccaaaagtttcaacccgagttaggtcggcaaactcttgaatcttagatgtgtgatgtttcagagc

SEQ ID NO: 6478 - DNA, 256 bp, Homo sapiens
gttattctcctgcctcagcctctcaggtagctgggattacaggtgcctgccataatgcccagctccattttgtacttttaatagagacagggtttcaccatgttggccaggctggtctcaaactcctggcctcaagtgatccgcctgccttggcttcccaaagtgctgggattacaagtgtgagccactgcacccagcctgaatttctccattcttcccacacaccctccccaggttctccttcctgacctctgac

SEQ ID NO: 6479 - DNA, 4226 bp, Homo sapiens
tacctcattaatggatctgtcctttttcttttctaaccacttccttatgttacttctgaaatctagtgaggctctgtggtgtctgactttccctggctgcttctttagttttgtctccttttccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacattcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcatccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatactttttaaaaccttttgcctatcactctggacttttggattgttttttacattcagtgttataatatttgattatgctgattggttttggtgggtactgatgtgaattaataaaaacatttcatttccatgtttattttctaatctcttccacattgtaggctatgtttaccatacgtagcagaatgtatttacatttcttggttctagtcatttgtattcttcgtgagtgtgtgtgtgtgtgtgtctgtgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttcctacctcctttacctgccacttctcataatagtatttgaacctaaacatataccggtgacattctgtgattatcatcctgcccctaccttggtttttatccattgtggtttagatccataatgaaatatattaacgctcatgagctattcaaaagtgaatgtcacagtcatcacttgctgagtggtactcatccttaacagagtcctcatgagggaatcaggtctcgctgagtttagcatgtttaataatcttttctcacggtctcgatacatggatcacattactagatataaggtgcttgtccaaaatgatttttctggagcttttaggagatattgtcatccttgggggacatacatggtgtatgttctcattgtgggattctattttgttctaccaggacctctaatttctgccagttacttcattcatttgttctcttcaccatgagtctccagaggatacttgcatggtccgtgcctgcccatctgccagcaattctgcatttccaagattggcacctctggtcctctgcacggtgaagccccttcctttcaattccccagtagccagtgctctaatccaccaggtctcaggcatgatctatgtttctccacactcgctttctgaggagagttttgcctgggttctatcatgaacaggccctccctgctgtcctggcctctatttgcatagtgtttcctgctccctctgccgtcgtgtggctcccagacctggctaaagaaaatcacctgagggccacagtgttccctagccctggtgtttagggcaggattatgggtgagatttttgagtctctaagttgacccctacggctctgaagtgtaagttgagaaattcagctgttatcatcctaggtggacttgctccctcctatcctcctacttcaaatgcagaacttcaatcgtttacaaaagaagactgaatcgtataatagaacacacccttattcattggctggcttcaccaatcatctcatggctgaacttgtaaaaatacaatcttagccacatacctatgaaatgtatgtgtgtgtatatatatgcatgaatttgcttctgagattatggaggctgaaattcccaagatggaaggaaagctggatatccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaactacaagtaactatcacacatgccctttgtcatattggtgatttccactgtttttctcccaaactgcagcttatatttgttctcttaatactgttgagcaaaaacttttaatttttataaagtcgaatttatcaatgttttctttaatggtttgtgtttattgataataaagaacactttgcctaactctgtgtcatgaagattttgtcttatattttctgctatactttttctagttttatagtttatatttagttgcataatccattttgagttagtttttgagttagtattgaggttcaggtgaatttttttcctttgggtataaaaaaaacaaattgtgtaaaaaaagttgtttctacacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttgcatgaggaataggaaatccccaagcacaattgggggtaccctctac

SEQ ID NO: 6480 - DNA, 6753 bp, Homo sapiens
agttttcctcctaagaaatcttgtgggcattttttttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatccctcaaattgtcctgttctcatgctgaggagcctgagatccctgtgtggggattagacagtggactgttatgggtgtaggtgaattggcttattttgtctgtccctgcctgaatgtattgcaggaattaaaaaggaccaagaagaggaagaagaccaaggcccaccatgccccaggtaactgagcaattgtgaacagctacttctgtgttgacatctggagactcctggttcagggaaaatagagcgggccgacattatcgattacatcttttcaaccaagcctgaattattcctactaacattgctgttggttttcattgcagtagatatttaggtttccatttcttcctccccttatcatttactaacctactgcaggtggaccagacttcaaaaactgtattctcatggtgactgcatggaaacttgagcacattttatggaaaattattgagcacagtcttcatgatcactgtatgctgtgtgtcctgagggcactaactcagagtgtcctgttactccctcatcagtgtgtcacctggacaattcactgagctcgttttctctctctctctctctctttctctctcagtgtgtgcgtgtgtctttgtgtgtgtgtttgtgtgtgtgtgtgtgtgtgtgtgtgtctgtctttctctttcattcttttccatttggccctgttctgtcccaacatgaaggcaataatttgttacctcattaatggatctatccttttacttttttaaccacttccttatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggaggtgagtacgtttctatgaaggtgataaggatccactgagtcttccatataaagatcatattcctgctccaagtggccattactgagctgagagatgtcattgccgcagtgaggacctataggcacatgtaggttgaatgaaactctagttctacctggaagcccagacatgggatgggtcagtgagcatggctctcttcctagtctcaggccatgcctgtggcactctgattctactctcatgacattggacctgggcagatgtgacaaattcagagaactatgattttgactcaagggtttgtagatttcctttttcactctaatttcagtgtctggagtcctcacaaccatgaacaatctgagtatttgatgagacagggctaaatattgcagtttttctcctagaaatcatttgagggtatttgctttaaattgattggaaaaataaggcataactgtttgcacaaacttgggacaaatgatattgggataacgatctactagaatagggacattttacccagagtttctgggagaaaaaccgaggaatttctatcacgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagaagatcaaaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttagtaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactagctcactttctctctgtctctgtctctgtctctgtctctgtctctgtctctctctctctgtctttctctttcattgttttctacctggccctgttctatcccaacataaaggcaataatttgttacctcattaatggatctgtcctttttcttttgtaaccacttccttatgttacttctgaaatctagtgaggctctgtggtgtctgactttccctggctgcttctttagttttgtctccttttccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataattagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttccatgtttattttctaatctcttccacattgtaggctatgtttaccatacgtagcagaatgtatttacatttcttggttctagtcatttgtattcttcgtgagtgtgtgtgtgtgtgtgtctgtgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttcctacctcctttacctgccacttctcataatagtatttgaacctaaacatataccggtgacattctgtgattatcatcctgcccctaccttggtttttatccattgtggtttagatccataatgaaatatattaacgctcatgagctattcaaaagtgaatgtcacagtcatcacttgctgagtggtactcatccttaacagagtcctcatgagggaatcaggtctcgctgagtttagcatgtttaataatcttttctcacggtctcgatacatggatcacattactagatataaggtgcttgtccaaaatgatttttctggagcttttaggagatattgtcatccttgggggacatacatggtgtatgttctcattgtgggattctattttgttctaccaggacctctaatttctgccagttacttcattcatttgttctcttcaccatgagtctccagaggatacttccatggtccgtgcctccccatctcccagcaattctgcatttccaagattggcacctctggtcctctgcacggtgaagccccttcctttcaattccccagtagccagtgctctaatccaccaggtctcaggcatgatctatgtttctccacactcgctttctgaggagagttttgcctgggttctatcatgaacaggccctccctgctgtcctggcctctatttgcatagtgtttcctgctccctctgccgtcgtgtggctcccagacctggctaaagaaaatcacctgagggccacagtgttccctagccctggtgtttagggcaggattatgggtgagatttttgagtctctaagttgacccctacggctctgaagtgtaagttgagaaattcagctgttatcatcctaggtggacttgctccctcctatcctcctacttcaaatgcagaacttcaatcgtttacaaaagaagactgaatcgtataatagaacacacccttattcattggctggcttcaccaatcatctcatggctgaacttgtaaaaatacaatcttagccacgtacctatgaaatgtatgtgtgtgtatatatatatacatgaatttgcttctgagattatggaggctgaaattcccaagatggaaggaaagctggatatccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaactacaagtaactatcacacatgccctttgtcatattggtgatttccactgtttttctcccaaactgcagcttatatttgttctcttaatactgttgagcaaaaacttttaatttttataaagtcgaatttatcaatgttttctttaatggtttgtgtttattgataataaagaacactttgcctaactctgtgtcatgaagattttgtcttatattttctgctatactttttctagttttatagtttatatttagttgcataatccattttgagttagtttttgagttagtattgaggttcaggtgaatttttttcctttgggtataaaaaaaacaaattgtgtaaaaaaagttgtttctacacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttgcatgaggaataggaaatccccaagcacaattgggggtaccctctac

SEQ ID NO: 6481 - DNA, 5860 bp, Homo sapiens
tccatttggccctgttctgtcccaacatgaaggcaataatttgttacctcattaatggatctatccttttacttttttaaccacttccttatgctacccatgaaacctagttggggctctgttgtgtctgatttcccctggcgtattctttactttttcctccttttccaggctcagcagggagctgctggaggtagtagagcctgaagtcttgcaggactcactggatagatgttattcaactccttccagttgtcttgaacagcctgactcctgccagccgtatggaagttccttttatgcattggaggaaaaacatgttggcttttctcttgacgtgggaggtgagtacctttctatgaaggtgataaggatccactgagtcttccatataaagatcatgttcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctactctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattgtaaaaatatggcataactgtttgcacaaacttgggacaaatgatattgggataacgatctactagaatagggacattttacccacagtttctgggagaaaaaccgaggaatttctatcacgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagataagaaggggaagaagatcaaagaagaaaagaagaaggggaagaaaagaaggggaagaagatcaaaacccaccatgccccaggtgactttcagcaattgtggatgcttagttctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccacaggttgaccatacttcaaaagctgtactctcatggccactgcatcgaattttgagcatattttatggaaaactattgagctcactcttttcatgatcacagtttgctgtgtgtcatgagggcactaactcagagtgtccttttactcccttaccagtatgtcacctggccaattcactaggtcactttctctctgtctctgtctctgtctctctctctctgtctttctctttcattgttttctacctggccctgttctatcccaacataaaggcaataatttgttacctcattaatggatctgtcctttttcttttctaaccacttccttatgttacttctgaaatctagtggggctctgtggtgtctgattttccctggctgcttctttagttttgtctccttttccaggctcaacagcgtgctgatggaagtggaagagcctgaagtcttacaggactcactggatagatgttattcgactccatcaatgtactgtgaactacgtgactcattccagcactacagaagtgtgttttagtcatttgaggaacagcacatcagctttgcccttgacatggacaataggttctttactttgacggtgacaagtctctatctggtcttccagatgggagtcatattcccacaataagcagcccttactaagccgagaggtgtcattcctgcaggcaggacctataggcgcctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtagaacactgagcaggacaactgacctgtctccttcacatagtccatatcaccacaaatcacacaacaaaaaggagaagagatattttcggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcagttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgtttttcacattcagtgttataatatttgattatgctgattggttttggtgggtactgatgcgaattaataaaaacatttcatttccatgtttattttgtaatctcttccacattgtaggctatgtttaccatacgtagcagaatgtgtttacatttcttggttctagtcatttgtattcttcgtgagtgtgagagtgtgtgtgtgtgtgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttcttttttctacctcctttacctgccacttctcataatagtatttgaacctaaacatataccggtgacattctgtgattatcatcttgcccctaccttggtttttggtttagatccacaatgaaatatattaacgctcatgagctattcaaaagtgaatgtcacagtcatcacttgctgagtggtactcatccttaacagagtcctcatgagggaatcaggtctcgctgagtttagcatgtttaataatcttttctcacggtctcgatacatggatcgcattactagatataaggtgcttgcccaaaatgatttttctggagtttttaggagatattgtcttccttgggggacatacatggtgtatgttctcattgtgggattcgattttgttctaccaggacctctaatttctgccagttacttcactcatttgttctcttcaccatgagtctccagaggatacttccatggtccgtgcctccccatctcccagtaattctgcatttccaagattggcacctctggtcctctgcacggtgaagccccttcctttcaattccccagtagccagtgctctaatccaccaggtctcaggcatgatctatgtttctccacactcgctttctgaggatagttttgcctgggttctatcatgaacaggccctccctgctgtcctggcctctatttgcatagtgtttcctgctccctctgccgtcgtgtggctcccagacctggctaaagaaaatcacctgagggccacagtgttccctagccctggtgtttaggggcaggattatgggtgagatttttgagtctctaagttgacccctacggctctgaagtgtatgttgagaaattcagctgttatcatcctaggtggacttgctccctcctatcctcctacttcaaatgcagaacttcaatcgtttacaaaagaagactgaatcgtataatagaacacacccttattcattggctggcttcaccaatctcatggctgaacttgtaaaaatacaatcttagccacatacctatgaaatgtatatgtgtgtgtatatatatacatgaatttgcttctgagattatggaggctgaaattcccaagatggaaggaaagctggatacccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaagtacaagtaactatcacacatgccctttgtcatattggtgatttccactgtttttctcccaaactgcagcttatatttgttctcttagtactgttgagcaaaaacttaatttttataaagtcgaatttatcaatgttttctttaatggtttgtgtttattgataataaagaacactttacctaactctgtgtcatgaagattttgtcttatattttctgctatactttttctagttttatagtttatatttagttgcataatccattttgagttagtttttgagttagtattgaggttcaggtgaatttttttcctttggggataaaaaaaaaattgtgtaaaaaaaagttgtttctacacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttccatgaggaataggaaatccccaagcacaattgggggtaccctctac

SEQ ID NO: 6482 - DNA, 2871 bp, Homo sapiens
ttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatcactctggacttttggattgttttttacattcagtgttataatatttgattatgctgattggttttggtgggtactgatgcgaattaataaaaacatttcatttccatgtttattttctaatctcttccacattgtaggctatgtttaccatacgtagcagaatgtatttacatttcttggttctagtcatttgtattcttcgtgagtgtgtgtgtgtgtgtgtgtctgtgtgtgtgtcctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttcctacctcctttacctgccacttctcataatagtatttgaacctaaacatataccggtgacattctgtgattatcatcctgcccctaccttggtttttatccattgtggtttagatccataatgaaatatattaacgctcatgagctattcaaaagtgaatgtcactgtcatcacttgctgagtggtactcatccttaacagagtcctcatgagggaatcaggtctcgctgagtttagcatgtttaataatcttttctcacggtctcgatacatggatcacattactagatataaggtgcttgtccaaaatgatttttctggagcttttaggagatattgtcatccttgggggacatacatggtgtatgttctcattgtgggattctattttgttctaccaggacctctaatttctgccagttacttcattcatttgttctcttcgccatgagtctccagaggatacttccatggtccgtgcctccccatctcccagcaattctgcatttccaagattggcacctctggtcctctgcacggtgaagccccttcctttcaattccccagtagccagtgctctaatccaccaggtctcaggcatgatctatgtttctccacactcgctttctgaggagagttttgcctgggttctatcatgaacaggccctccctgctgtcctggcctctatttgcatagtgtttcctgctccctctgccgtcgtgtggctcccagtcctggctaaagaaaatcacctgagggccacagtgttccctagccctggtgtttagggcaggattatgggtgagatttttgagtctctaagttgacccctatggctctgaagtgtaagttgagaaattcagctgttatcatcctaggtggacttgctccctcctatcctcctacttcaaatgcagaacttcaatcgtttacaaaagaagactgaatcgtataatagaacacacccttattcattggctggcttcaccaatcatctcatggctgaacttgtaaaaatacaatcttagccacatacctatgaaatgtatatgtgtgtgtatatatatacatgaatttgcttctgagattatggaggctgaaattcccaagatggaaggaaagctggatatccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaactacaagtaactatcacacatgccctttgtcatattggtgatttccactgtttttctcccaaactgcagcttatatttgttctcttaatactgttgagcaaaaacttttaatttttataaagtcgaatttatcaatgttttcttcaatggtttgtgtttattgataataaagaacactttgcctaactctgtgtcatgaagattttgtcttatattttctgctatactttttctagttttatagtttatatttagttgcataatccattttgagttaatttttgagttagtattgaggttcaggtgaatttttttcctatggggataaagaaaaacaaattgtgtaaaaaaagttgtttctacacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttgcatgaggaataggaaatccccaagcacaattgggggtaccttctac

SEQ ID NO: 6483 - DNA, 4998 bp, Homo sapiens
gcagttagtataattgtattttaattaaatagggaggttgaagattttttaaatatcaaattctgtaaataaaaagtatgatttacagtctgaaatggaagaaggcagtggattaaacattgcagaagagaagattattgaactagaaggaatagaatttgaaactaacataaatgaaacacacagtaacaaatgacttgaaaacataaaaagaccatcggcatcaaaactttaaaccccccagtatagggctaaatggaatccctgaagggcgtgtagtggagaagagagaaaaagatatttaaaacatactggatgaaagatttagaagctccatggaaaccataaacttcaaatattacagaaatatgattattctaagaacaagaaacatgaagaaaacttcaccaaggaatgccttaatcaaatccatcaaaaccagtgataaaaaggaaatcctaaaaggaataaaaagggaaagaacatgttacatacagagcactaaatataatgatggcataagatttctcatacaaacaagaagtttgcaataaagaacttaaaaaaaagaaaaactgtcacctacaattctacacctggccaaattatcttttaaaaataaacatgagaaaaagtgtttttgaacagaaaacaaaatgatctcaatttgcagatggtgtgatcctatgcatagaaaatcccaaataatacctacagatgcaaacacacatacatgcacacagaggccagtcacacacacacacacacacacacactcacatacacacactactagagttaataagcgaattcagcaaactttcagcaaacaatcagttgtgttagcaatgaacaatctgagaagaaaattgacacaatgatttcatttataatagcactggtaagaataatatgcctgggaataaatttgttcaagaaggtgcagtacttgtacacagacaactacagaacattgctcgaggagattcaggaagacctaaatcaatggacagacatcttgtgtccatgggttggaagttgtaacatggttaagataaaaatacaactcaaagcaacccacagattcaatacaatcctatcaaaaagtggccttttttacaggaatgcctaacaagaacttcatattcctaaaaaatagtgtgtccccccaaaacaaaagcaatcttgaaatgcaagaagaaacattttctattccaaaggtctttaactgctctaagcagtacttggtagtcttcaatatataggctttcacatctctttttttcttcttttgtttctgcacaggatctcactctttcacccaggctggagtacagtggcacaatcacagctcactgcagcatggaattctcaggcctatgacatcctagggcctcatccactgattcctgggactacaggctcacaccaccaaacccggataatttttctgattttcagtagagatgagggctcactatgttgcctaggctagtttcaagcttatgagatcaagcaaccctcctgccacagccttccaaagtgctgggatttgaggccaagcctggctggctttcatgtcttttctatgtagtttatatttctggatgccattgagagtctggctggctttcacatatttgctatgtcgtttatatttcttgatgctattgtaaatgtttattaaaggaatcttttaaaaactttgttttggccaggcgcggtggtccatgcctgtaatcctaccactttgggaggccgaggtgggtggatcatgaggtcagaagatcgagaccatcctggctaacatggtgaaaccccatctctactaaaaatacaaaaaaaaaaaaattagcctggcgtggtggcgggcgcctgtagtcccagatacttgggaggctgaggcaggagaatggcgtgaacctgggaggtggagcttgcagtgagccaagatggtgccactgcactccagcctgggagacagagtgagactccgtctcaaaaaaaaaattgtattaaaattatatatttaaggaattacatatatatttatatatatatataatacatatccttaaattatatatatttaaggaatacaacctgaggactacatatacatatacataatgaactaatgcctactaggtgaggggctgccttgtgagcaaacccaaggtccttggcttatgaagcctttgtctagaaggatggagggatcagcaaggtgggcacacagcaggttctgtctttggtgtgggcttctgcccactcgggtctctggcaatactaatcaggcttcacgatgggtgaggtgagctaggaatgggaaagtggatgacttcagatccagagactgcagttgtcacctggggacctggcgtaggggtggaggagtctcccactgacttggccatgggtcaatgcccaaacatgcacaaggatgggactctcggcctcaatgctttaggagcccccagtcttctaaagagggtttgtggtggggaagaatgttcaacaaaacagaagagttatgggtgctctagcttggcaacggagaatacttccttgtgctactaaatggcaatatttgacaattacggatgacacaattgagcaacagctttcactgtttaacaagcagtgtctctggaacactaggttagtgctgtcggatgttgactgaaaagtcagtggtttgagcccatccagtcatattaatgtttctagctgacgtgaccttccatctgaagagtctcttccttggaccaaatatctcttaaagcttctcttcttcttgtctcttgtctattttctaaggtgcctctttgttgcttggggcaaaaaaagtccatttttaatccacacccaacaaacatctacccttacgtatcctggtttttagggttttgagtttgttgtttgttttctcagcttctcatatttggaatactggaaattcctaaagtggagaatgacagaacgtgaatcacagctatggtgaagccacaggctctggatgaaaaacctaatctgccagggtttgaagttaaacacattaatcttctgtgcctccatttctatctgtccaatgggctaaatcagaacacttaggttgtccagtgtttaaatgagcagtgcaggaaaagcatggagccaatgcctgtcacgtagtaattggacaacacgcatgagctcctatcagcgccatggtctccagcatttccatcaggttttgatctttgaaatgtccttcttgatatgaaaggatcattcctcaaacattctctaaccgatggccatgaaattgctccaatgtgtattattacaaatacaactgcagggaccagactgacacatgtatctgtcgtgcatcgcttgtctatttctccgtagacacctggagatggaattgtcagaccaaagtatttatacatgtttgattttgctaatttctgtctaaattactgtgaaaagaaaatataatatgtcatacttttaatattttttgagaattcttttttctccatcttctggtcaaaactgggaagtacttgcctaccatttcctctgaacttacttttgccaacatttgtgtagtcatacagtgggatcacattgtatgcaagacatcaaactcaaatccttaaatgaaagcgattaacatgactgtgtaaaaacttatcttcaaaatacaatgaatacatatatacacatacttatatgggaaaggaattatttggatactttatcaaagttatatatacttgaaaatttgtttagtaaaatagcagtgcccttgtgtactcccagagtttcatcacatagaagcaattatttcattatttatctccttatgcctaaatagatattattactttttgattttcaagtttaggcactacctctccttcacatacttgctcatcaccaccacccccaaacacgcctctcaccaccttacccttcaacacgtttgtgtcctcgtttgctgggtcaattgctacattgttataacttgtatattttattcagagttcagtcacattggatatacatagcaggaatgagaggccagtatcttcagggactctctctcaagtagataagcttcagagatttttgtagtctttggtcactctccccatctttttcctattccaggtaagtactggatctgatgggcccagctcaggtcaggcactctctccttgagcaggggagagcgggacatcttcatgtgcagtaccaggaagacactgtccaaagagggacaggtagttctaagacagaaaagtctgtctggggtacaggtaggcaaaacaaggacacacacacaaaaattagtctgttctgtgaggggagcatgcagtagagggtggattcagagtgggaggggagagttttgagagatatgggccatggatatcactctgtgggccggagccacacaagacggttggggtctctcaggggcagggagctgaggaggatctgccctccccaacctgggagactggtgaggggactgtcctggtcaccagacagaaatggggtctgggccagggcagttctggtgggaaagaaagaacaggacatctccttaaggaaaggtcctgagtcaggtcttggtagggagggaggttaccttgcccattggcagctgaagatggttggccagatgagggcactgaaatccatgtcctctaaacttgtagttcagtaaaagaacgacagcagtaaagggtctttaggaagaggaggtggaagacctgatttgggttgggggctccaagaagaatgtctgccttgctgtgcagaagcctgctacacaacctccctggtccccttgctcagtctcctggccagacccctgtgagccctggaagtgcacagtcagctcggccaaggcatctccagccaggactcatccctgggcatttctgtggccttgggtgccctggcctccaggccctgtcttgcaggcaatcatcctgc

SEQ ID NO: 6484 - DNA, 5008 bp, Homo sapiens
gcagttagtataattgtattttaattaaatggggaggttgaagattttttaaatatcaaattctgtagataaaaagtatgatttacagtctgaagtggaagaaggcagtggattaaacattgcagaagagaagattattgaactagaaggaatagaagttgaaactaacataaatgaaacacacagtaacaaatgacttgaaaacataaaaagaccattggcatcaaaactttaaaccccccagtatagggctaaatggaatccctgaagggcgtgtagtggagaagagagacaaagatatttaaaacatactggatgaaagatttagaagctccatggaaaccataaacttcaaatattacagaaatatgattattctaagaacaagaaacatgaagaaaacttcaccaaggaacgccttaatcaaatccatcaaaaccagtgataaaaaggaaatcctaaaaggaataaaaagggaaagaacatgttacatacagagcactaaatataaggatggcataagatttctcatacaaacaagaagtttgcaataaagaacttaaaaaaagaaaaactgtcacctacaattctacacctggccaaattatcttttaaaaataaacatgagaaaaagtatttttgaacagaaaacaaaatgatctcaatttgcagatgttgtgatcctatacatagaaaatcccaaataatacctacagatgcaaacacacatacatgcatacagaggccagacacacacacacacacacacacacacacacacactcacatacacacactactagagttaataagtgaattcagcaaactttcagcaaacaatcagttgtgttagcaatgaacaatctgagaagaaaattgacacaatgatttcatttataatagcacttgtaagaataatatgcctgagaataaatttgttcaagaaggtgccgtacttgtacacagacaactacagaacattgctcgaggagattcaggaagacctaaatcaatggacagacatcttgtgtccatgggttggaagttgtaacatggttaagataaaaatacaactcaaagcaacccacagattcaatacaatcctatcaagaagtggccttttttacaggaatgcctaagaagaacttcatattcctaaaaaatagtgtgtccccccaaaacaaaagcaatcttgaaatgcaagaagaaacattttctattccaaaggtctttaactgctctaagcagtacttggtagtcttcaatatataggctttcatatctctttttttcttcttttgtttctgcacaggatctcactctttcacccaggctggagtacagtggcacaatcacagctcactgcagcatggaattctcaggcctatgacatcctagggcctcatccactgattcctgggactacaggctcacaccaccaaacctggataatttttctgattttcagtagagatgagggctcactatgttgcctaggctagtttcaagcttctgagatcaagcaaccctcctgccacagccttccaaagtgctgggattcgaagccaagcctggctggctttcatgtcttttctatgtagtttatgtttctggatgccattgagagtctggctggctttcacatatttgctatgtcgtttatatttcttgatgttattgtaaatgtttattaaaggaatcttttaaaaactttgttttggccaggtgcggtggtccacgcctgtaatcctagcactttgggaggccgaggtgggtggatcatgaggtcagaagatcgagaccatcctggctaacatggtgaaaccccattcctactaaaaatacaaaaaaaaaaattagcctggcgtgatggcgggcgcctgtagtcccaggtacttggaaggctgaggcaggagaatggcgtgaacctgggaggtggagcttgcagtgagccaagatggtgccactgcactccagcctgggagacagagtgagactccgtctcaaaaaaaaaaaattgtattaaaattatatatttaaggaattacatatatatttatatatatataatacatatccttaaattatatatatttaaggaatacaatctgaggactacatatacatatacataatgaactaatgcctactaggtgaggggctgccttgtgagcaaacccaaggtccctggcttatgaagcctttgtctagaaggagggagggatcagcaaggtgggcacacagcaggttctgtctttggtgtgggcatctgcccactcgggtctctggcaatactaaccaggcttcacgatgggtgaggtgagctaggaatgggaaagtggatgacttcagatccagagactgcagttgtcacctggggacctggcgtaggcgtggaggagtctcccactgacttggccctgggtcaatgcccaaacatgcacaaggacgggactctcggcctcaatgctttaggggcccccagtcttctaaagagggtttgtggtggggaagaatgttcaacaaaacagaagagttatgggtactctagcttggcaacggagaatacttccttgtgctactaaatggcaatatttgacaattacggatgacacaattgagcaacagctttcactgtttaacaagcagtgtctctggaacactgggttagtgctgtcggatgttgactgaaaagtcagtggtttgagcccatccagtcatattaatgtttctagctgatgtgaccttccatctgaagagtctcttccttggaccaaatatctcttaaagcttctcttcttcttgtctcttgtctattttctaaggtgcctctttgttgcttggggcaaaaaaagtccattttaaatccacacccaacaaacatctacccttacgtatcctggtttttagggttttgagtttgttgtttgttttctcagcttctcatatttggaatactggaaattcctaaagtggaaaatgacagaacgtgaatcacagctatggtgaagccacaggctctggatgaaaaacctaatctgccagggtttgaagttaaacacatgaatcttctgtgcctccatttctatctgtccaatgggctaaatcagaacacttaggttgtccagtgtttaaatgagcagtgcaggaaaagcctggagccaatgcctgtcatgtagtaattggtcaacacgcatgagctcctatcagcgccatggtctccagcatttccatcaggctttgatctttgaaatgtccttcttgatatgaatggatcattcctcaaacattctctaactgatggccatgaaattgctccaatgtgtattattacaaatacaactgcagggaccagactgacacatgtatctgtcgtgcatcgcttgtctatttctctgtagacacctggagatggaattgtcagaccaaagtatttatacatttttgattttgctaatttctgtctaaattactgtgaaaagaagatataacatgtcatacttttaacattttttgagaattctctttttctccatcttctggccaaaactgggaagtacttgcctaccaattcctctgaactcacttttgccaacatttgtgtagtcatacagtgagatcacattgtatgcaagacatcaaactcaaatccttaaatgaaagcgattaacatgactgtgtaaaaatttatcttcaaaatacaatgaatacatatatacacatatttatatgggaaaggaattatttggatactttatcaaagttatatatacttgaaaatttgtttagtaaaatagcagtccccttgtgtactcccagagtttcatcacatagaagcaattatttcgttatttatctccttatgtctaaatagatattattactttttgattttcaagtttaggcactacctctccttcacatacttgctcatcaccaccacccccaaacacgcctctcaccaccttaccctccaacacgtttgtgtcctcatttgctgggtcaattgctacattgttataacttgtatattttattcagagttcagtcacattggatatacatagcaggaatgagaggccagtatcttcagggactctctctcaagtagataagcttcaaagatttttgcaatctttggtcaccctccccatcgttttcctattccaggtaagtactggatctgatgggcccagctcaggtcaggcactctctccttgagcaggggagagcgggacatcttcatgtgtactaccaggaagacactgttcaaagagggacaggtagttctaagacagaaaagtctgtctggggtacaggtaggcaaaacaaggacacacacacaaaaattagtctgttctgtgaggggagcatgcagtagagggtggattcagagtgggaggggagagttttgagagatatgggccatggatatcactctgtgggccggagccacacaagacggttggggtctttcaggggcagggagctgaggaggatctgccctccccaacctgggagactggtgaggggactgtcctggtcaccagacagaaatggggtctgggccagggcggttctggtgggaaagaaagaacaggacatctccttaaggaaaggtcctgagtcaggtcttagtagggagagaggttaccttgggcattggcagctgaagatgcttggccagatgagggcactgaaatccatgtcctataaacttgtagttctagtaaaagaatgacagcagtaaagggtctttaggaagaggaggtggaagacctgttttgggttgggggctccaagaagaatgtctgccttgctgtgcagaagcctgctacacaacctccctggtccccttccttagtctcctggccagacccctgtgagccctggaagtgcacaatcagctcagccaaggcatctccagctgggactcatccctgggcatttctgtggccttgggtgccctggcctcctccaggccctgtcttgcaggcaatcatcctgc

SEQ ID NO: 6485 - DNA, 423 bp, Homo sapiens
ctggtatgttttctagataaatggctgacttttcacccacaaaagccataatagctgatgcttctgtgtagaaccaagtttcattttgactcaagagctggtacattgcaccccctcatcaaatctctgtgtccacaatctcataaactatcaaattctgggtatttgatgagagaaagcttaatattgaagtatctctcctatgaggtgttagaactatttgcctacaatttattggggaaaaaattgctcatttgtgtacataaacctaggacagagcacatagggaagataacattccaactcaggggaattttgcccaaggctcatgaaagaacccaagccagttttctcaagacttgacctcaggcctactggaatatttctctcaaagtctcctgttctcacattgacaagactgat

SEQ ID NO: 6486 - DNA, 560 bp, Homo sapiens
gcagttagtataattgtattttaattaaatagggaggttgaagattttttaaatatcaaattctgtaaataaaaagtatgatttacagtctgaaatggaagaaggcagtggattaaacattgcagaagagaagattattgaactagaaggaatacaagttgaaactaacataaatcaaacacacagtaacaaatgacatgaaaacataaaaagaccatcggcatcaaaactttaaaccccctagtatagggctaaatggaatccctgaagggcgtgtagtggagaagagagacaaagatatttaaaacatactggatgaaagatttagaagctccatggaaaccataaacttcaaatattacagaaatatgattattctaagaacaagaaacatgaagaaaacttcaccaaggaacgccttaatcaaatccatcaaaaccagtgataaaaaggaaatcctaagaagaataaaaagggaaagaacatgttacatacagagcactaaatataatgatggcataagatttctcatacaaacaagaagtttgcaataaagtact

SEQ ID NO: 6487 - DNA, 4226 bp, Homo sapiens; identical to SEQ ID NO: 6479

SEQ ID NO: 6488 - DNA, 6753 bp, Homo sapiens; identical to SEQ ID NO: 6480

SEQ ID NO: 6489 - DNA, 5860 bp, Homo sapiens; identical to SEQ ID NO: 6481

SEQ ID NO: 6490 - DNA, 4998 bp, Homo sapiens; identical to SEQ ID NO: 6483

SEQ ID NO: 6491 - DNA, 5008 bp, Homo sapiens; identical to SEQ ID NO: 6484

SEQ ID NO: 6492 - DNA, 423 bp, Homo sapiens; identical to SEQ ID NO: 6485

SEQ ID NO: 6493 - DNA, 6753 bp, Homo sapiens; identical to SEQ ID NO: 6480

SEQ ID NO: 6494 - DNA, 3391 bp, Homo sapiens
gcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagtgagtaccttactatgaaggtgataagcctccacctggtcttccagataggggtgatattcctgttccaagtggcccttactgacctgagagatgtcattgccacaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatatctgtcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacatctacttctgtgttgacatctggagactcctggttcagggaaaacagagcgggctgacattatcgattacatcttttcaagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctctgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagattgtgtttgatgtcatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactagctcactttctctctgtctctgtctctgtctttctctctctgtctttctctttcattgttttctacctggccctgttctatcccaacataaaggcaataattttttttttttacctcattaatggatctatcctttttcttttctaaccagttccttatgttacttctgaaatctagtggggctctgtggtgtctgattttccctggctgcttctttagttttgtctccttttccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccac

SEQ ID NO: 6495 - DNA, 4998 bp, Homo sapiens; identical to SEQ ID NO: 6483

SEQ ID NO: 6496 - DNA, 437 bp, Homo sapiens
gaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacggaggttgaattactcctactgccattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcct

SEQ ID NO: 6497 - DNA, 4226 bp, Homo sapiens; identical to SEQ ID NO: 6479

SEQ ID NO: 6498 - DNA, 6753 bp, Homo sapiens; identical to SEQ ID NO: 6480

SEQ ID NO: 6499 - DNA, 5860 bp, Homo sapiens; identical to SEQ ID NO: 6481

SEQ ID NO: 6500 - DNA, 4998 bp, Homo sapiens; identical to SEQ ID NO: 6483

SEQ ID NO: 6501 - DNA, 5008 bp, Homo sapiens; identical to SEQ ID NO: 6484

SEQ ID NO: 6502 - DNA, 423 bp, Homo sapiens; identical to SEQ ID NO: 6485

SEQ ID NO: 6503 - DNA, 6193 bp, Homo sapiens
agaaacagcagcagtcgtgcagtatcatccacagcctgagagagagtcagcagcaagagctgagccggtttctgaacccgcccagcatcgagaccacccagcccagtgaggacacgaatgccaacagtcaggacaacagcatgcaacctgaggtatgggcacgaggcgtcctctgtcccaggacactctgtgggcttctttcttttaataaaaataaataaaatgggtgctggtcagatcattcaaacaaggtgacaatatttctaataggaatattttcattaaaaaaaaaaaaggcaacggaaatccattgatccagattatgtctatgtctttgccatcttggatgcagttgaggttatttaaaaagagtctgactcatatgaatgccaaaaaaagtgaatgccctgaacttcataattctgtagttttatttttgtctaaagagttaacatcagctctaagggctgcatttgaatctgggtatattacatggagtatggtttacaggaagctctgccctaaatattttcctcccttctctaaagtcatagaaatttgcagtaaaatcagtgaaaatgtttgtaattagctttcaacctccttaaataatcagactcattgaagatatatcctttcctggttgggtatcagaagaacatatggaattcaggacaattggcttgaggagtttctatttattaagtcacagcatattttcattttcaaactctatgtatgtgtctatataaaaaagtacaaggagttatcagcgtcctggagagtcctgtgctgtgagaagcagctggctgggaggacctgcccctttatgaggcagcaattacgatttgaggttaacaacgtggagctgatcccgtgctctgtgcagagcccccagcagcaccaggctccatggtgtgcagcaacgcagccaggggccagagtacctttggaagcctaaggctccacggcccagcagggtgctccaggaggcccactggtgccatagctcagttttcagtagatctcatgttttgggctccccagcctttagaaatcatctgccaccgactgcagggacttctgcggagttagtcaaccaaggggcaaggggaggcatctgcagtggccttgccactggtcaccctgaagatggttggcaatgtctcgcatgggagagggaggcaggctgaagtcaggacagacagtgagacagggctaatgaggttggggaaagtgatgatttcagagccctctgtttttagatgaaaaagcctaagaaagaaagaggtgacaaaaaaaaaaaaaaaaggatactaaagagatgtgaagaccaaggcttttgttaggaaagggagaggtgacaggtgaacctgagaacaggtgaaatgtgtgggaagtcttggcatctctctttctttcactgtagcttagattgttatcagctccatcctccaccagggcccatcatacagctttgcctgcagagaactctttccctgaagctctaagtgtggatctccaggctggtgacagtagactgcccccgcccagcccgtccccactgccccaccttccttcctgcagttccccttccttaccccctggtttgccagcgaagatatgaagggaaacaatgacattctcaggcatggaggggaacgaaccatgggggttacccaggacaagatgtcccagaaagagtggtgtgtccttcagcagggcgtgcagtggtggctcttattcttctgtaacccttaatacccattttcacttttccccattgtggacactctgagtccatgttgttcttcccacttgtcctcctgccatgtgttttcctttcttatagtaaaaggaggagagcgcagggttaaaaagacggtaactgtgtgcttctcctcccatgcagacaagcagccagcagcagctcctgagccccacgctgtcggatcgaggaggaagtcggcaagatgcagccgacgcagggaaaccccagaggaaatttgggcagtggcgtctgccctcaggtaggtccatccaggcatttctccagcgatcgaggcattttaaaggtatttactctgtttgtgtgttttgggtcttgcctttcaaaatgcaagtctgcatctacagttgtttacagacagcaacataatgaaaaatgtagtcttgtcaaaaacattgtcccccaaaataacttctctaaatatgacttacattagcccccattttccgggtacatttcaggctatcatggttgagaagccagcacctatgaaaaagacaagattcagcaagagggagaaatttccaagggctttctgtgtgcctcaaggcatgctcaaacatgggcaaaagtattcaactgaagagggagtgggcagatgcaatcattcagaaaatgccacgaagttctcaaaaaagggacaggcccccgatttctctcagcacactttgcagctgagccggtcactggctttaggcaagctgctttacctccatacaataacaaacaacaacaacaaacacttacgtagtactcactgtatgccagtcactcttctaagtgcattacttgtgttctctcattcaatcctttaataaacagtcccattattttccatattttactgattcagtaagagaattttcttctatgagcttcttctctatagggttttggaaagccaggataatcccattaagagcactcaggaatggagggagagcaatgctccccacagcccagtgtccttgtacatgtttttttctatagataactaagttcatgctaaagcaggagctttataatgctctttaactgtgccccaacttcagcccaattgaaaggagaagatgtgtagcatatgtgttccacaaagcagatgacagcacagcttacattttgaggctgacgatgttcagtgggtcttcactgggactaccaccaaggaaagtatcccctttcatatccaggaacttatttttcagagatcagagaagatctaggttcctcctgattcaaacacagcagagaatgacagcatcaagacaacgtagatggtggtgccaggtcataaattacaagctgagtcggttcaattttatcctgtaggcaattaggagctagcaaagatttctgagcagtatgtgacttttggaatctgtgctttaggaagttgacttggcagcaaaggagggaattgtctatgacagagcctggaggcaggttacaagctggaggaagttaccgtggtgtgagcacaaggcaacaaaggcatggacagagctgggggccagatactgcagggacagataggagaggtgacctggggagaatgcacagtccttggtattcatttaaatggacaaaagaaatgatgctgtcaaaagtacttccattgggccaggcgcagtggctcacccctgtaatcccagcactttgggaggccgaggcaggtggatcatttgaggcctggagttcaagaccagcctggtcaacatggtgaaaccctgtctctactaaaaatacaaaaattagctgaccggtagtggtgtgcacctgtaatcccagctgcttgggaggctgaggcaggagaatcacttgagcctgggaagcagaggttgtggtgaaccaagattgtgccgctgcactcctgtctgggtgagagagtgagaacctgtctcccaaaaaaaaaaaaaaaaaaaaaaaaaaaaaagtacttccactggtccatgcctaggtggtccccaccaaaaacggtgatcgtgaaatagacatgctcttggggtcaggctgagtttgaggaggcagaggagaagaaaaatagtattttgagggggcagcaacaatgtcacaggtgtcatgctatgcactttcctaagtcatctcatgtaacctgttttaatcctgacaatagtctaattaggacattttcattgtcttcatcttacaatggaggaaacttgggttcagagacgtgaagttgcccatagctacatatccacaggttgcagaggtgggtcccaacaccatgactgtgaggccccagaaccacacctttcctcccataccctcactgcatcccccctcgcctttactgtgggtcacactctccttcctttttgttttttttattgcatatgctaatgaatgcacaggtttctgtgacacttaatagttcccgaattggaatttttttagtgattttctagtttttttaattatttcaaaatgaaaggggtgagcagcacgtttttttcccaaatgacatcattagttgtccatgagcacaattaaaaaaaaaatctatcgtgaacataaagaatcaagtcctgaaaaggatgtttacttagcatctgtggctaggacacgttagccaaaagtatcactgatgggaatatcatgggtttttaggagtgattacaatagggtgaagcaataccaagtggctcataggactcattaattccacagccccaaaaccaataagccattcagtgtcctcagtcaacttacggtttggaggaaggacaaccatgaaatctgtcgtgtgcaaaatgaaccccatgactgacgcggcttcctgcggttctgaagttaagaagtggtggacccggcagctgactgtggagagcgacgaaagtggggatgaccttctggatatttaggtggatgtcaatgtagatgaatttctagtggtggaaaccgttttctaataatgtccttgattgtccagtgagcaatctgtaattgatctataactgaattccagcttgtcacaagatgtttataaattgattttcatcctgccacagaaaggcataagctgcatgtatgatgggttactatcaatcattgctcaaaaaaatttttgtataatgacagtactgataatattagaaatgataccgcaagcaaatgtatatcacttaaaaatgtcatatattctgtctgcgtaaactaaggtatatattcatatgtgctctaatgcagtattatcaccgccccgcaaaagagtgctaagcccaaagtggctgatatttagggtacaggggttatagctttagttcacatctttcccatttccactagaaatatttctcttgagagaatttattatttatgattgatctgaaaaggtcagcactgaacttatgctaaaatgatagtagttttacaaactacagattctgaattttaaaaagtatcttctttttctcgtgttatatttttaaatatacacaagacatttggtgaccagaacaagttgatttctgtcctcagttatgttaatgaaactgttgcctccttctaagaaaattgtgtgtgcaagcaccaggcaaagaaatggactcaggatgcttagcggtttaaaacaaacctgtagataaatcacttgagtgacatagttgcgcaaagatgttaagtttcttaagaaaccttttaataactgagtttagcaaaaagaataaaactatatagctcaatttatttaaaaaaatctttgcatgtgtgatgttatcattggcttcatttcttacccaaggtatgtctgttttgccataaatcagcagagtcatttcattctgggtgatcctaacacaccattgctacgttagatttgaaatgacatctctgttaaaagaatcttctatggaaataatggtgccctgcaaaatcttcctttgaactcacaggttagggatcacacaacttacttaatcgttttttgtttttgttttttttccttatatgtcaatggcccatgtcctccgggaaaattagaaaagcaaaatgattacaaagtgctgttagatttcttgtgctgggccagccaagtagaagtggacttgacttggacctttaactattttattacagattggacatttgctgttcagatgttttttaacagagggattatctcagaatcctgtgacctccaggttgttttataatctatttttctctatttaacattcctcagatagataggcaaataggacattccttctgtgtcacagaagtatcgtggtagtggcagtctacagtttatatgattcattgtaactatgagataaagaacaaccagtcatgtggccaaaaggattagatttgatttgatgttcacttggagtttactttttgtacatacaagataaaataaatattggatttgtaaaataa

SEQ ID NO: 6504 - DNA, 336 bp, Homo sapiens
ctctattttttttttttttttttttttttttttgagacggagtcttgctctgtcacccaggctggagtgcagtggcacgatctcggctcactgcaagctccacctcccgggttcacaccattctcctgcctcagcctcccaattagctgggactacaggtgcccgccaccatgcccagctaatttttttgtatttttagtagagacggggtttcaccatgttagccaggatggtctcgatctcctgacctcgtgatccacccgcctcggcctcccaaagtgctgggattacaggcgtgagccaccgtgcccggcccactctattcttaatggtact

SEQ ID NO: 6505 - DNA, 3602 bp, Homo sapiens
gaaggttagaggatttgccctctgaccttggcccagccacttcccccctgtggagcggggttctcaccctgctttttccctggctctgatggagcctttgggctgcagtcgtgcttgagatgaatggccctgcccccgtatcccttcctccatgagctgctgcggcccacctagttgtgacacctggtggtggtcttgtaattgcccacggcttttccctctcctctggactctggcctcctccctccctctgtggccctagcacctggcagatgcattggatgggcagcaggcactcagaacatgtttttataatgaattcctcaaccaagggaactaagggacttgctgtttccttactgtcacctgggattctttttgctgttttctactttctgattgcttttcttcctgctaattcagtttcatcttctcttttcagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccaccgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcaggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgcacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaacaaatatcagccccaccaaaatagttatgttggcactgtgttcacacgcatgtccccacaccccagcgttgggtgcgtctttttgctttttgcccttttccggggcgggcggcctcttcatgttacatccatatctgtatttatatcttatttgtctcactttcaagtgtatcatggcaaatgtacagatttttttgttaataatgtgctaggatttgctaaaaaagaaaaaaaaaaaacccttttgagtttgccctagaataaatga

SEQ ID NO: 6506 - DNA, 651 bp, Homo sapiens
gcattctgggaggccaaggcgggcggattacttgagctcaggagtttaagaccagcctgggcgacgtggcaaaaccccgtctccactaaaaatacaaaaattagctgggtgtggtggtgtgtctgtaattccagctacccaggaagctgaggtgggagaatcgcttgagcccaggaggcagaggctgcaatgagccgagatcatgccactgcactccagcctgggtgacagagtgatactccatctgaaaaatatatatattaatatacatttttttaaaaaggtcaatctggggaaatatcacatctgatggagtcgcctgggagctggttgctgtgccgtgtgtgcggtgacaaggtgggaggtgagacgcatgggctagaatcccacccacgctcctggaggccatgtgagcaggggcctccctcatcggctccatttcctcaactgatcagtgagaacagtggctccccggaaaggtagaagcaggagaaagcctcagcctcgaatcccgagatgagctggagagccgctgagagcagccgggctcccctgcatgcctgcggttcttctctgctggtcactggggactggagcaggctaggcagggcaagagcagagcctctgggagcaaatgcacaacatcacagg

SEQ ID NO: 6507 - DNA, 1933 bp, Homo sapiens
ccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggcacagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagatagggaaagttgattttaggcacacatgtaccctccttgacagcaggaactcagacttcaatcttgggggtctaagaccagaatattttccttctgccagaaaagaatcttgcacatatactcctgaaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattggaaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagac

SEQ ID NO: 6508 - DNA, 269 bp, Homo sapiens
gacactctttcaatgatgaaagagcgtgtaatttatgctacaagtgccagaatcgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaa

SEQ ID NO: 6509 - DNA, 176 bp, Homo sapiens
gtggcagcatcacctccacggctctttcaagctgccctgttcacacagctttcttcagagagcagcccactcctgaggcactggatgggattgtcctggctgaaaccagagacacagccctgcccttggaaacagaggagaaaacaccttgattctgggacctatggtagcagtgg

SEQ ID NO: 6510 - DNA, 2883 bp, Homo sapiens
tggaactgtccctcctaggggggaatgttcactttttttttgtcaggttttatgggggggcaggaacatggtttctggaaaaaatcccattcttttggaattggcccattccttttgggcaaaattttcaaaaggctggatcaacttggtgtggtatctctgatggcttagagtaatggcaatgagggtctctgttgtgatgtcactgagtactttctggggtgcttctgggcaccccttatgatgtcacaggaagcagttcctcagaggttacttcctgtgaacataagggagcaggtacttcctgtgatgtctcaatgagttcttccttgaaggtcactttggtgatatcatgggaaggtgtacttccggtgatgcctagaggtcacgtcctgtgatgtcattaggctgaagcatgtacttcctgtattggacagtgaccagtctctgacctgccttctccctccacacccttctttggtgggtgttggcctgggggtcttcctaggaagagaataaggcacgggacttggatccaatctggaggactctaacggaaaaaaaccaatattgtcagggtcatctccattcaaacacgtcaagtctgcgaactcgccctggagggaggggtgggagatggacctagtgcaaactactgttaaagacctcccttcccacccctgccttttgtgtgcatgcctgtgtctgcgtggctttgtttcattgaatcgggtgagccaagtgtgtggtggctctgtcaggccagtatggccaggtgtagagttcagtgagccatagtagggtcccttgggccagaatgcttcgtgtggtctgataggttagattggtttggtggcttccagcaagctggcatacttcggtgatgtctgatggatcagaatgttttggtgtgctcaccaggggctctggagaactagaatgttctgatggagtctgacaagccaggcggccttgagagttggtttaggagtggctccctgagtgctgtggctgtggtcagctctaaggacctgttggcagactgagatttcagggcctgacaaccatgtagactaggatagctgagacctccctctacccccacccatctccctctcttccttggagaccacctccactttctccaacccaaagcagggcgcccagtgccctggttccatcatcagcatctctgggggaggggcgccccatgcccaccctctcccccatttgtccgcctcctaggtcttccaaacccttttcttctctatgactttgggggaaatccagcctccttgtctctctcctaaaaaaggagggaagaaaagccacagagacaattcctgcccctaaagcctaggagatccctctcccttgctagagagccacccccaaatcaaaatgtgaaaatccctagaaagcaatagccttcgaggtaccttgcactgaatttcccaccccagcccttccacccgatgggaggctgtaacttgggcactggggtgactttttccatgcccttgtcatctccagggtgggaggcaggccccacttcccctcccctatcccccacttcccattgttgttgccccacccctaatctccagactgaacccagatggagatctgagtgccaaaacaattcttgatgtaactttgtacatatcttctactaccgttgggggctcttggggttagaggtgggggcggctctgtgggccattgctcccctccacctctcaaaagaccttacagtatttcacagtatctctacccgcacgcgagtattacagtatctagctggaatatccccctacagccccccaggaccctatgaggaagggaaggagccagggagagtgaagtaaggtctgggactggggaggtgggatctgaatgaactcatttgcatatcatttgcatcctccgcttggcagccgctttctacaaactcattcactggagtctgggtcccaatcagccgggtccaggactcctctcacacagacacatctccggaggctgggcctcctgaaaagtgtttgcttggggtgtctgtgtaacaacccctccctattcatatttcttggggaccccctacccagccagccagggtgatctgaaaggtatactttgctagctcagtgagctagttcactcaccatgttggtgagcagagagccacacctttccccattttaccttgggaaactcactccaccatctttgccatctcttgaaagtcccttctgcaatctgacctcaatcttttgtgctgcagtttgtccagaggggacacagatgtggggtcagggatgaggattattgaaaaacccatcatctctttttttttccccgtctccctattagccaatccgatctcagagtctctgagtggcctccttgcacccttctcttcagcacccagtaggtgcttaataagtgtttgctgcattggattatctccctattccttctcatttgccctctagcttcccataccttctccaagtgtcttcctccctttctttgtctggctccctatgactttctatttttttttcctccgtgtggttcccattgttttctgtcctgtctctatcttagtctttgtctgtcttcctcctttcctcaaatgtctcaactctctctccccaatttccccatttaaaaaaaaaaaaaagtgccaaacttccttggaactgagccgctctggggggagaggaccttggatagaggggaggaaatgggaccatttctctttgaggaggtccctaagaggcattgcaaaagtgtggacatggagctaaattgggtcccccttccacagccctcccaccctgagtttttcttagaatctttgtaagaaaaaaaaaaaaagac

SEQ ID NO: 6511 - DNA, 350 bp, Homo sapiens
caacttacccctatccttttgggtccccccaaattccaccagccaaggagaatcccacttgccaacttcctggcaaatctatggaaactggggaggaggagacaagctcaactcctcctctgctagcccaaggggcggtaccaactggattcaagagaaggacctcaaagctcctatgagaagagggggttcgatgtgccaaattaacctccttcatcccccatctcagggggctctgagccaacctgcccagccaccttcttctgccctgtcccagccacctctacatgggcaaggaggcttcactgcaataattagtaggggtggtgatcagaagacaatgattttgc

SEQ ID NO: 6512 - DNA, 555 bp, Homo sapiens
ctggggaaggggggcaagacgttggtggagtaccaggagctgacgggcgctcgcatccagatctccaagaagggcgagttcctgccaggcacgcggaaccggcgggtcaccatcacgggcagccccgcggccacgcaagccgctcaatacctcatcagtcagcgggtcacctacgagcagggagtgagggcctcaaacccccagaaagtgggatgaggcctgtggtgtgtgctcccacccttttctctcctcccatctcctcctcttccctctcctcctcccccccaactcctgacctcagcttggtgtagtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgtta

SEQ ID NO: 6513 - DNA, 4243 bp, Homo sapiens
gaagatgatgagaagcttattgaggaaatccagaaggaggctgaagaggaacagaaaagaaagaatggaggcaagtgcccctccccaggcccccaggacagagcagcagccaggccatgcaggcttctgctggcctccctgagtgtcctggcactcaacccagcacaggagaggagggggtgctgtccctcaggtggctatagacctgacttcacccacgcggccacatctcaggcttatggaaaggccttcaacgccttgaatatagttttggcatctccttgatggtgaggaagtcccaaggggtgggtttgagctcaggaatcaatcaagccacacctggctaaagaaaagtagacccagctgatccttctgaggctgaaaagcagtgaagccaggtgtgttggcacacatctgcgatcccagctcctcaggaggcagaggtgggagcatcactggatcccaggaggttggggctagcctgggcaaaatagcaagaccccatctgtttttctttaaaaaaaagaggctaagtgcagtggctcacatctgcaatcccagcactcgggagggtgaggcaggtggatcagttgagcccaggagtttgagaccagcccgggcaacatggcaaaaccccatctattaaaaaaaaaaaaaaaagtaactgagtcactgaggtggcccatcaaggccctggctctgaaggatgtctggctgggtgggtggacgtgccaccttccaaggtgccactgtggagcaagacactggtggaagtacagatttgttcttggtttcttgcagtggcatttgggaggtgtccacgttttgtgctttgatcagcatgtggagccactcccgtgtccagaggtcgctgccctggtcccaggctagattccattgaggttggtttaatgtttttctccactaatccccacatccctttcagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcagcaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctccctccagcttcgtctctccaccccgccatccggcaagttacaggggccgccgacagattcgtccaagtgattgggtctaaaccagcatcctcacctccccgactgggtcctggcaggagcaggcccggaaggcccagtagtaagatccccaccactcccctgcc

SEQ ID NO: 6514 - DNA, 3461 bp, Homo sapiens
tggtttcttgcagtggcatttgggaggtgtccacgttttgtgctttgatcagcatgtggagccactcccgtgtccagaggtcgctgccctggtcccaggctagattccattgaggttggtttaatgtttttctccactaatccccacatccctttcagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtgcgcctgctgggcagcccaactgctgggggagacgtttctgccaccctgggtgatgagcagcttttcccccctggctttctggaggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagccgtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcaggcggatgagttgaggtcgggagtttgagtccccgtctctactaaaaatacaaaattagccggacaaggtggcgcatgcctataatcccaggtgctcaggaggctgaggcaggagaatcacttgaacctgggaggcagaggttgcagtgagccaagattgtgccactgcactccagcctgagcaacaaaagcaaaactctatctttaaaaaaaaaaaaaaaaaaaaaaagatctaagatacccattctttctgcctttgcccaggatggaggctttgaagacaggtggtcacctggacctggggtaagggtgcgcagggaggccgggcttgggggcagcctgctgctacgtccttgctggcgcccatacctgttggactgcctgaactttgctactagcctgaacgacagtgccttggaaaggcaggctccatgcggcagcaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttctgaccagccagcaaggggccgtgccagtgcccagagagcaggtcagacaacaggcaaccctgaggcagctggctccctctctctgccctgcagggcttgcgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctccctccagcttcgtctctccaccccgccatccggcaagttacaggggccgccgacagattcgtccaagtgattgggtctaaaccagcatcctcacctccccgactgggtcctggcaggagcaggcccggaaggcccagtagtaagatccccaccactcccctgcc

SEQ ID NO: 6515 - DNA, 344 bp, Homo sapiens
tttcaggctgtgcccactcagacccagccctctccaaacccttctcatatccaccacttgcacgcagctcagtgcatggaggccctccatccccccacctcaccaggcagctgcctgccatgctcagacccctctgcccagccttgtggatggcctccttgtggaacgccatcaggctgatgaaggaaggaggccttcggggaaataggaaggaacggtgtgcagcccaggccccactggccagcagcaggcttcgggcttgttccatggccataagcaacaagcggcctcctcactgtcccacggggcctcagcactgcatgaagctacaggttcatccttct

SEQ ID NO: 6516 - DNA, 195 bp, Homo sapiens
ccaagttcaagcgatcctcctgcctcagcctcccgagtagctgggattacaggcgtgtaccaccacgcctggctaattttttgtacctttagtagagacagggtttcaccatgttggcgaggctggtctcaaactcctgaccttgtgatctgcccgtctcggcctcccaaagtgctgggattacaggcgtgaggc

SEQ ID NO: 6517 - DNA, 1899 bp, Homo sapiens
ctattaatgactgtataaaaactgggatctagaacttttaatttgggggaagtgaatatcgctttttagctataaactatacatccttaaaggtgatatttaagtttaaggtgatgtgtttaaaaaattattaaacttccatgtctacttatgatagaagacataacaactcaacaaataccctaaccacaccatccatctgcagatagaacatcatcagcaacattgaaataccccatgtgctctctgcttcctaatctcagcgccctcctgtcctccatgatgaatgtttctcttgaaatttactttgttgtctttctttcacttttctgtgtcgttttaccattacatgcattattcctaaagtcgttctttttgttggattttgcttgctttcaaattttatgaaaatggcagcaaaatgtttatattcttctgccacttgctttttttcatttaatattgttttgaagatctatgcatactgatgcacactgatcatattttcagtgttgtactaattacagtttatgactattccacaatttgttcatccatttattccctcatttttgtgtatttggtttgttggaagatttcctggctttttttttctattatcaactgggctgccacatatgtctttatgcctgtttcatgataaatacgtgcaagaggccaggctatgcaaagtgccagctttacaagatcatgagcagctgttttgctacgtggtattgccagtttagactcacacaagtggtaaagaagcatccccagtgtcctaaatccttgccaacacttagtgtcaccaggcttcttaatttttaccaatctggccagtggataatagcattgaaaagttatttttattgtgatttggagtccaatattttttctgtaagaaatgcatgtacaatgttataagaacatgcaaaaatcaaaatactttataaatgttcactttataaaaaatgaatgagaaaaacataatgcattttacataaagaaaatctgtaatgcttttgttattggctgggtattttcacaccttccaagtggtggctgttgataaattcagcaataatacctttatgtttattaatattaaatgataatgtcgaattaattaaatgaagttcaatttattgatagttattcattatatcctgctgttctaactcatcctggaagagaatagagtgaaagagaaattgcctttatatataaatgactcatagaatttcatatactgacctaaatagatttcattgcaaaggtattatagaggtaataacacagtaactcttaggactgttttgagattttcacaatttgaaaaatccttttagatccttggttgacaaatgccctggctgtgctaattatatgacatttcctgacactagtgacgtggcatggcctctcccggcttacattatagattgttttctgcccccatgggatctgatttgttaaggctcattttctattttaatgtggtggaagaattttagaaaccctagaaccccactttcaccctccactgaaacaaatagaagcagtgtattagtcagttttctcactgttatgaagaaatacctgagactgggtaatttatgaagaaaagaggttgaattggctcatggttccacagctgtacaggaagcatggcaacatctgcctctggagaggcctcaggaaacttttactcatggtgggaggcaaagtgggagcaggtgtcttatgtgacagaagcaggaccaagagagagacgggggaggtgctacacactttttttaaaacagagtctcactctgtcccccaggctggagtgcagtgatgtgatctcggttcgctgcaaccttcgcctcccaggttcaagcatttctcatggct

SEQ ID NO: 6518 - DNA, 225 bp, Homo sapiens
agtaggtttaaattcctaatggcagctgatcacagggattacattcaccccagtccctcagccttggcaagtgctggtcccaggaatccaggcttggccataccacaacagttgccatcagcctcccctacatcaagtggaggaccagcagctcagaccctcactctcacataaatgtatacaggttttactggtgaattatacctcaataaaactgcgggaaaa

SEQ ID NO: 6519 - DNA, 1121 bp, Homo sapiens
cttaaacctgattgtagctatctaagttgtagccaatgaggtgtcagaggaagtaccatgcagtgcaacttcttaagtagcctagaaagatggggtcacatccccctgggttgtttccttctttgtgtcattttgatctctctcgctggaaaacagaaatgatgtctggagtgtaagcagccatcttgggctaggagactacatgctgacatggtgacacaccacccagaaagaatctgagtagtcgatgatcacagagctaccatatcagcactagactctctacctccacattttatttgtgtgacatagaaataaagtttaagctttgttttttctggggtgtatgtgtgtacacatgtgcgtctctgtctgtctcacatgcagtgagacctaattctaactgatatgccggtaggatggggggaccttgccacaaggtataattgtggtgggatggctgtgtcttgctcccattcaggatccatggaaagctcctcctccttcctgttcccctggatgccaagcgatgggcctgagaccctggctttgccatgtggatgctccccctcaggactttggatgtgcagtgattgctacaaaaagggcaatgaagatgcctggaccacagccacacagtctccatcacagcagtggtattctgtggaatgagtactaattttctggccacattttctgttaaaaactggttgttgagctgcccacttgtcttggtcaagggatgctggagtggcctgggaaggcagtgttgtttgcttttcttaggatggaacacacttaggcatatttttggtcaaagcaaaagaagaattcaaaggtgagagaagttgaagataaaaaggggaaaatgagggtagcagatgaagcaaagtcacacagaaagctggcaggcgagtagtagaatcagagtacaggctgagcatcccaaatctgaaaatccaaaatcggaagtgctccaaaacctgaaacttttggagcaccaacacaatgctcaaagtaaatgctcagtgaagcattttggatttcatattttcagatttgggtttgcccaaccggtgtaatacaaatattccaaaatcaaaaaaaaaaaaaaaaaaaaa

SEQ ID NO: 6520 - DNA, 1119 bp, Homo sapiens
cttaaacctgattgtagctatctaagttgtagccaatgaggtgtcagaggaagtaccatgcagtgcaacttcttaagtagcctagaaagatggggtcacatccccctgggttgtttccttctttgtgtcattttgatctctctcgctggaaaacagaaatgatgtctggagtgtaagcagccatcttgggctaggagactacatgctgacatggtgacacaccacccagaaagaatctgagtagtcgatgatcacagagctaccatatcagcactagactctctacctccacattttatttgtgtgacatagaaataaagtttaagctttgttttttctggggtgtatgtgtgtacacatgtgcgtctctgtctgtctcacatgcagtgagacctaattctaactgatatgccggtaggatggggggaccttgccacaaggtataattgtggtgggatggctgtgtcttgctcccattcaggatccatggaaagctcctcctccttcctgttcccctggatgccaagcgatgggcctgagaccctggctttgccatgtggatgctccccctcaggactttggatgtgcagtgattgctacaaaaagggcaatgaagatgcctggaccacagccacacagtctccatcacagcagtggtattctgtggaatgagtactaattttctggccacattttctgttaaaaactggttgttgagctgcccacttgtcttggtcaagggatgctggagtggcctgggaaggcagtgttgtttgcttttcttaggatggaacacacttaggcatatttttggtcaaagcaaaagaagaattcaaaggtgagagaagttgaagataaaaaggggaaaatgagggtagcagatgaagcaaagtcacacagaaagctggcaggcgagtagtagaatcagagtacaggctgagcatcccaaatctgaaaatccaaaatcggaagtgctccaaaacctgaaacttttggagcaccaacacaatgctcaaagtaaatgctcagtgaagcattttggatttcatattttcagatttgggtttgcccaaccggtgtaatacaaatattccaaaatcaaaaaaaaaaaaaaaaaaa

SEQ ID NO: 6521 - DNA, 363 bp, Homo sapiens
agtaacttaattgataaagtcagtgaggaaggaatagaatacaacaaatggcttaaaaacagaaggccaagcgtgatggctcattcctgtaatcccagcactttgtgaggccgaggcaggtggattgcttgagctcaggagttcaagaccaacctgggcaacatggcaaaaccccatctctaccaaaaatacaaaaaattagccgggcgtggtggctcacacctgtagtcccaatttctcagaaggctgaggtgggaggatcacttgaacccaggaggaggaggtttcagtcagtagagattgaactactatactctagcctggatgacaaagtaagaccttgtcaaaaaaaaaaaaaaaaaa

SEQ ID NO: 6522 - DNA, 446 bp, Homo sapiens
cagtgggaaactaatagagcatctttcctttttttctagttaaaggactcacttgtacgtgtacacatttctcaggagtcctgtcaaccactgggaagaaagaggctggacttctgcattgaacccaggaacggggtttcacagcaatggaaacctggggttaaatatcaatggaaccttacatgacttgaagaatctttaatacaagctaggttttgaccccaaattagacatttggcagcctctcattacagtctatcttgcaaacctcagtgtggcaaggaatcagattcacccacactccctagtctaaaggattgtcctctgatccttccaggtggattaagccctttctaatctgtcatggacagagcaatgtacctgcctttgtttgttttccttaattctttcaagtgcctttgggtaataaatggttgcgtactcag

SEQ ID NO: 6523 - DNA, 446 bp, Homo sapiens; identical to SEQ ID NO: 6522

SEQ ID NO: 6524 - DNA, 363 bp, Homo sapiens
agtaacttaattgataaagtcagtgaggaaggaatagaatacaacaaatggcttaaaaacagaaggccaagcgtgatggctcattcctgtaatcccagcactttgtgaggccgaggcaggtggattgcttgagctcaggagttcaagaccaacctgggcaacatggcaaaaccccatctctaccaaaaatacaaaaaattagccgggcgtggtggctcacacctgtagtcccaatttctcagaaggctgaggtgggaggatcacttgaacccaggaggaggaggtttcagtcagtagagattgaactactatactctagcctggatgacagagtaagaccttgtcaaaaaaaaaaaaaaaaaa

SEQ ID NO: 6525 - DNA, 2115 bp, Homo sapiens
  misc_feature (2006)..(2006): n equals a,t,g, or c
ccaggtagccccatcccacacactttccactagtgcctatattgggatgaatcttctggcaatcttccttaaaacttcaagagacctctttaagattctgtagttgggtgagcctgtctgtgcccagggtagcctgaagttaaggtgagggcttaacagtggtaccaggcagtttggatcccaactagctagctgtccttgggcaaatgactactttcctactactgttacttcttgtttctattttctcctctgtaaactgtgggtaatgaaaatgttgcgcaaaggtagggtgggtgagtgacagctacaggctcactgttcctgaaaactgcaattcgaaattccacagccccctgaaaataaaaagtctttcagtgaatgttcagcaaactcccttggtggcaaaactgacttgaattaacatgaggctatttatgatattttgtaaatctcagttagtgagactagttgtacattttactgtagaaatatccatgtgtttgatttcagagtactaccctgaaaatacccaggtatttggaagcatagaatatatgaattaaatgacttttttaaaaaattgtggtaaaatacatataacacaacatttactatcttgaccacttttaagggtacagttcaatagtgtttgtatattcacattgttgtgcaaccaatctccagaattctttttacttattaaactgaaactctgtacctatcagacaactccccgttttcccctttccccagcccctggcaaccaccatttgactttccaaatttcttttagaattgcaaaaattccaaattccaaaacacatctggcctcacaagcatttcagataagggattgggaaacttaattagggaaggggaatgcctaacatttgatagagtcaccacctttcgagatgatcctggaagagggagttcttccaatcttacaggggcctgtcaaccacagcacactgcttcccaacatcgatgcccttttgtaaaagatggcacagtaacaagaacaagggccattagattctgaccagagcaaacagaacgcaggtacttgcatgggatgtttgataccttccccttcttttctgtcattcccttgatctcagtttttctcagtaagtagaagtgcacatgttggcagctggttctggcatctactttttatttccattccagggaccatgatggaggatgcttttacagtgaaaaggcatgaaaacctttatgcagactgaactcatggggaagatgctgacagtctgtttagaacttgctggaagccattgaaggccagatttatccattttgcagaactctctaggaatcttcagaaaagcagtagggcttaccctgctgttccccagcagatcacagtatggagaccggttctgagtcatgctccctataactggaataacacagggaattcttcacatgtttcataatgtgtgtgagtgaaaggacaacccagacttgttattgaaaaacccgacagtggtcaggcatcattattggaatgtcttctccacactgcccattctgtaaacatcctggggaaatgtcgaggttactttctgtgtgaggcttgtgctttcttttcctgtttgtaaataccagggatgaaagtggatgccttcagaattggaagcccatgaacacaaaaattctgcagaatacaaaaccctctgatggaccactcctgataaatataaaataaccttagtaccagaacttctacttttgggttatggaaaatatgccaagaattttatgttttaaaaacaaactacaggctgggcgtggtggctcacgcctgtaatctcagcattttgggaggccaagccaggtggatcaactgaggtcaggagttcgagaccagcctggccaatatggtgaaaccccatcactactaaaaatacaaaaattagccaggcatggtggtatacgcatgtgttcccagctacttgggaggctgaggcaggagaatngcttgaacccgggaggcagagtttgcagtgagccgagatcgcaccgttgcaccacagcctgggtgacaagagtgagactctgtgtcaaaaaaaaagaaaaaaaaaaaac

SEQ ID NO: 6526 - DNA, 2115 bp, Homo sapiens
ccaggtagccccatcccacacactttccactagtgcctatattgggatgaatcttctggcaatcttccttaaaacttcaagagacctctttaagattctgtagttgggtgagcctgtctgtgcccagggtagcctgaagttaaggtgagggcttaacagtggtaccaggcagtttggatcccaactagctagctgtccttgggcaaatgactactttcctactactgttacttcttgtttctattttctcctctgtaaactgtgggtaatgaaaatgttgcgcaaaggtagggtgggtgagtgacagctacaggctcactgttcctgaaaactgcaattcgaaattccacagccccctgaaaataaaaagtctttcagtgaatgttcagcaaactcccttggtggcaaaactgacttgaattaacatgaggctatttatgatattttgtaaatctcagttagtgagactagttgtacattttactgtagaaatatccatgtgtttgatttcagagtactaccctgaaaatacccaggtatttggaagcatagaatatatgaattaaatgacttttttaaaaaattgtggtaaaatacatataacacaacatttactatcttgaccacttttaagggtacagttcaatagtgtttgtatattcacattgttgtgcaaccaatctccagaattctttttacttattaaactgaaactctgtacctatcagacaactccccgttttcccctttccccagcccctggcaaccaccatttgactttccaaatttcttttagaattgcaaaaattccaaattccaaaacacatctggcctcacaagcatttcagataagggattgggaaacttaattagggaaggggaatgcctaacatttgatagagtcaccacctttcgagatgatcctggaagagggagttcttccaatcttacaggggcctgtcaaccacagcacactgcttcccaacatcgatgcccttttgtaaaagatggcacagtaacaagaacaagggccattagattctgaccagagcaaacagaacgcaggtacttgcatgggatgtttgataccttccccttcttttctgtcattcccttgatctcagtttttctcagtaagtagaagtgcacatgttggcagctggttctggcatctactttttatttccattccagggaccatgatggaggatgcttttacagtgaaaaggcatgaaaacctttatgcagactgaactcatggggaagatgctgacagtctgtttagaacttgctggaagccattgaaggccagatttatccattttgcagaactctctaggaatcttcagaaaagcagtagggcttaccctgctgttccccagcagatcacagtatggagaccggttctgagtcatgctccctataactggaataacacagggaattcttcacatgtttcataatgtgtgtgagtgaaaggacaacccagacttgttattgaaaaacccgacagtggtcaggcatcattattggaatgtcttctccacactgcccattctgtaaacatcctggggaaatgtcgaggttactttctgtgtgaggcttgtgctttcttttcctgtttgtaaataccagggatgaaagtggatgccttcagaattggaagcccatgaacacaaaaattctgcagaatacaaaaccctctgatggaccactcctgataaatataaaataaccttagtaccagaacttctacttttgggttatggaaaatatgccaagaattttatgttttaaaaacaaactacaggctgggcgtggtggctcacgcctgtaatctcagcattttgggaggccaagccaggtggatcaactgaggtcaggagttcgagaccagcctggccaatatggtgaaaccccatcactactaaaaatacaaaaattagccaggcatggtggtatacgcatgtgttcccagctacttgggaggctgaggcaggagaattgcttgaacccgggaggcagagtttgcagtgagccgagatcgcaccgttgcaccacagcctgggtgacaagagtgagactctgtgtcaaaaaaaaagaaaaaaaaaaaac

SEQ ID NO: 6527 - DNA, 1736 bp, Homo sapiens
tgataaacaactgattgcccagggaccagtgaagaatcttgatgataaaactcctacttgtagtgaaagaatcatgggatcttttgcattttcttacatcaaaaacgaccttgaactgaaagctctctttaaaaaacaaacaaacaaacaacaacaacaaaaaacccaccctaccctgcatactatcacctgctaaactacccagtgtcagaaggacaacttcagagatgctgtggtggcagctgatagtgcctgacatttagtgagtgctcagcacgtgccgggcgttgttctgaatgcttcatgtggattagttcatttccccttccagcagccctgtgagctcaatactgttattatttacatcccacaggtaaagggaaactggggcacagtaggttgaaaaataacggaaattgagtttgtttgaaaaattttaaggctaaaagccttcagtcttatctaatcacatctatcttttgatttcgggttggatttttcttttgggaatcagtcaaaacccactgtgggttattaagagtagaagatgacttataaagggataatgaggatagcctccttttgctgggaagacagaatttttcattccaaattctaatctccagtgtcaccttgcatgtccatttctggatttatattttgtattttagtatttatatcccatgtttcatttgactctgggatacaagcaattgtcagatgcaccattattttccagaccactaagaaaggaaaaaaaaaacctaccgattaaactgtgacacaccattgattgtaagacacaccctgattggtgaggtgtaaaaatgggggaaagtggctctcttagaatgaaatatcttagaatgaatttgtgtgagtcaggggcaggtgaaagtcattttgcaggattctaatggcttctccatacacctctctccgaagaaagaaaggacttggggtgttttgctgactcctggcagcattcttggcccaatgtattctgggtttgctcttccccgttggagagccctttgccagagaacagccactggcttgttgagccaggaagcttaccatgtgagtgcagcttgtgtctgaagaggctgggccagtacagataatacgaatcacatttcactggctttttgatcggctgtttagctcctggcagcttgttcccagcattcatgtttgctgtgagtaggaaacacaaagaacctcgtcttcagaacgagaaagacttggggctggattctagctgtgcccgtggctggcttagtgctcatgattgtggccctgtgcagaccactttgcctccctcagtctcagtttccccatctatcaaaacggatattcattcctgccttgaatgtgttatgtaataatgattaaggaaaataaaatgcaagtgttgaagttgatacaggatctttatttcattccagaaaactctgtaaagtttcctcatttaaaaattccttccttctgtggccgggtgtggtggctcacactgtgatcccagcagtttgggaggccgaggcaggcagatcacttaaggtcaggagttcgagaccagcctggccaacatagtaaaaccctgtctctacaaaaaatacaaaaattagtcggacatactgtcttgaacccaggaggcagaggtttcagtgagctgagattgtgccgctgcactccagcctaggcaacagagcgagactctgtctcaaaaaaaaaaa

SEQ ID NO: 6528 - DNA, 404 bp, Homo sapiens
gggcaaagcctgacggaatggcagggtggggaagcagttgctgcctctcttgagttgcaacccatcagccatttatggtttttgtaggactaattgattcacgcctggtgccattcttccattcataaacatccttgactgctgcagatgagtcctgcaaaacactccagcctccatttattagtttgttctttcattcattcattcaggaaaggggtatgacaagcctcctctgtgctagactctgttagctgctaaggaggtaaaagtagcatctacactcaagctctccccagcacgaagaatgcatttatgttccaacatcaattctctgactgcagctgctgtcctattcagttatgacacacctagtgttagtgtagaccccacaagctaagagttca

SEQ ID NO: 6529 - DNA, 104 bp, Homo sapiens
ccagcactttgggaggccgaggcaggtggatcacttgaggtcaggggttcaagaccagcctggccaacatggtgaaatcctgtctctactaaaaatacaaaaat

SEQ ID NO: 6530 - DNA, 2121 bp, Homo sapiens
accttaaaataagtttttaggagagtaatatatattcatgggattgtgagggagcattgtagagctgttttcttctcagtcatagtggtggttttcctagctgctatggaaaggtttgttcacttatgagattaggacttttcttaaattcctcattaaatatgaacctaaggcatacccatcatttaccttgattcccatataatttgtgtaagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactaggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttga

SEQ ID NO: 6531 - DNA, 2122 bp, Homo sapiens
accttaaaataagtttttaggagagtaatatatattcatgggattgtgagggagcattgtagagctgttttcttctcagtcatagtggtggttttcctagctgctatggaaaggtttgttcacttatgagattaggacttttcttaaattcctcattaaatatgaacctaaggcatacccatcatttaccttgattcccatataatttgtataagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactagggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttga

SEQ ID NO: 6532 - DNA, 573 bp, Homo sapiens
tttttttggtttctttttttttttttttgagacggagccttgctatgttgcccaggctgcagagcagcacaatctcagctcactacaacctccgcctcccgggttcaagcaattctcctgcctcagcctcccaagtagctgggattacaggtgcccgccaccacacccggctaatttttttgtgtttttagtagagacagggtttcaccatgttggccaggctgatttcaaactccagacttcaagtgatccagccccccaggcctcccaaagtgctaggattacaggcgtgagccaacatgcccggcttccatttgcttttgatattgtttttatctctgagttacaaactatacaagcttaccaggtataaggttagatgctacatctaggagcattcaagatatacattaatttaaacttttattagtctaactttctgttaagtctcttagctttgaaacataaaagagaaatcaagcccaaatttttagaggaaggctaaggtatactattggcagttgtagttttaattgtaattgactgattaaccaagtaatttataaaatgtta

SEQ ID NO: 6533 - DNA, 2410 bp, Homo sapiens
  misc_feature (1314)..(1314): n equals a,t,g, or c
  misc_feature (1320)..(1320): n equals a,t,g, or c
  misc_feature (1327)..(1327): n equals a,t,g, or c
tctttctttctttttctttcttttttttttttttttttttaccaagtcttgctctgtcgccaagcgggagtgcagtggcactatctcggctcactgcaacctctgcctcccggttcaagcgattctcctgcctcagcctcccaattagctgggaagctgggagtacagacaggcaccaccatgcccagctaatttttgtatttttagtagagatggggtttcaccatgttggccacgatggtctcaatctcttgacctcatgacctgcccaccttggcctcctaaagttctgggattacaggcatgaaccaccgcacccagtcagagttttcactcttgttgcccaggctggagtgcaatggcgcgatctaggctcactgcaacctacacctcctgggttctccctcagcttcccaagtaggtgagattacaggcacccgccaccacgcctggctaatttttgtatttttagtacagtcggggtttcaccatgttggccaggctgttctcaaactcctgacctcaggtgatcccccagcctcggactcccaaagtgctggggttataggcatgacccaccatgcctggctgatacaaatattaataagaatgacagaccagtgagaagagagatgatgtggtggaactaaaaacggacatgatgagatctttaagaggacacattaagaaactattatcttggataccttgtgatcacaataaaatgaggttagatgggtcctacttccaaacgtggaatgtaaaccttaaatttctaaggcagtggagaagtggaaacttcacagttgtcactaaaagacttcatagctcacaccggtactatcacaattctcagctgccaatttccccaggattttgacagttaatgtgacagatatgtctataaaatcactcctttacactcacttttttaatagaaaagttgaaactaatgttctatttccaatggaaatacaatttaaaataccagccacacataatatctcatcagtaaaaaatagtttttttctatttggagttctaaagaggactctctgaagattaaatcctattatcattcgaagaaatgagaggataaaagaaaggaaaacaatttggataaaatattttttctacatttttataatttccatgcagtattttctttttttctttttttttttttattattatacttcaagttttagggtacatgtgcacattgtgcaggttagttacatatgtatacatgtgccatgccggtgcgctgcacccaccaactcgtcatctagcattaggtatatctcccaatgntatccntcccccnctccccctccccaccacagtccccagagtgtgatattccccttcctgtgtccatgtgatctcattgttcaattcccacctatgagtgagaatatgcggtgtttggttttttgttcttggcgatagtttactgagaatgatggtttccaatttcatccatgtccctacaaaggacatgaactcatcattttttatggctgcatagtattccatggtgtatatgtgccacattttcttaatccagtctatcattattggacatttgggttggttccaagtctttgctattgtgaataatgccgcaataaacatgcgtgtgcatgtgtctttatagcagcatgatttatagtcctttgggtatatacccagtaatgggatggctgggtcaaatggtatttctattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaaactcttacactgttggtgggactgtaaactagttcaaccattgtggaagtcagtgtggcgattcctcagggatctagaaccatgcagtattttctatgattaaaataaacaaacactttaaaagggaaaaggagaggggaaggagaa

SEQ ID NO: 6534 - DNA, 573 bp, Homo sapiens
tttttttggtttctttttttttttttttgagacggagccttgctatgttgcccaggctgcagagcagcacaatctcagctcactacaacctccgcctcccgggttcaagcaattctcctgcctcagcctcccaagtagctgggattacaggtgcccgccaccacacccggctaatttttttgtgtttttagtagagacagggtttcaccatgttggccaggctgatttcaaactccagacttcaagtgatccagccccccaggcctcccaaagtgctaggattacaggcgtgagccaccatgcccagcttccatttgcttttgatattgtttttatctctgagttacaaactatacaagcttaccaggtataaggttagatgctacatctaggagcattcaagatatacattaatttaaacttttattagtctaactttctgttaagtctcttagctttgaaacataaaagagaaatcaagcccaaatttttagaggaaggctaaggtatactattggcagttgtagttttaattgtaattgactgattaaccaagtaatttataaaatgtta

SEQ ID NO: 6535 - DNA, 2121 bp, Homo sapiens; identical to SEQ ID NO: 6530

SEQ ID NO: 6536 - DNA, 2122 bp, Homo sapiens; identical to SEQ ID NO: 6531

SEQ ID NO: 6537 - DNA, 573 bp, Homo sapiens; identical to SEQ ID NO: 6532

SEQ ID NO: 6538 - DNA, 2410 bp, Homo sapiens; identical to SEQ ID NO: 6533
  misc_feature (1314)..(1314): n equals a,t,g, or c
  misc_feature (1320)..(1320): n equals a,t,g, or c
  misc_feature (1327)..(1327): n equals a,t,g, or c

SEQ ID NO: 6539 - DNA, 573 bp, Homo sapiens; identical to SEQ ID NO: 6534

SEQ ID NO: 6540 - DNA, 43056 bp, Homo sapiens
aaaatggcggctgccactgtggggcttctgccggccggtagtccctggcgctgctgacccagcatcggcttttctacgtcttgaacctggattcgcctaggggttgggaagggctgtggacggcgttgggggaggcctgacgaggcaagtgagggcgggagaaaggagcgagcctcgggctggggaaggcggcgtcattggccctccgggagcacggggccccgactccgacccggtctcccccgaggactcgcccccgccgcttcggctgcgactgtcccggtcgttcccggcagaagtggtcagcgagggaaagagaagtgacttctccatgggtttcaagctcccagctgttttgcggcagcccgtacggttccctcccgggatcttcttccctcctttctgcttccctctgcttcccctttcatctcttggcgctggaagagttaaaccgacgccagctttagctccttggcttcgtggctacggcgttcttagcctcccctgctcgggctcttcccgtcgttttgggttgagagaccacgaggttgctaagctctggacaccgcttaggcgtccttttagttcttcgactccagagacctttcggttgtttgtaccacactgtactaaaagggtcttgggccttcgcgccctcccgccatcgccctccagcgcttccactatcactgcgaagttctaattcttttttgacttcgtactattttacgtgctctttagaaaagaagaggtcagattgaaccccggcaagtctggcttcctgtgaccaggcgaacctgagctatcatttatacccatcccctaatttttaattttacaacccctttaacccctttcttttttctttctttttttttttttttaataaagacggggtttcactatgttgcccaggccggtgtcgaactcctgggctcaagagatcctcccattttggcctgtgctgggattccaggcgtgagccaccatgcccggccttgcaaccccagtatgaaactggggctctccctcaactgaccgagaagagccttccccactcagtgagctccagggctaacccaaactcctctgttttcccttggattttgcttagttcaccttagttgtcatcaacatgcacggtaattattttttatttttgagaaggaatctcgctctgtcgcccaggctggagtgcagtggcacgattctcggctcactgcaacctctgcctcccgggttcaagtgattctcctgcctcagactcccgagtagctgggactacaggcgcgcaccaccacgcccacctatttttgtagctttagtagagacagggtttcaccttgttggccaggattatccgcctgcctcggcctcccaaagttctgggattacaggcgtgagccaccgcgcctggccgatttattatttgagaccgggtctcgctctgtccacccaggctggagtgcagtggtgccatctcagctcactgcaacttccgcctcctgggctcaagtaatcctcccacctcagcctcccaagtagctggggtcaccagcgcagccaccgcgcccggctacttttttgtgtttttagtagagaaggggttttgtcatattgcccaggctggtctggaactcctgagctcaagtgatctgccctcctcggcctcccaaagtgttgagattaaaggcgcaagccactgcgcccggcaacatgcacgattattattaagagggcaagtaactgtgagatatttgcgatgaagtagtatctgtcaaaaccagtgctctgaaggaatttatgatatgatgaggcttcattccttcttgcagtacccatttatgctgccttgaccactgaagttggtattggatatacaaagatgatcacttttactcctctatacattgaacatccattcaacaaatactttatgtgcctcctttataacaaaataactaactttgcctagggcaacaaaaaggctttataaaggagtaaatatgtgagctgggtcatatagcatcaaaaggaatttgctgagctcaaaaggagaaggtaatttcgggattcagtacaggaatacagagctttgagaagctttagcatacttagggagagtgggataatcaacctgcctgagcatttagtgcacgagtgattggtgaagcaagaggtaggttaagatcagcttgtgaaggatcttggtttccaatagggagtttagatttttttcagtagttaccaggaatccagtggatattttgtgcaaggagtgagcaggaggatatttgtttttttaggatggtctctgacagctatatggaggatcaactgggaacagaaaaactagatgaaaggaaatgggcaatcattcaggtaaggcaatgagggcctccatggaggcaggacataaaggaggtcagagagacactaagtaaatgtcaaatgggattcacctgctgactgctaagttaatggtaagaaggtgacttgagtttttagtctgggagagtaaatggttggcaatactattaaaacttagtctgagacatgtacataaacataggatggtgccaacctgcactttaggggtgacaacatgatgctctatagtgtaaagcattggtttttatggtctggagtctagatctgcactgttatggtagtcactagccacatgtagctattgagcacttcagatgtcgttagtctatttgaaatgtgctgtaaatataaaatacacagtggattttgaagatttaatatgaaaatgtaaaatattcaacatgattacatgttgaaataatattttggttctattgggttaaataaaattcattaaaattcacccgtttctttttcacttttccatgtggccatgaagaaattaaaaagtacatttgtggcacgcattatatgtctgttgacagagctgttctagtctagactagatgtgggaatttgtaaggaggtggaacatgagctgggcctgaagacattgagcagtgatgtcagggtggcttcctggcaacctccattgccagttaaggcatttggtttgtcttttctcaagcagtaagaagccttcagagatttctgagcaaggggtaataggtgcagggtatttctgaagatgaatctggtagcaatgtttaggttggatgaagggaggaaatactggaggcagagaaactgagaaacccaaacataaggtagtgaggcccttcctgtattagggtactggcagtgggatagaaagggaatgatgtgcaaagcgttcctgagggaagaataatcaggaactggtaataatagactgtcccagaagtgaagaatcagcatgtagcatttcaaaccttggttacttagataacaactaatatattcatgtcgcagagctataaaatacaatttgagactgaagaaatttggtcacaagatagaatcagtaacgttaggaaggggtggtccactaaatactttcgctttttatctccctgctttctgtatcatctcatcaatcatacacaccagctaatatccccaaaatacagaattacctgtatcatgccatctttctacttgataatgagtcttaaaatgtttctgttgcctgcaggactaggttcacagtttccaaggcctttcactatctggcccctttctgttcattaggccttatcttttattttttgcttttgtgaatgttttccaggctagttttttcactggtactttaaaacttactcaaaagtgtagagatctgagatgtctggtattcctttactcctgttactcctctgttttgagtaccttctctttgtttctacccatgtcttaccaatccttagtgagtaatcttaaatcccacctcttctatgattctcaataacataaggtaatgtcaacttaaaaaaaaacttcctaaatatttttatgtcttttattatctgttatgtaagcttaagattcctaaaattaatgacagatctcttttttaaaaaaggaccacgtattatactacttgctgctgctcctgatgccttagggcaagatacaaattaaacaccataattataaacagaatgaaatcataataccacattcataaggcttttatttattttttagattaataaagaactcttcagaattcctggtgtttcatcatatatacgactaagatatcagtaagtagtgaatgtttgataaagatatagctttattatgaataattgtagtgaaaatatcttttcatctgttgaaatcttggtctgtctgcaaaacagttttaatatgaacttactcagttctagctgcaagataccttgcatgttacttcataatctaaatgaagaaagtgggaattaaggaagacttaagtagaaaagagtttcccttaggccattaatataattgtggtacagtaagctttttgacagggataatttccaaggtcctttccaaaattgtatttataaacgtttttcatcaaatagagaattaatgtctttgtaccccaaataagaacacatgaaggccaggcgtgctgtctcacacctgtaattccagcatttggggaggccaaggtgggtggatcacttgagcccaggagttaaagaccagcctgggcaacatagtgaaaccctgtctctacaaaaaattagccgagtgtggtggtgcgtgcccgtagtcccagctacccaggaggctgaggtgggaggatcacttgagcccaggaggttgaagctgcaaatgagccatgattgcaccactgcactccagcctgggtaccagagcaagatcctgtttcaggaaacaaaaacaagtcaatatattttaaattttaacttaccaacagttatttattgaacaaccactatgtgcagggatgtgctaatgtactaaggataaaaaaatggatcaagccaactcctgtactcagagagctctcccaagcaagggcaaatacatgtggatgggttctggtttatggtgtggtaaggacagtgagcttatttaatactagccatgccccattccttcctttaagaaacatttatcggctaccactgtatattaggcactgtggaggcgctggaatgtaactgtgatgaaaacagagaaggtctttaccttcatggagtctgcattccagtgtgggcacaggaggggagaaggtgacagacaaagcaagtaaataaataagtagcaattagagagcactaagtattttgagggaaatagaatgatgttgtaatggatgtgaagaaggactttagggtggtcagagaatgactacctctgagaatgactcagaataaattagagacagggaaaatatatataaaagttagaggttttggtcacagtgaagagagaagaaaatttgagaaatataatgagttgttatgaaagtatatcactggaagtgttttataaaggtcattgataaacctctatacaacttaagccaatggacatttctctggcttctcagacttagtgcaaatgggaggtgaggaagtggagatatatctgtggacaaatattctgagaacttttgctgtgaaagggaaacccaaaaatgatgtagtggttgttgggggttgaagggttaagagagggttcttataagttgggaaattctagagtatttttataagcttgtgggaatggtacatcagtgatacgttgatgcaggggaaagagcgaatgactgaagatgtcaagtctttcagaaggtgaataagaatgggatcaacggcacacatagagggattggccttggatgggagcaggactattctatacaacaggagacccaacagtgtacatgcagataggttaatagatgtagtatctggaaaatgagaaattattgtctaattttattttctgattgaagaatgaaatgagattatcagctgagactagggtggagggagggatgggtgatctttgaacaaagaggaggaggtgtggagtagtagtctcagaaactgaaagtcaacctactaagaaaagtcagattgaagggtaatacttacggcctgtttgaggcctttggccatgaatttaaagagcaaatagcgttagccaggtgtggtggcaggtgcctgtaatcccagctactcgggaggctgaggcaggagaaatacttgaacccaggaggtggaggttgcagtgagctgagatcttgccactgtataccagcctgggtgacaagagtgaaactctgtctcaaaaaaaaaagaaaaaaaatgggccaggtggatcatgaggtcaagagatcgagactattgtggccaacatggtgaaactccgtctctaccaaaaagaattagctgggcgtggtggtgcatgcctgtagtcccagctactcaggtggctgaggcaggagaatcacttgaacccgggagatggaggtggcagtgagccaagatcgtgacactgcactccagcctggcaacagagtgagactccgtctcaaaaaaaagcaaatagcacagctgtaattctcctccatatcccatccccccgccggccctgcatgattggagttaatcaggactggggttttgccagcctagtagagagaagtacctagaggagcaagacatttgagtgtttgcaaataatgttaacagatcatgaattgaaggtgaggacctgagtaaaaacaggagggggtcatggatagggaaaaagtagtcagcgaattagagagataccactgaccccagaggatttttgcaatgggaatactagagtaagtaaggtgttagagaatgagatgcttgaagtgaaattttgaaagtagaacagttactggtagtgataaggtctagggtgtaatcgtagtggtgggtggctgaagtgaaatgattattggagttgaggaagtcaaggaaccaacaggtcagtattgaagttactgagaggaacaacgggtcatgtaaaagtcctcagtgaatgaggccaggtgaatagatgccatagtgaagaggaaatgtggaagactaatagtgaactgctgggtggcaagagctttaatgggactagactatttgaaagaggaaagagaagacatggtttagaagctgcagtgaggagcaaggaacacatacctcctgcttttcaagtacagggggtacaagaagttaaaacaacaacaacaaaaaaccttgagaaggccgtaagaggaagagtatgatgagggaacagccaggtacctgggaagacaagcaggtgaagagaattttcagagaagcagttgcagttacaggtgagtatgatcacagttccagagagcatcctgaaaggatttgagagggagaagaggtaggggattaggtcttactgggagacgtacacatcgttgataattgataacctagcagtcttgtgattttggctgtcactcagataaacaaggctgggagatgtggtgggtttagcagcccctgtcagcctcttatgaaaggtggatattcagtttaccttagtttgttgatggccttgagtagtggtaagaaattattaggtaactcggtggccttctctcctacttgcatagttagccaggaaaagctcatttattttagggagctaaaatctgaaatgttgctgtggagttgaactttgctaatgaatattttcataacttctgcttaatagcacacagttccaggttctaaatcccatttttaaaaaatgtatatattttattttatttattttttagatacaaagtctcactttgttgcccagtctagggtacactctagggtctcactctgtgcccagtctagtggcgcactcatagctcacagtaacctcggactcctgggctcaagcaattctctcatcttggccttctgagtagctaggactacaggtacatgccaccagccagttttcttatattttttttttgtagagacagggtctcactacattgcctaggctggtctcaaactcctgaactctagcagtcttcctgcctcggcttcccaaagtgctgggatcacaggcgtgagccaccgtgcctggcctgtagatgtgttcatgttatattttcctgaaatatatgtagtaggcatcccaatttgcatttcatcagatatatgttgaagcgtgcatcaggttctatttagggagttgcaaacatatgccacctatgtttttcagttgctcacattccaatgcaagggttcttaatgttaaactccctgaaaagtttgtgaatttctacgtgtatatgtactcttgttttttgtttgagtgtgttgagagttggtgggggagggggagggtccataggtttttatcagattctcaaggggatctatttaaggaccactggtctaattaatgggagagaaagacatgtaaactaatcattgtaatacagtgaaatcagtgccatcacaaagcaagataaaagaggaagagattcaccttgaaggatgagttcattaattcctaaacatttatttattgaggaacttggatgcagtagtatctgttataggtaatttatacattatttgaaatacttcaacattgtttttacatgtatactaatactaatgttttatagactgagatacataggtgaggaaagtttaattaacttgcttcaaatcacatagaagtagattcatatatgggtctatttgattgcaacattcactaccccactagggagccactaaagggctcattgtgtctaagattatctttgtgcttttaaacttggcagtgacttaataaacttgctttcacttaaaaaaaaaaagtaaacttggcaatgatggaaatgggcctttaaactgcttttcgtgttaatggaatttctatgcacttaaagatttgaaataattttaatcaatttgtttattatatatgccagactgtgcttttatgtttaattatgttttcatttcatttgaaagactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagtaagttacatttcataattctatgtttttattaaatcaacttctcttttctgtactgtaataccatttcgatgtgataaatactgcctttttacactagtttatagcaaaaggcttaattttacttatgccaaaaacctatagtgacattttaacttgtaaagttttgattgacttataagctttgcttgttgaaattcagcaaaatcttaagctaatggatttcagtagaaacttttgcatgctaatttttggaaagaacaagaatacataagaatttgagaagaggaaacattttccatgtgaaagttctgtggtcagatcacattagcttactttctacatcttttgatgcttaacattgtcagctggttctcagaatgaccatgagatactgattcatcaaaaaaaaaatcaattatgggctgggcacagtggctcacgctggcaatcccagtactttaggaggctgaggtgggcagatcacttgagttcaggagttcgagaccagcctggccaacatggtgaaactccaactctactaaaaatacaaaaattagccgggtgtgatggtgtgcacctataatcccagctacttgggaggctgaggcaggagaattgcttgaacccaggaggcagagattgcactgagccgagatcgtaccactacactccagcctgggcgcaaagcaagactctgtttcaaaaaaaaaataagataaaataaaaagtcaatgatgtttgcagtattatactaattttgcaagaaaagaggacttaaatatttaaaaaactttagaacttgagaaaaaaaatccaaaccattttattaatttcttgtgttgatgagaacatatgcttccctgattaactgaagttttactattcaattagcaaaactgtctgtggttactatgcgaaaaagctgggacaaaaatccattataagtatgtggccatataaatatcctctccttaataatttctgaaattcttctcttttattattatttttttttgagatggagtttcacttctgttgcccaagctggagtgcaatggcgtgcttttggctcactgcaacttccgcctccagggttcaagttattctccttcctcagcctcccaagtagctgagattacaggcatgcaccacccggccggctaagtttttgtatttttagtagaaacagggtttcaccatattagccagactggtcccgaactcctgacctcaggcgatccacctacctcggcctcccaaagtgctgggattacaggcctgaaccaccatgcccagccaataataatttctgaaattctaagctgagttcttgaacttaaattaatagtttgcgaccaggcacagtggctaatgccggtaatcccagcactttgggaggccgaggcgggcagatcacttgaggtcaggagttcgagaccagcctgaccaagatggtgaaaccccatctctactaaaattacaaagattagccaggcatggtggtgcatgcctgttatcccagctactcaggaggctgaggcaggagaatcacttgaacctgggaggcggaggttgcagtgagccaagatcgcaccattgcattagagcttgggcaacaagagtgaaactccgtctcaaaaaaaaaacaaaaaaaacaaaaagagttaagtgaggctgggtgcggtggctcatgcctgcaatcccagcactttgggaggtggaggagggcagatcacctgaggtcaggagtttaagaccagcctggccaacatggtgaaagtgtgtctctactaaaaataaaaaaattagccaggtgtggtggtagacacctgtaatcccagctactcaggaggctgaggcaggagagttgcttgaaccgggcggtggaggtcgcagtgagccgaggttgcgccagtgcactccagcctgggcaacagagcgagactacatctccaaaagaaaaaaaatagtatgcaggatagctattaaaaatcaacttatggccgggcgtggtggctcacccctgtaatctcagcactttgggaggccgaggtgggcggatcacctgaggttgggagttcgagaccaccctaaccaacatagagaaaccccatctctaccaaaaatacaaaataagctgggagtggtggcacatgcctgtaatcccagctactcgggaggctgaggcaggagaatcgcttgaacctgggaggcagaggttgtggtgagccggagattgcgtcattgcactccagcctgggcaacaagagcaaaactccatctaaaaaaagaaaatcaagttacttgtgtctactgttcttttttgtttttgttcttgtttttatttttaggcagggtctcactctgtcacccagactggagtgcagtggcatgatctcatcaaggtcaacctcctgtgcccaagtgatcctcccatgtcacccctcaagtagctgggactacaggctcatgccaccacccctggcttttttttttttttgtattttttatagagaacggtgttttgccatgttgcccaggctgatcttgaactcctgagctcaaacgatttgcctgccttggcctccctaagtgctgggattacaggtgtgtgccatcacacatggccttcttttctgtttaaaatgtgtgtacacaccatatatttaagtgtaccttataccacattttttgtagctatggagagcacaggtagtaataattgaaattcataggtaatcataattttagctcttagttttgctcttctgccccagtgtagtcttcaatccagaattggtgaataattttgaatattctgtctttacccttaaaaagattcaagaagtagtcctttggattgtgttcttgtaggcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcaggtaatttaagcaattaaaaaaattttgttagcactccttcagtgattgtttttcacctttatttgtgttattcttttagtctcgacacaatacagaagattttacactctttacattagatgatgtggatgcagcctttgataaaatacagcagctaaaattctctcagattgtgaatttgaaaggtaaaaagaatttccagtagtaagtatttagatgaatggggtttaacttgctggaaaataccgaggagaattcagagagaaaattataggcattataggctgaagaataaaaaagttagcacattctgccttgatacagaactcttaacttccatttgaattttaaaatatttcagaaaaaatgctaacagaatgttaatagctcaggccttttcatatttaacttgggaaaaactcatttagtgtttactgtgtacaataaacaaaagataatgtggccatttcctcttcctcagagcttacagttagattgaggcaacaaagtagctgagatggctaaatgtagtgattggggtaaatgaagtgctatggcagcagagtagataatgaattctagcattggacgttaaaaagtttattattgaattaggaagtcctatactaagtctatatttatcatctacagagataattgtattagatattttcatagatatgaaccctggcattgataaaatggtgcaataatggactctgaagatttagcccagaaataacaacagtctcaacagttttgcttctagttaatttttctgcaggataaattctttagcacaatgagatttaaattattctgttagtttagacgttagcaaaaatggaaacatttggtaactgtatatacaaaatacacattaaaatttgctagttcatactaaataatttaatagtgtactagcttttaaatctaatctctagccttgtacttataagcacaaataactctacaagattacataatatagtaacaagaatgtttgcctctagtgagggagtggagtaggtgggggacaggagagtgaagcctgctttcactatatgcatttttacttttgaaatttgtattattgcatatacagtattacctattaaaatattatagttgagaaataaataacctttctttagggttgtaaaagaaatctgagtattgttatcttgttgacataggtaaaggacatggcctgtctatcacacctctgccagctggtcatatgataggtggaacaatatggaaaatagtcaaagatggagaagaagaaattgtttatgcagttgacttcaaccacaagagggagatgtaggtatatcaagagaaaagctaaaggcaatgcaattggtattattttattctttggagaaaaaataagaaacacagtttttgttttggttaccagaaatttagagcaacttaaaaccgtcaaatagggagtgttttcaaaattaattatttgcatagtaagggggaaagtatggtataagacataagagattttaaaaatttataggttaagtatacactctacaaaacgggtatctccctggagatgttgcaaaggagatgaattttttacgtatcaaattacatgttcttgacctgctatttaacacaactttgtggatgggttgttcttttgttttgtaacgtgatatggtttggctctgtgtccccacccaaatctcatcttatagctcccataattcccacatgttgtgggtgggacccggtgggagatgattgaattatgaggttgggtctttcccgtgctgttcttgtgatagtgaatgggtttcacgagatctgatagttttagaaacaggagttgccttgcacataatgtaattaccatctaatataactgccctgtatgtttaaagttagtccctttgaaagggaactcaattctagttatgattttacacacttcatgtggcactcagagcattactatataatattttggtgtttagtctcttacaggctcgttttgttttatctgtacattaagttcatagctattttgtgttacattacaatagtctcaggatctttatattaagaaatatttaagacaaatagactgaattttagacacttataaccatagattaatgaggaaaggatggctatgttgcagggcaaaagagtgagggtcgtgatcaactcagtataccactggaggctatatgagtaaacagcaaactgttcgcataaacgcagaaaattggcaaactgacaaactgtgtctgccacccagaaggaatgctgagggcagtcaggcctcaggtgcaggtgtttcttgtgattagacacatctgaagcctgttagcagtaatgtgaacctgtgatcaattaagcagctgaccaattgttacctcgtcctccctgctctttctacccaataaatatgaagggctgtagaagctgaaggcagctccctttgctcactagaagcagggagctctcttcttcttctcctgaccccttcctttaaaatagttacttttgttttaagttttcatttctgcattcgtcctccttcgttcagtctcgtagtaaccgtggcaaactgcagcatggctatttgagtaaatggtattgaaggattcaaccattttggaaaaaaatcaatttgtgtccttttaattatataacaaaagaaatttcagatggattagaactaaatagaaatgaagcaatattggtgagtctgatctctgatttggaaaagactttgtaagcataaaaataatgaaccaagttacaaaggaaaagtttgatagatttgatgacatacaggttcaaatgtctgaaacaacaaataaaaaaaaaaatcaaagtaggaaaatatttgcagcaagttgcccaaaaacttacaacatatatataagatcaagtattaatttattaataaaaatataccagttgcaagatggacaaaagttataaagtcaaaagagaaaatttaaatgatctttttttgttagataccattaaaattattattattcttatttatatttttatgtatttttttgaaacagagtctcactctgtcaccgaggctggaggcacaatcacggctcactgtagtgtcgacctcccagcttcaagcaatcttcccattttagcctcccaagtagctaggactacaggtgcgctctaacatgcctggctatttttgtaattttagtagagatgaggttttgccatgctgcccaggctggtcttgaactactgggctccagtgatctgcccacctctgtctcccaaagtgttgggattacaggcatgagccactgcactagtccaaaattatttttaaatggtgattttcttctgggaagtatgtagaattggtcagtctttttgattgaacttttctggatgaggttaaatcttgctggaaagccttttagcagtactatgtattaacagtaaatacatttttaggaatgtgacctaaagaaacaatcagaaatgcaattgaagcttttgtaaaaaatgttctttggaagattataatggcaaaaataagtgaccgaaatatcagtaaagggaaaggatcaaatacagtgtagacacaataaaatgtttttataactgttaaacatttagtttagaaaaaaatttttatgtcctgggtaaaaaccaggatatagaactgagcgtataggaatgtatatgggatatcagctttgtaaaatacatatgtatatcagtacttaccataagacagggcaaaaagaaaaataaaaaaaatacatatgtgcatagaaaaacttatatggttagcaggatgtacaccaaaatattatgtcagttatctctgagtaatggtactctggaagatttttattttcttctttatacttttttgaagttactggatttcttatcaatgagcatgtctacttttatagttagaggagggaacaccttataaatgaagctgcttattttttaagtaagagaagctattattgtttacttgaaatgatataaaatattcctcttcttaaactttcttatagccatttaaatggatgttccctggaaatgctaagcaggccttccctacttatcacagattcattcaatgctacatatgtacagcctagaagaaaacagagagatgagcagcttctgagtacgtattctttcacgtccttattattattattattttgtaactttttgtatatttagggaatataagtacataaaagtacaggtttctttttttttttgagacggactttcgctctttcacccaggctggagtgaagtggcgcgatctcggctcactgtaacttccgcctcctgggttcaagtgattcttgtgcctcagcctcccgagtagctgggattacaggtgtgcaccaccacgcccagctaatttttgtatttttagtggagacagggtttctccatgttggccaggctggtcttgaatttctgacctcaggtgatccacctgccttggcctcccaaagtgctgggattacaggcatgagccaccacgcccggccacaagtataggtttcttaatgcatacgttgcacagtggtgaagtttggccttttactgtatccgtctccagaatcgtgaatgttgtacccaatgtataatgtccttttcaaggagctgtggaaatgcatggtagtgggaatgactgtattctgtttagcacttttcttggtcataagagattggttaactttagtatttttgaaaaaaatattatgtgaccatcagtttttgtataagaagaaacttagctggtttgaatttaacttttgtggaacagtgtgtaaagattggcttctttttgccagtcagtacatagctagctatccctggcactcactggcatatgtctgtatgtaaagacctcgtacaaatctattagaaaaatatactctaaaagaaaaatgaggccaggtgcagtggctcacgcctgtaatcccaccactttgggaggctgaggcaggcggatcatgaggtcaggagattgagaccatcctggctaacacggtgaaaccccgtctctactaaatatacaaaaaattagccgggcgtggtggcgggtgcatgtaatcccagctactcaggaggctgaggcaggagaatggcgtaaacccggaaggcggagcttgcagtgagctgagatctggccactgcactccagcctgggctacagagtgagactccgtctcaaaaaaaaaaagaaaaatgaacaaagagctaagtggataaatgaggctgtaaatattccactaattttgggtgttttacactttaatatagtaggccattgctgcttgcttcatcttacattctttttttttttttttttgagatggtgtcttgctctgttgcccaggctggagtgcagtggcacagtctcggctcactgcaaccttcacttcccgggttgaagtgattctcctgcctcagcctcccaagtagctgggattacagtcatgcgccaccatgcccagctaatttttgtatttttagtggagatggggtttcgccatgttggccaggctggtgttgaactcctgacctcaggtgatcctcctgcctcagcctcccaaagtgttgggattacaggcgtaaaccactgcacctggccttatattctttttaaataagctataagggatttcagcagggaaaattggattccatttttaaacatgttttcaaccattgtttttagttcatctactttaaaagtacaactatttttttttttttttttttttttgagatggagtcttgctctgtcgccaggctggagtgtagtggcacaatcccggttcactgcaacctctgcctcccgggttcaagtgattctcctgcctcagcctcccaggtagctgggattacaggtgtgcgccactacgcccagctaatttttgtacttttaatagagacggggtttcaccatgttggccaggatggtcttgatctcttgaccttgtgatccgcccacctcggcctcccaaagtgctgggattacaggcgtgagccaccgcgccctgccactaaaagtgtaactattaataatataccgtgttgcaccaactttaagaagctcaagccagacactgtggttcacgcctgacattgtggtcaatggtcaacactttgggaggctgaggcaagatgatggcttgaagccagcagttcaagaccagcctgggtaacatagtgagacccccatctctttttttttttttttttgagatgtagtctcgctctgtcgccaggctggagtgcagtggcgcgatctcggctcattgcaacctccacctcctgggttcaggtggttctcctgcctcagcctcccgagtagctgggattacaggcgtgtgcaaccatgcccggctaattttttgtatttttagtagagacggggtttcaccatgttggccaggatggtctcgatctcttgacctcatgatctgcctgccttggcctcccaaagtgctgggattataggtgtgagccaccatgcctggccgcaatccccatctctacaaaaaaaaagaaaatttttgccagacgtggtggtacaggcccgtagttccagctgcttgggaggctggggtgggaggattgcttgaggccaggaggttgaggctgcagtgagctatgatcacaccactgcactccagcctgggtgacagagcgagaccctgtctcaacaaacaaacaaactgaaaaacaaaaaaagtagcggctctttaagtcttagttttgctagagttcagttttaccacatatttccaaggggactttcatctagaggaaggaaatccataaagatatacttgttggaagggaatatgatctatattttattctataggcatacatacatacaaactatgtatcatacatagttggcctttgtagctgctgttccacatctgaggattcaactaactgtggattgaaaatatttgaaaaaacaataaaagaagataatgcaatagtttaaaaaatataagtaaaaaaaaacagtgtaacaaccatttacatagcatgtacactgtattaggtattataagcaatctagagatgatttaaagtatataggaggatgtacgtaggttatatgcagatatattgtttttttgaggcaaagtctttctctgttgtacatgctggagtgtagtggcacaatcacgactctctgcagcctcaaactcctgggctcaagcagtctccctctagcttcccacatagctaagaccacaggcatgtgccaccatgcccggctaatttgtttatttttatagagacgggatctccctatgttgtccaggctggtcttgaactcctggactcaagccatcctcttgccttgacttcccaaactgctgggattacaggtgtgagccattgcgcctggccaccattttatttgagggacctgggcatctgatggttttggtattcgtgggagtcccggggccagtacccatgggtactgagggatggctgtatatataattatgtgagtgtatatatgtatgtatataaatttgggaattcatcataacggagttcactggggtggataggcgagaccagggtagcccggaaacaccaggctggttacatttggcctggtcatacaattttctcagtgatacacacaccattttctatgtgtattatgatgtataaagtgttgaggactactgatttataattttttaatgaagaaagattgagagttaatgacactgaatatatgaagagatattcaacagaatcaaaagcagttgtaatgacctgaacaaaattccttcattttgtacttggcctagtagttgcttatttgtaaattatagtctttctaataaaaacagggagataaaattatctttaattttgtagcatagtattgttacgttctatggggattttacattcttgttttctagcaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtttgttctcatgttgtcacttgtaataagtttgctacagtgattgggtctgtggaagtgggcgtcttaaatgttttttggattttatttttctcttgaagagattgttaataagatgataacttggcattaaccatttactgtcctgtgtgctttaaatgtattatttaatttaatccctatttattctattaagtagtttccattgtgtccctgttttaaagattaggcaaattgcttcccttctaactcttagtatcccagtctgtaaaatggggacaaaaatagaacctacctcatagcattggcatgttagaattcattgttctttcttttaaataagctttttgccttgaaatagcaatctttgggagtaagattttcatttagaacatataccttgccttttcaaaaagatttaaggtgatttatatgtgaaatataatgcaaaattggttttctttgggatgaaagtgagggtgggataatctaatgggaaatggaagcagaaaataagctgcttgtcaaaacagtacaaatttaagcaaccagtgggggtaaaagatagaacttgaattccttgactattagagaatatattgaagttataatatagtatttctaattcttgtcatctttccccccatgttaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagaggtaagcacttgtatgtgaactttatcttaaaactgtttgggggatacattgtgcatgatgtaaaaaaatagtgaccaaaaataaaacttgaaattgttttaggatttttatcagaattactcttgagagccaggagtggtggtgtgtgctgtagtgccagctactcgggaggctgaggcggaaggaccactcgagcccaggaatttgaggtcagcctgggcaacatgccaagacccaccccccatctcttaaaaaaaaactactgtggaagagagcctttaatagcacaaatttcagagttccttaactggaggttctcattcttctttgagatggggtcttgctttgttacctagtctagagtgcagtggtgctatcatagttccgtgcagcctcaaactcctgggcttaaaggatcctcctccctcagcctcctaagtagctggaaccatagacatgtgccaccatgcctggctatttttttatttttattttttggaaagacgttgtctcattatgttgccatgggtggtctcaaaagaaattctcattcttaaacttttccgtggtaccctctagtttacccagagggtaagcatatacagggttttctcaatctgtgaaaggttcctttcctgtctcttgcttaatttaaatcagactctttcctaaagacgttctttatcctgtagccccctgaagtaattactctttctttcagtgtttcatgtactttgaatggagtacacgtcttccttgttctgtattgcagcttcctagctacttatcttccatttgcagtttttgccttcagacctgctgatatgctgacccctccttgtttctgacatttaatgatctcttggtcattctgttactcattcatcatttgaccctgattcacagtcttcctgtccacttgtgttcaggactttattctcattgactttagcatccatgtgtatgatctgtctggttcttctcagttacttggcaccttatttcttaatcttttccttcgtcttacctcagacatccattcctgctatcatgctatctgctcctgtggtcattgcctgtaaccttcttatggctgaacggtctccagttctccacctcaagcatatcattctgaatttacagctgactttccctattattcccatgacaacaactcttctgttccattgggactttcagttcgtgaacctcaccttttacagtctgtcatccttccagccttaaactcagtggtccacaattaagcaaaattttgcaaatacatttaactctcctacacttctgttttagttgcctggaaaggctttgaccttagttaaaccatttgcttggtttgtgcctgtacttaagcagctttatgtttctgaagttaaacattatggtgtagacagatttgttttcacattcataacttcacatctcaaaaggggaccccataccagtactcagcatttggtaggatgttccctttctcacggtaaggtaattgtatatcttctttctcctcaaacatcctacagctcactctcagccttcattcatagcacatgatcttgtctcaaacttaatgtagaagtcaaagcagtgagtcaggaattcctttatctttccaccactaaatgtactaacttgattctgcatctgcatttgctgccttatctcttgttataggaacaagactattagctcactaaccagtatacccaaagatcatttgcttaataaccagcccatcaaatctatcgatttttcaaaattagtatatcattaaagtttgtagcaattgatatagtgggatggttaataactgccagagttgtacaaaggtttagctgactaaaccttaacatagaactgtaacaaaccttaacataaagcagtatcataaagctgcttctcattttgtctttgtagcactcatataattatttaattagagacagactctcactctgtcacccagcctggagtgcagtggcaccatcatagctcactgtaccctcaaactcttaggctcaagctgtccctacaccaccccctaacccactccaccttccaaagtgctgggattatacatgaaccactgcacctggcccttagcagtcattttaaggaaagtttagtttgttaaaagctatgtggtagagatatctgtctgccaactctacttaagaaaatcataacatcagtaactaaaatctgagatatatgtactataattatagaattgttgagcaaggattctgagcaagtatagcaaagtaaaatggtgtctttggggttatttagtagctcagaaatacaaggttaaaagaactaagaaatacttgaaacaatttcatcagataggaaatactgaatttgaaaattttaattactagaaattcaattaggtctaataaaccatttgaggaattagtaaaagaaaaatggtttaagtttggaaaaaaatagacaatgatgtttagaagcatgctaaagaaatgagaaacagccaaaacatcaaatgttaagtttttgacctttttaataactaatgctgatgctcagggaccttttcttgctcaccttcttagcgatagttcttttgcagttatccctcctatcttcattatctagcagttttccctctacttgatcacatccaaaacaatttttattcttcccctactcccaatactgttctgtcttatctcagacagcacttcccacatattcaagccaaaaatttggaagtttaaaaaatgttcactgaatcgtaatatgtaccaaaacctacgttaagtgtatagcatgatgaacttttacaaaaattgaatgcacctgtctagcctgtaccctgatcgagaaatagaatatttctgtggcatgttgggcagatccaactaaggtaaaaaatagaaatggtaaaaaaagaaatagagggctgggcgtggtggctcacgcctgtaatcccagcactttgggaggcagaggtgggcggatcacgaggtcaggagttcgagaccagcctggccaacaaagtgaaaccctgtctctactaaaaatacaaaaaattagcctggcgtggtggtgggcgcctgtaatcccagctactcgggaggctgaggcaggagaatcgcttgaacctgagaggtggagattgcagtgagccaggatcgcgccactgcactccaacctgggtgacagagcgagactccatctcaaaaaacaaacaaaaacacatacagttcactctcttaaccatttttatgtgtacagtacagtagtgttaactatatgtacattgttgtatgacagatctctaaaactttttcatgtagcaaaactgaaactctgtacctattggataacagctcccagagagagcttttaaacattcatcatttcatgtcattcacttgcttaaatggctccaaagccttccttcttctctttcaataaaatccatgctacttacacaggcttcttagatcccatatgatctaatccccacctaccttctgaccttagcttattccactttctctatgccctacggtgcatcaggatctttgtactagctgttcttctgcctatagtgttctttcctggctttgcgcatggctggctcctggtcattcaggcctcaggtttaaccccctcaggtaggcctttgactacagatttaaaatacctgcctggtttagctgcccatcaccttacttgaagtatttttcctagcactcatcaccatctgatgtatttcttttttgttgtcttcctcttcccaccatcaactagaatatgaattccatgagaaaaaggcccttgttttttggtatccctagcacccagaactgtgcctgacatattggagggcttcagtgagtgcactggttgaattcatgaataatcaaaaaagtgaatatggaataaactagatttctgattatgttagataagaaaagtttaccaagtatggtattttttcatctatatctaatgcccttctaagtcaagtcttactcatttagaaaaagcaaaaatgaacaacgaaggattaataggttggagtagatttggattagaaaaaggagtaagttggaggtaatacggtgaaggagtaggaagaaaaatatttttgagttggttattctagaaatctgtttctgaataagccattaatcttacatattttaaatgaaaaataagatggagataaaaatttattatagcaacaggcataaactaaatcacagaggtaaatactttgttaaagattattggtgggtaaaaggcatctatgtaggttgctaactgtttttaaaaaaaacccactattttctgaatgaaacttattttcaaataagttattaggcaaatgtgagatgccaaatataaacatgtatttatttgtttattttaactttttattttttgagacagggtcatgtcattccctgtcacccaggctggagtgcagttgcatgatcatagctcactgcagtcttgaactcttgggctcaagcgcgcctcctgcttaagcctcccaattagttcgcactgcaggcatgtgccgccatgcccagctaatttaaaaaaaaatttatagagatgggaacttgctgtgttgcccaagctggtcttgaactactggcctcaaacaattctcccaccttggcctcccaaagtgtgggtattataggtgtgagccactgctcctggccttaaacatgtaaatcacccatttattttatacatgaaaataatctgattttggtttaatttttttgtttttacttgtctcccctccccttaccccactgggcagcccctgaactagaatagtttcagagagattcccccttttccattacttttaattttgaaaaaatttcaaacaggaaagttacaaaaatattatacccagattccccaattgtcaacattttactggatttgctttatcacttatatacacataaacacaatattactttttctgaaccatttgaagaaaaattgcaaatattttatcattatctctaaatattgccagtgtgtgttacctaaaaacaagggcaatctccagcaaaactgtgttacatccattgaaatcaggaaatcaacattgataccatcctaccatttcacccattgaccccattcagcattcaccttttaccgatgaccacaatgtcctttataattaccctttccttttttgtccaggttcgcatccatgactacatactgcatttaattgtcataactgttgacatttttgaagcatatatattctgggttttttttttcttattgatatactaatacctggtttttattttatttttttaaagagatgggagcaaggtgtggtggcatgtggctgtagtcccagctattgaggcaagaggattgcttgagcctaggagtttaaggcaagcctgggcgatatagcaaggcctcttctcaaaaaaaaaaaaaaaagaaagaaatgtatatatatatatgtagagagagagagatgggaccaaattatcatgtattccacataccctgagacttgtattttcacttgagtccttcttgaacaatgtaagaagatatgggtctaccttacatagtacctggtatattacaaacatttaaatgtttttggataaataaatgtaagctttttagtaattttataatagtacattgtatatgtgtgctgtgattatttaatctcgtggttctcaaaagtgtggtttgaggacgcctgggagtccctgagaccctttcagggagtccacaaagccaaaactatttttcataatactggtaagatgatatttgccttttcactgtgcctacatttgtactgatgagtaagatcagtggtgcataaagtgcttacaccttggcctaaaactccactagtagccactgcatttttcaccaccgtacatacacgtcattaaaaaaaaaatgctagtttcacttaagaatgtccttgagaggctgggcgtcatggcccatgcctattcctaacactttgcgaggctaagatgggaggttcacctgaggccaggagtttcagaccagcctgggcaacagcaacactctgcctctacgaagtataaaggtatattaaacaaaagaaatttgaaagagaatgtctttgaggggccagacatactggctcatgcttgtaatcccagcactttgggaggctgaggtgagaggattgcttgaggccaggagtttgagaccagtctgggcagcatagcgagaccctgtctctacaaaaaagaaaaaaaagtccttgagggaatagtaaaagttactaatattactaagttctttcagtaaaagtttttttgtttttttttgagatgggtcttgctctgtcgtctaggctggagtgcagtggtacgatctcggctcactgcaacctccgcctcccaggttcaagtgattctcctgcttcagcctcctgagtagctgggactacaggtgtgtgccaccacgcctggctgattttttgtagttttagtagagacattgtttcaccatgttaaccaggatggtcttgatctcctgactttgtgatccgtctgcctcagcatcccaaagtgctgggatcacaggcatgagtcactgcgcctggcctagtaaaagattttttaaaataatttgggtgacaagatgggaagtattaataaagaatttgcgttgtgtactaaagtacaatggctatctccaagaaaaacacttgtatgtttatttgagtcgtgagttaaactagccacttttttctgggaacaccttttttttgttggtattttttttttcttgtgtttgagacggagccttgctctgtcgccaggctggagcgctcggctcactgcaacctctacttcccgggttcaagcgattctcctgcctcagcctcccaagtagctgggactacaggtgtgtgccacgttgcccagctaatttttttttttcatatttttagtagagatggggtttcactatgttggccaggctggtctcgaactcctgacctcaggcgatccacctgcctcggcctcccaaagtgttgggattacaggcgcgagtcaccgcaccaggccctgttttgtgtgtgtgttttttttttttgagtttgggtctctgttgcccaggttggagtgcagaggcacaatcatggctcaccacatccttgaacttctgcgttcatgtgaccctcctgcctcagccttcctaccagctaggactacgggtgtgtttcaccacacctgtaatttttaattcttttttgtagagactgggtcttgctacgctgcccatatggtctcgaactggcctcaagcaatcctctcacctccgactcccaaagtgctagaattacaggcatgaatcactgtgcccagtctggaacaccatttttatgtgaaataatgacagggttattcagatttgggtatttggcagacattttcttgaaaattaatacattgagcctgtcactctaaagaaaacaattgacagcatttgttggcttaaatctgataaaattctaattttcaaatgaaaatttagaattttggaaaacttatacccagcactgtgagattgacaacttaaactgaaaagacttctgataagattggtggtgatatttacaaatgtgattttaaaaatattgtcaacatttgtaagatctggataacttggtgaactagtattttccaaataaccaattaattatgttagaaaataatgcacaaattaaaagatccattcaaaatttaaaatacaggctgggcacagtggctcacacctgtaatcccagcactttgggaggcagaggcaggaggatggcttcagttcaggagttcaagactagtctggataacatagcgagaccttgtctctacaaaaaattaaaaatcagctgggcatggtggtgcacatctgtggtcgcagctattcaggaggctgggaggtagaagggttgcttgaacctgggagttcgaggctgcagtgagcagtgatcatgccactgcactcatcgtaggcaacagagtgagaccctgtctcaaaaacaaaacaaaacaaaacaaaaaacaagagtgtaagatacataaaaaaaaaaaaaaattaacacaacagagtataaaaagtctattagtatggtttcaggttctgcgttaaaactaaccttgaagaaactaccactttctgagttttaatgtagtatcaaagaataatatccatgaaaggactatttacatatttttcccttttcaactatacatgcgtataagcctggattttcttcatatactttaaccaaaacaacatattgcaagagactgaatggagaagcaaatgtgagaatccagctgtcttctgttgagctagacattaaagagatttgcaaaaatatagaataatgctataggccaggtgcggtggctcatgactgtaatcccagcactttgagaggctgaggagggcagattgcttgactccaggagtttgagaccagcttgggcagcatgtcaagactcggtctctacaaaaaaaatacaaaaattagctgggagtggtggatggctgaagtgggaggatcgcttgaggctggaagattgagctgcagtgagctataattgcaccactgcactccagcctgggcaatggagcaagaccctgtctcaaaaaaaaaaaaaaatgccgttcttcccactatcttttttttgctttggaaaatgtaattattttttgtaaaaatctgttaatgttgccatgtggttttatttattatttatttattattattttttcatttttgagatgtagtttcgctcttgttgcccaggctggagcgcaatggtgccatctcggctcactgcaacctccgcctcccaggttcaagtgattctcctgcctcagcctccctagtagctgagattacaggcatgtgccatcacgcccggctaattttgtatttttagtagagatgggctttctccatattgatcaggcttgtctcgaattcccgaccttaggtgatctgcccgcctcgacctcccacagtgctgggattacaggtgtgagccgtcgcgcccggcctattattattattaatttatttatttttgagctggagtctcactctgttgtccaagctggagtgtaatggtgcgattatggctcactgcagtttccgcctcccaggttccagcgattctcctgcctcagcttcctgggtaactgggattacaggcatgtgccaccatgcctggctactttttatatttatagtagagacggggtttcaccatgttggccaggctggtctcggactcctgaccttaggtgatctgcctgcctcgacctcccaaagtactaggattacaggtataagccaccatgccctgctggttttattattttttaaatgaacagataaatattttaaaaattgctcagttttaatttctgataaggtagacattgataaatataacccacaaaaacaaaaagctctttggggttctctaatttttaggagtctaaggtagtcctgagataaatatatgagaactactgatttaatcattccattttgatggattttaaaattttgtccagttttttactactataagcattgctgcaatgtacgaatgtactttttttttacacatttgtgattgtttcagtaggataaattcctagaagtagaaatactgtgtcaaatgtcaaattttatttttagatgttagcaaattgccttttaacatagttgcactaattttccaacagataatggaagaaggtactctttccccatgtatggcattgccaatctcatagatgaaaacaattatgttttttatattttgtgcttttcaaaaattagtaaaattaaggatcttttcatggccagtagttatttgtctttcttattttgtaaattgcctttttaagtatcttgtgctttttcatgtgttgatcatccttttcttaactaatttggaagagctcttaggaaaaaatcatttttattggtcgtagtgctgaaaatatttttctgtttcttttttgtttttcttttcagtttcttattttgagatttaaaatgtcaaagggagtttttctttattcatgttgctgtatttatttatgtttcccattatggcttttgggcctcacctactccaaattataaaaatgcttatctgtattttcttttcctgattggtgatttttaaccagtttgattgtttggttgattgagacagggtcttgctctgtcagactgaagtgatcctcagtctcagactcaagtgatactcagtctctgagtagctgggactacaggtgcatgctaccactactggcttttttttttttttttctgagacagagtattgctttgtcacccaggctggagtacagtggtgtgagcacagctcactgcagccttgacctcccaggctcaagtgatcttccactttaaccacctgagtagcggggacaacaggcacatgccaccactcctggcttttttttttttttttttttatgtggagacaaagtctcattatgttgcccaggctagtctcaaactcaagtgattttcctgccttgcaaagtgctaggattataggtgtgagccaccgtgcccagcctcccagctaatttttaaattattcctagagacagagtcaacctatgttgcccaggctggtcttgaactcctggcctcaagcagtcctcccacagtgctaggattataggtgtgagctactgtgcctggccaaccagtttgatttaaattaaacccattctagatgatgtgtgacagctcaattttaatactaatctaaataggacctataattgtatgtaatggaaacttgattaatttcagaggaaacaatcagtttaaagatgatagagcaatttagagatgtgatgtatctcatatcccactgctttaaccccctaatattaacatattaacatttccttttgtcttttatttttttttagttgaggaaacgtgtgaagcttgaagggaaagaacttgaagaatacttggaaaaagagaaactaaagaaagaagctgccaaaaagcttgagcagtcaaaagagtgagtcattttcagacagattataaatttatggatgcaatttgagaagaatgtgtccttgacttaaatgtttcattgaaaatatttttaaattttcgtaagacttaattttgttacagacatctttcaaatgtctagaataccagatcctgtcagtgctaatattattatgcatttatttgttatgttttataaaatgtcagtccaataaagttgaatgttattccagtcatgcatcacttaatgatggggacagttctgagaaaagtgtcgttaggggatttagtcattgtgcaaacattaggatatatgtttacacaaaccttgatggtatagcctactgtgtatccagagtatatgatatggcccattgttcctaggctacaaacctgtacagcatgttactgtactgaatactgtaggccattgtaacacaatgttaagtatttgtgtatctaaatgtatctaaacatagaaaaggtacagtaatcttatgggacctctgttgtatatgtggtctattgttgttgaccgacataactgtatattatcatttaatattgaattaataatattgagtatggattcagtaataaattgataaatattaatttaaaatatctttgaaactttatgaccttgatctattctaaaatcctcctagggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaagtatgtgagcaaaacaaacttttctctcttacaaattggaggtattaactgtgttatcatttcatttcagtgaatttgatctttcacttgatctttctagtcacatgtatggggttagcttctgagtacctcagcctgaagacacagaagacttgtaacttgaaacataaaaatagagatgctgagaaacatctagagaatattgagagaaaactggcagtttatgacttagttgtgtaaaggtttaaaaacatgatcacgtgatcaagacttttttcccccacttaaaaagagaggaagatgtaggataggaagaactttggggctgtgtgtggtggctcatgcctgtaatcccaacactttgggaggccgagatgggaggatcacttgagctcaggagtttgagaccagcccaggcaatatagtgagacccccatctctatctttaaaaaaaaaaaaagaactttggatggctggtgattgcatttccaatggattatgtcttaagtattatacaagttttatgagattaagaggaatgtgagatagcatgagtgaaatcatggaaaaatctacaaaatctatactgactattagaaaaacaactgcaatcacatgttgtaattgcaaatttgaaaacactactatcctgtgtggaaaataaaaaaagaaaaacatgatacaggccaggtgtggtggctcacgcctgtaatcccagcactttgggaggccgaggcaggtggatcatgaggtcaggagttcaggaccagcctggccaagatggtgaaaccacatctccactaaaaatacaaaaaaattagccgggcgtgatggcaggcacctgtaatcctagctactctgggggctgaggcagagaattgcttgaacagggaggcggaggttgcagtgagccgagatggcgccaccacactccagcctgggtgacagagggagactctacctcaaaaaaaaccaaaaaacgcaatacatacagccatctggtaattgatatgaaattgcatcagctttggatgaaatgtatatttaaatcttgagatatgtgaggactccaaaaattatgccacctactagtcatatatgttatgtagtattagcttgctttttactgcttctaattagagacttattatttagaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaagtaagtgcttttgtgacattttgaaaatagattataagataaaatttcaagcatttgaattatataatttacattatgtcaagcaaaatttctgaatattctttagtaagtttgtgcttttaaaatttatttttgtatgaagagacttgtgaagtatggtggcatgatattttctcttcattaatggtatttgaatgccaaagtaattgaattggtggtggtggggggtgcttaaattgtaacattaaattgtacatttatatgaagaaaaattatttttggcctttttattctgtaagcaggtgaaagggaataatgtgactcacagtttaatttttctgagtaactgcttgtttcataaaatatactccttaacttaaacatctctaagaccctaatgtctggaaaatactgttgtgatctgaagtagttagaaaccttttttctcccgctttctacttagttaaataataccagtaagtgatcattttggaatttcttttaagtcatcagagaacaaagttttttatttgtccagtaatatcatttagtatatatttttgggtgtagataaaatctaaataatacagatagggccgggcacggtggctgatgcctgtaatcccagcactttggtaggccgagataggctgatcactcgagatcaggagtttgagaccagcctggccaacatggtgaaatctcatctctactgaaaatgcaaaattatccctgcgtggtggtgcatgcctataatcccagttacttgggaggctgagtcaggagaatcacttgaacctgggaggtagaggttgcaatgagcgaagatcatgctactgcactctagcctgggcaaaagagcgagacccaatctcagaaaaataaaaacaaaaataaaataaatcatacagatactataacatgtgtatttctcaaatcctagtgttatatattgtatacatgataaaagccatttttttttagaattatgagaaaagtaatcttgaataatcatatctaattacagagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtaaacatgccaggagttgccattgagtagaaataagtactttttgttgcaggttaggacagataacattagaaataccgagatgtgtgagacagacatggatggtctcctgccctagcagacctcatagggtatggggcttagaacaaggaaataccatttatcatgttgttgtgccactgagagaagaagtacaggatgctatgagagtatcaagaggggaaaccacccacatttagaggtttagaaaaggtttcctacaggaagtgataactaatcctaactgatgtttagatgggttgtcaggacagacagagtaggaaagggggggaagagcgttctaggcagagggaaccatatttgcaaaagtacagaggtgaggaaaatgattaagaattcaaaagttttagaagaattcccggatatcaaggttctactcctaattggaacaaatggagatggataccaaatataggactagcacagtagagagataaattttgtctggtaatgggagatggtgtcagtttaaggccagagtgatgtctatatctggaagaaatggatgtgcacataccaggcaggaaatttattctgggcagagtaagaagaagcaaccttccaagaatatggagatgtgaaattctgtggtatattcaggaaaggacaagcagttcagtacctactgaagtatgccaagtactagaggatgggagtgatcagtggttctcaaccttgactgcacataagaatcatctggggagcttcgtgagggtcagagggactcagtttttctggtcttaatcttaccagttatgttagaaacactggatatgacgctctgatatactttttgttttaattgccatgtgattccattttgtagtcagggttaagaatctctattttggaaagtaggcaggggcccaatgatctgcaggtaatgaggtcattgcaggtcattgtgggactcagatgagtgaaagattttccaattttaacatattaccagaggtagaaaatgataataggttatatttaatttgttaatatgtattctgtgggttttatttctctccccctcctttgcatgtctaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggtaaaaaaagcatgtgcttttttgatttcttcctgaatttgtcatccttctagttttcatgtcttttggtttttttccccccttctaaaactaagtgggtctgtggaaccttttatatttttaaccatttaaaatatatgtcagctgggggcagtgactcacgcctgtaatcccagcactttgggaggctgaggtgggagaattgcttgaggccaggagctctacatcagcctgattatagggacaccctgtcagaaacctagtcggcatggtggcatgcacctgtaatctcagcttagaaggctgaggcaggaggattgcttgagctcaggagttcgagactacagtgagccacaattgtgccactgcatctagcctatatgatagagtgagaccctgtcttgaacataaaatatgtctcacatttgggctgattttggagtttttaaaaaagagaacttgtgacatgcttctgtgtgtatgtctctgtgtatatattaattctatatagctaaggaatgacatatctttagcaaatcttttaaggtacataattgtttcatgattttttttttttggtctggatttttaaattttaagtttgatgattgtgaggatcacctgcctgcttccagtcaggagatttatagttttctaagaaagtcatactgttttttttttgttttgttttgttttttgagatggagtctcgctctgttgcccaggattgagtgcagtggtgtgatcttgtctcactgcaacctccgcctcccgggttcaagcgattctcctgcctcagcctcccaagtagctgggattacaggcatgagccactgggcccggctagtttttgtacttttagtagaaacggggttttgccatgttggccaggctggtcttgaactcctgacctcaggtgatccacccatctcagcctcccaaagtgctgggattacaggcgtgagccaatgcacccagccaatagtcatacctccatttttttatgttattcagttcaaataacttttggttttgatatagttagaaatctttaagtatagatataatttagtctagcatttacatattcttgagaggtatctagttaactagcaagattctaggtaattaaacttggaaaaatattaaaactatgaatcctacatgcatgtcaagtgatgtcttcagccctactatgaaattaagaatagagagacagcctctgttgttggattcccttctagtacaaccctcaaaattgggaggaggaataagaatatttttttcttctgtgctaaagctaatgctcttcaaagtaatgtcaaagcagaaagcagcagcattaggcaagaaccactttcgttactgattgtagaacctatggcatccattacatttgctctgaggaaggagggacagggaaaatgggattggggaggaaacgtcttttgaagtaagcaaatgactgggatctagaaaatgaatttttggttcagtcctgcccatggcacgctagttgaccccattatgcaagtgggtgagtgaagagcctaacattaccaaacgtctctgttatgatgaggcatgactaacaaaactgattgtgaaacagaaaatgtgaagggctttgttaaataatgttaaataatggggtaaaatttagaataacaacttggaatgtgatttacagtcttgaaatgatctgtcaaaggacttcagggaataatagaaaatctcttagagataatgtagtattttactttattcagtacagttgtatgtctggtgttttacttgaagttattctttcccctttgaccttatctaaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagagtaagtgtgttttcaataagggctgaattgaacacatacgtctgatgttttgtcattttgaaattctgtaattcttgtttggtattttcacaaaactgaagatcagtaatttatattcatgatcatgacctcaaaggcttacagaagtcttattgacttgaaggcttatgaaagactcttgaagaaatgatatataattttattgtaaattttaattatttgaatcttctgacatttatgtctatgtaaaattcatgacttcaatattatatccatatgctgtgaatcagagcaacccatgtcctgaccaatcataaagtaatctatttcatatatttcggttattatgtctgcatattaatgaatagaaaatgtactaaagaattttttttatttggtttctagacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgagattcaacttacataccataaagttcactcttctaaagtgtacaattcattggtgttagtatatttacagagttgtacaactattaccactatataatcccagaacactttcatcactccaaaaagaaacaccatacccactaccagtcactcctcatgcccccttcctatgacccctggcagccattaatctactttctgtctccttgaatttggattttctggacacttcataaaaattgaataatacaatatatgaactttta

SEQ ID NO: 6541 - DNA, 43053 bp, Homo sapiens
aaaatggcggctgccactgtggggcttctgccggccggtagtccctggcgctgctgacccagcatcggcttttctacgtcttgaacctggattcgcctaggggttgggaagggctgtggacggcgttgggggaggcctgacgaggcaagtgagggcgggagaaaggagcgagcctcgggctggggaaggcggcgtcattggccctccgggagcacggggccccgactccgacccggtctcccccgaggactcgcccccgccgcttcggctgcgactgtcccggtcgttcccggcagaagtggtcagcgagggaaagagaagtgacttctccatgggtttcaagctcccagctgttttgcggcagcccgtacggttccctcccgggatcttcttccctcctttctgcttccctctgcttcccctttcatctcttggcgctggaagagttaaaccgacgccagctttagctccttggcttcgtggctacggcgttcttagcctcccctgctcgggctcttcccgtcgttttgggttgagagaccacgaggttgctaagctctggacaccgcttaggcgtccttttagttcttcgactccagagacctttcggttgtttgtaccacactgtactaaaagggtcttgggccttcgcgccctcccgccatcgccctccagcgcttccactatcactgcgaagttctaattcttttttgacttcgtactattttacgtgctctttagaaaagaagaggtcagattgaaccccggcaagtctggcttcctgtgaccaggcgaacctgagctatcatttatacccatcccctaatttttaattttacaacccctttaacccctttcttttttctttctttttttttttttttaataaagacggggtttcactatgttgcccaggccggtgtcgaactcctgggctcaagagatcctcccattttggcctgtgctgggattccaggcgtgagccaccatgcccggccttgcaaccccagtatgaaactggggctctccctcaactgaccgagaagagccttccccactcagtgagctccagggctaacccaaactcctctgttttcccttggattttgcttagttcaccttagttgtcatcaacatgcacggtaattattttttatttttgagaaggaatctcgctctgtcgcccaggctggagtgcagtggcacgattctcggctcactgcaacctctgcctcccgggttcaagtgattctcctgcctcagactcccgagtagctgggactacaggcgcgcaccaccacgcccacctatttttgtagctttagtagagacagggtttcaccttgttggccaggattatccgcctgcctcggcctcccaaagttctgggattacaggcgtgagccaccgcgcctggccgatttattatttgagaccgggtctcgctctgtccacccaggctggagtgcagtggtgccatctcagctcactgcaacttccgcctcctgggctcaagtaatcctcccacctcagcctcccaagtagctggggtcaccagcgcagccaccgcgcccggctacttttttgtgtttttagtagagaaggggttttgtcatattgcccaggctggtctggaactcctgagctcaagtgatctgccctcctcggcctcccaaagtgttgagattaaaggcgcaagccactgcgcccggcaacatgcacgattattattaagagggcaagtaactgtgagatatttgcgatgaagtagtatctgtcaaaaccagtgctctgaaggaatttatgatatgatgaggcttcattccttcttgcagtacccatttatgctgccttgaccactgaagttggtattggatatacaaagatgatcacttttactcctctatacattgaacatccattcaacaaatactttatgtgcctcctttataacaaaataactaactttgcctagggcaacaaaaaggctttataaaggagtaaatatgtgagctgggtcatatagcatcaaaaggaatttgctgagctcaaaaggagaaggtaatttcgggattcagtacaggaatacagagctttgagaagctttagcatacttagggagagtgggataatcaacctgcctgagcatttagtgcacgagtgattggtgaagcaagaggtaggttaagatcagcttgtgaaggatcttggtttccaatagggagtttagatttttttcagtagttaccaggaatccagtggatattttgtgcaaggagtgagcaggaggatatttgtttttttaggatggtctctgacagctatatggaggatcaactgggaacagaaaaactagatgaaaggaaatgggcaatcattcaggtaaggcaatgagggcctccatggaggcaggacataaaggaggtcagagagacactaagtaaatgtcaaatgggattcacctgctgactgctaagttaatggtaagaaggtgacttgagtttttagtctgggagagtaaatggttggcaatactattaaaacttagtctgagacatgtacataaacataggatggtgccaacctgcactttaggggtgacaacatgatgctctatagtgtaaagcattggtttttatggtctggagtctagatctgcactgttatggtagtcactagccacatgtagctattgagcacttcagatgtcgttagtctatttgaaatgtgctgtaaatataaaatacacagtggattttgaagatttaatatgaaaatgtaaaatattcaacatgattacatgttgaaataatattttggttctattgggttaaataaaattcattaaaattcacccgtttctttttcacttttccatgtggccatgaagaaattaaaaagtacatttgtggcacgcattatatgtctgttgacagagctgttctagtctagactagatgtgggaatttgtaaggaggtggaacatgagctgggcctgaagacattgagcagtgatgtcagggtggcttcctggcaacctccattgccagttaaggcatttggtttgtcttttctcaagcagtaagaagccttcagagatttctgagcaaggggtaataggtgcagggtatttctgaagatgaatctggtagcaatgtttaggttggatgaagggaggaaatactggaggcagagaaactgagaaacccaaacataaggtagtgaggcccttcctgtattagggtactggcagtgggatagaaagggaatgatgtgcaaagcgttcctgagggaagaataatcaggaactggtaataatagactgtcccagaagtgaagaatcagcatgtagcatttcaaaccttggttacttagataacaactaatatattcatgtcgcagagctataaaatacaatttgagactgaagaaatttggtcacaagatagaatcagtaacgttaggaaggggtggtccactaaatactttcgctttttatctccctgctttctgtatcatctcatcaatcatacacaccagctaatatccccaaaatacagaattacctgtatcatgccatctttctacttgataatgagtcttaaaatgtttctgttgcctgcaggactaggttcacagtttccaaggcctttcactatctggcccctttctgttcattaggccttatcttttattttttgcttttgtgaatgttttccaggctagttttttcactggtactttaaaacttactcaaaagtgtagagatctgagatgtctggtattcctttactcctgttactcctctgttttgagtaccttctctttgtttctacccatgtcttaccaatccttagtgagtaatcttaaatcccacctcttctatgattctcaataacataaggtaatgtcaacttaaaaaaaaacttcctaaatatttttatgtcttttattatctgttatgtaagcttaagattcctaaaattaatgacagatctcttttttaaaaaaggaccacgtattatactacttgctgctgctcctgatgccttagggcaagatacaaattaaacaccataattataaacagaatgaaatcataataccacattcataaggcttttatttattttttagattaataaagaactcttcagaattcctggtgtttcatcatatatacgactaagatatcagtaagtagtgaatgtttgataaagatatagctttattatgaataattgtagtgaaaatatcttttcatctgttgaaatcttggtctgtctgcaaaacagttttaatatgaacttactcagttctagctgcaagataccttgcatgttacttcataatctaaatgaagaaagtgggaattaaggaagacttaagtagaaaagagtttcccttaggccattaatataattgtggtacagtaagctttttgacagggataatttccaaggtcctttccaaaattgtatttataaacgtttttcatcaaatagagaattaatgtctttgtaccccaaataagaacacatgaaggccaggcgtgctgtctcacacctgtaattccagcatttggggaggccaaggtgggtggatcacttgagcccaggagttaaagaccagcctgggcaacatagtgaaaccctgtctctacaaaaaattagccgagtgtggtggtgcgtgcccgtagtcccagctacccaggaggctgaggtgggaggatcacttgagcccaggaggttgaagctgcaaatgagccatgattgcaccactgcactccagcctgggtaccagagcaagatcctgtttcaggaaacaaaaacaagtcaatatattttaaattttaacttaccaacagttatttattgaacaaccactatgtgcagggatgtgctaatgtactaaggataaaaaaatggatcaagccaactcctgtactcagagagctctcccaagcaagggcaaatacatgtggatgggttctggtttatggtgtggtaaggacagtgagcttatttaatactagccatgccccattccttcctttaagaaacatttatcggctaccactgtatattaggcactgtggaggcgctggaatgtaactgtgatgaaaacagagaaggtctttaccttcatggagtctgcattccagtgtgggcacaggaggggagaaggtgacagacaaagcaagtaaataaataagtagcaattagagagcactaagtattttgagggaaatagaatgatgttgtaatggatgtgaagaaggactttagggtggtcagagaatgactacctctgagaatgactcagaataaattagagacagggaaaatatatataaaagttagaggttttggtcacagtgaagagagaagaaaatttgagaaatataatgagttgttatgaaagtatatcactggaagtgttttataaaggtcattgataaacctctatacaacttaagccaatggacatttctctggcttctcagacttagtgcaaatgggaggtgaggaagtggagatatatctgtggacaaatattctgagaacttttgctgtgaaagggaaacccaaaaatgatgtagtggttgttgggggttgaagggttaagagagggttcttataagttgggaaattctagagtatttttataagcttgtgggaatggtacatcagtgatacgttgatgcaggggaaagagcgaatgactgaagatgtcaagtctttcagaaggtgaataagaatgggatcaacggcacacatagagggattggccttggatgggagcaggactattctatacaacaggagacccaacagtgtacatgcagataggttaatagatgtagtatctggaaaatgagaaattattgtctaattttattttctgattgaagaatgaaatgagattatcagctgagactagggtggagggagggatgggtgatctttgaacaaagaggaggaggtgtggagtagtagtctcagaaactgaaagtcaacctactaagaaaagtcagattgaagggtaatacttacggcctgtttgaggcctttggccatgaatttaaagagcaaatagcgttagccaggtgtggtggcaggtgcctgtaatcccagctactcgggaggctgaggcaggagaaatacttgaacccaggaggtggaggttgcagtgagctgagatcttgccactgtataccagcctgggtgacaagagtgaaactctgtctcaaaaaaaaaagaaaaaaaatgggccaggtggatcatgaggtcaagagatcgagactattgtggccaacatggtgaaactccgtctctaccaaaaagaattagctgggcgtggtggtgcatgcctgtagtcccagctactcaggtggctgaggcaggagaatcacttgaacccgggagatggaggtggcagtgagccaagatcgtgacactgcactccagcctggcaacagagtgagactccgtctcaaaaaaaagcaaatagcacagctgtaattctcctccatatcccatccccccgccggccctgcatgattggagttaatcaggactggggttttgccagcctagtagagagaagtacctagaggagcaagacatttgagtgtttgcaaataatgttaacagatcatgaattgaaggtgaggacctgagtaaaaacaggagggggtcatggatagggaaaaagtagtcagcgaattagagagataccactgaccccagaggatttttgcaatgggaatactagagtaagtaaggtgttagagaatgagatgcttgaagtgaaattttgaaagtagaacagttactggtagtgataaggtctagggtgtaatcgtagtggtgggtggctgaagtgaaatgattattggagttgaggaagtcaaggaaccaacaggtcagtattgaagttactgagaggaacaacgggtcatgtaaaagtcctcagtgaatgaggccaggtgaatagatgccatagtgaagaggaaatgtggaagactaatagtgaactgctgggtggcaagagctttaatgggactagactatttgaaagaggaaagagaagacatggtttagaagctgcagtgaggagcaaggaacacatacctcctgcttttcaagtacagggggtacaagaagttaaaacaacaacaacaaaaaaccttgagaaggccgtaagaggaagagtatgatgagggaacagccaggtacctgggaagacaagcaggtgaagagaattttcagagaagcagttgcagttacaggtgagtatgatcacagttccagagagcatcctgaaaggatttgagagggagaagaggtaggggattaggtcttactgggagacgtacacatcgttgataattgataacctagcagtcttgtgattttggctgtcactcagataaacaaggctgggagatgtggtgggtttagcagcccctgtcagcctcttatgaaaggtggatattcagtttaccttagtttgttgatggccttgagtagtggtaagaaattattaggtaactcggtggccttctctcctacttgcatagttagccaggaaaagctcatttattttagggagctaaaatctgaaatgttgctgtggagttgaactttgctaatgaatattttcataacttctgcttaatagcacacagttccaggttctaaatcccatttttaaaaaatgtatatattttattttatttattttttagatacaaagtctcactttgttgcccagtctagggtacactctagggtctcactctgtgcccagtctagtggcgcactcatagctcacagtaacctcggactcctgggctcaagcaattctctcatcttggccttctgagtagctaggactacaggtacatgccaccagccagttttcttatattttttttttgtagagacagggtctcactacattgcctaggctggtctcaaactcctgaactctagcagtcttcctgcctcggcttcccaaagtgctgggatcacaggcgtgagccaccgtgcctggcctgtagatgtgttcatgttatattttcctgaaatatatgtagtaggcatcccaatttgcatttcatcagatatatgttgaagcgtgcatcaggttctatttagggagttgcaaacatatgccacctatgtttttcagttgctcacattccaatgcaagggttcttaatgttaaactccctgaaaagtttgtgaatttctacgtgtatatgtactcttgttttttgtttgagtgtgttgagagttggtgggggagggggagggtccataggtttttatcagattctcaaggggatctatttaaggaccactggtctaattaatgggagagaaagacatgtaaactaatcattgtaatacagtgaaatcagtgccatcacaaagcaagataaaagaggaagagattcaccttgaaggatgagttcattaattcctaaacatttatttattgaggaacttggatgcagtagtatctgttataggtaatttatacattatttgaaatacttcaacattgtttttacatgtatactaatactaatgttttatagactgagatacataggtgaggaaagtttaattaacttgcttcaaatcacatagaagtagattcatatatgggtctatttgattgcaacattcactaccccactagggagccactaaagggctcattgtgtctaagattatctttgtgcttttaaacttggcagtgacttaataaacttgctttcacttaaaaaaaaaaagtaaacttggcaatgatggaaatgggcctttaaactgcttttcgtgttaatggaatttctatgcacttaaagatttgaaataattttaatcaatttgtttattatatatgccagactgtgcttttatgtttaattatgttttcatttcatttgaaagactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagtaagttacatttcataattctatgtttttattaaatcaacttctcttttctgtactgtaataccatttcgatgtgataaatactgcctttttacactagtttatagcaaaaggcttaattttacttatgccaaaaacctatagtgacattttaacttgtaaagttttgattgacttataagctttgcttgttgaaattcagcaaaatcttaagctaatggatttcagtagaaacttttgcatgctaatttttggaaagaacaagaatacataagaatttgagaagaggaaacattttccatgtgaaagttctgtggtcagatcacattagcttactttctacatcttttgatgcttaacattgtcagctggttctcagaatgaccatgagatactgattcatcaaaaaaaaaatcaattatgggctgggcacagtggctcacgctggcaatcccagtactttaggaggctgaggtgggcagatcacttgagttcaggagttcgagaccagcctggccaacatggtgaaactccaactctactaaaaatacaaaaattagccgggtgtgatggtgtgcacctataatcccagctacttgggaggctgaggcaggagaattgcttgaacccaggaggcagagattgcactgagccgagatcgtaccactacactccagcctgggcgcaaagcaagactctgtttcaaaaaaaaaataagataaaataaaaagtcaatgatgtttgcagtattatactaattttgcaagaaaagaggacttaaatatttaaaaaactttagaacttgagaaaaaaaatccaaaccattttattaatttcttgtgttgatgagaacatatgcttccctgattaactgaagttttactattcaattagcaaaactgtctgtggttactatgcgaaaaagctgggacaaaaatccattataagtatgtggccatataaatatcctctccttaataatttctgaaattcttctcttttattattatttttttttgagatggagtttcacttctgttgcccaagctggagtgcaatggcgtgcttttggctcactgcaacttccgcctccagggttcaagttattctccttcctcagcctcccaagtagctgagattacaggcatgcaccacccggccggctaagtttttgtatttttagtagaaacagggtttcaccatattagccagactggtcccgaactcctgacctcaggcgatccacctacctcggcctcccaaagtgctgggattacaggcctgaaccaccatgcccagccaataataatttctgaaattctaagctgagttcttgaacttaaattaatagtttgcgaccaggcacagtggctaatgccggtaatcccagcactttgggaggccgagggggcagatacttgaggtcaggagtttgatctcagcctgaccaagatggtggtcccccatctctactaaaattacaaagattagccaggcatggtggtgcatgcctgtaatcccagctactcaggaggctgaggcaggagaatcacttgaacctgggaggcggaggttgcagtgagccaagatcgcaccattgcattagagcttgggcaacaagagtgaaactccgtctcaaaaaaaaaacaaaaaaaacaaaaagagttaagtgaggctgggtgcggtggctcatgcctgcaatcccagcactttgggaggtgaggagggcagatcacctgaggtcaggagtttaagaccagcctggccaacatggtgaaagtgtgtctctactaaaaataaaaaaattagccaggtgtggtggtagacacctgtaatcccagctactcaggaggctgaggcaggagagttgcttgaaccgggcggtggaggtcgcagtgagccgaggttgcgccagtgcactccagcctgggcaacagagcgagactacatctccaaaagaaaaaaaatagtatgcaggatagctattaaaaatcaacttatggccgggcgtggtggctcacccctgtaatctcagcactttgggaggccgaggtgggcggatcacctgaggttgggagttcgagaccaccctaaccaacatagagaaaccccatctctaccaaaaatacaaaataagctgggagtggtggcacatgcctgtaatcccagctactcgggaggctgaggcaggagaatcgcttgaacctgggaggcagaggttgtggtgagccggagattgcgtcattgcactccagcctgggcaacaagagcaaaactccatctaaaaaaagaaaatcaagttacttgtgtctactgttcttttttgtttttgttcttgtttttatttttaggcagggtctcactctgtcacccagactggagtgcagtggcatgatctcatcaaggtcaacctcctgtgcccaagtgatcctcccatgtcacccctcaagtagctgggactacaggctcatgccaccacccctggcttttttttttttttgtattttttatagagaacggtgttttgccatgttgcccaggctgatcttgaactcctgagctcaaacgatttgcctgccttggcctccctaagtgctgggattacaggtgtgtgccatcacacatggccttcttttctgtttaaaatgtgtgtacacaccatatatttaagtgtaccttataccacattttttgtagctatggagagcacaggtagtaataattgaaattcataggtaatcataattttagctcttagttttgctcttctgccccagtgtagtcttcaatccagaattggtgaataattttgaatattctgtctttacccttaaaaagattcaagaagtagtcctttggattgtgttcttgtaggcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcaggtaatttaagcaattaaaaaaattttgttagcactccttcagtgattgtttttcacctttatttgtgttattcttttagtctcgacacaatacagaagattttacactctttacattagatgatgtggatgcagcctttgataaaatacagcagctaaaattctctcagattgtgaatttgaaaggtaaaaagaatttccagtagtaagtatttagatgaatggggtttaacttgctggaaaataccgaggagaattcagagagaaaattataggcattataggctgaagaataaaaaagttagcacattctgccttgatacagaactcttaacttccatttgaattttaaaatatttcagaaaaaatgctaacagaatgttaatagctcaggccttttcatatttaacttgggaaaaactcatttagtgtttactgtgtacaataaacaaaagataatgtggccatttcctcttcctcagagcttacagttagattgaggcaacaaagtagctgagatggctaaatgtagtgattggggtaaatgaagtgctatggcagcagagtagataatgaattctagcattggacgttaaaaagtttattattgaattaggaagtcctatactaagtctatatttatcatctacagagataattgtattagatattttcatagatatgaaccctggcattgataaaatggtgcaataatggactctgaagatttagcccagaaataacaacagtctcaacagttttgcttctagttaatttttctgcaggataaattctttagcacaatgagatttaaattattctgttagtttagacgttagcaaaaatggaaacatttggtaactgtatatacaaaatacacattaaaatttgctagttcatactaaataatttaatagtgtactagcttttaaatctaatctctagccttgtacttataagcacaaataactctacaagattacataatatagtaacaagaatgtttgcctctagtgagggagtggagtaggtgggggacaggagagtgaagcctgctttcactatatgcatttttacttttgaaatttgtattattgcatatacagtattacctattaaaatattatagttgagaaataaataacctttctttagggttgtaaaagaaatctgagtattgttatcttgttgacataggtaaaggacatggcctgtctatcacacctctgccagctggtcatatgataggtggaacaatatggaaaatagtcaaagatggagaagaagaaattgtttatgcagttgacttcaaccacaagagggagatgtaggtatatcaagagaaaagctaaaggcaatgcaattggtattattttattctttggagaaaaaataagaaacacagtttttgttttggttaccagaaatttagagcaacttaaaaccgtcaaatagggagtgttttcaaaattaattatttgcatagtaagggggaaagtatggtataagacataagagattttaaaaatttataggttaagtatacactctacaaaacgggtatctccctggagatgttgcaaaggagatgaattttttacgtatcaaattacatgttcttgacctgctatttaacacaactttgtggatgggttgttcttttgttttgtaacgtgatatggtttggctctgtgtccccacccaaatctcatcttatagctcccataattcccacatgttgtgggtgggacccggtgggagatgattgaattatgaggttgggtctttcccgtgctgttcttgtgatagtgaatgggtttcacgagatctgatagttttagaaacaggagttgccttgcacataatgtaattaccatctaatataactgccctgtatgtttaaagttagtccctttgaaagggaactcaattctagttatgattttacacacttcatgtggcactcagagcattactatataatattttggtgtttagtctcttacaggctcgttttgttttatctgtacattaagttcatagctattttgtgttacattacaatagtctcaggatctttatattaagaaatatttaagacaaatagactgaattttagacacttataaccatagattaatgaggaaaggatggctatgttgcagggcaaaagagtgagggtcgtgatcaactcagtataccactggaggctatatgagtaaacagcaaactgttcgcataaacgcagaaaattggcaaactgacaaactgtgtctgccacccagaaggaatgctgagggcagtcaggcctcaggtgcaggtgtttcttgtgattagacacatctgaagcctgttagcagtaatgtgaacctgtgatcaattaagcagctgaccaattgttacctcgtcctccctgctctttctacccaataaatatgaagggctgtagaagctgaaggcagctccctttgctcactagaagcagggagctctcttcttcttctcctgaccccttcctttaaaatagttacttttgttttaagttttcatttctgcattcgtcctccttcgttcagtctcgtagtaaccgtggcaaactgcagcatggctatttgagtaaatggtattgaaggattcaaccattttggaaaaaaatcaatttgtgtccttttaattatataacaaaagaaatttcagatggattagaactaaatagaaatgaagcaatattggtgagtctgatctctgatttggaaaagactttgtaagcataaaaataatgaaccaagttacaaagtaaaagtttgatagatttgatgacatacaggttcaaatgtctgaaacaacaaataaaaaaaaaaatcaaagtaggaaaatatttgcagcaagttgcccaaaaacttacaacatatatataagatcaagtattaatttattaataaaaatataccagttgcaagatggacaaaagttataaagtcaaaagagaaaatttaaatgatctttttttgttagataccattaaaattattattattcttatttatatttttatgtatttttttgaaacagagtctcactctgtcaccgaggctggaggcacaatcacggctcactgtagtgtcgacctcccagcttcaagcaatcttcccattttagcctcccaagtagctaggactacaggtgcgctctaacatgcctggctatttttgtaattttagtagagatgaggttttgccatgctgcccaggctggtcttgaactactgggctccagtgatctgcccacctctgtctcccaaagtgttgggattacaggcatgagccactgcactagtccaaaattatttttaaatggtgattttcttctgggaagtatgtagaattggtcagtctttttgattgaacttttctggatgaggttaaatcttgctggaaagccttttagcagtactatgtattaacagtaaatacatttttaggaatgtgacctaaagaaacaatcagaaatgcaattgaagcttttgtaaaaaatgttctttggaagattataatggcaaaaataagtgaccgaaatatcagtaaagggaaaggatcaaatacagtgtagacacaataaaatgtttttataactgttaaacatttagtttagaaaaaaatttttatgtcctgggtaaaaaccaggatatagaactgagcgtataggaatgtatatgggatatcagctttgtaaaatacatatgtatatcagtacttaccataagacagggcaaaaagaaaaataaaaaaaatacatatgtgcatagaaaaacttatatggttagcaggatgtacaccaaaatattatgtcagttatctctgagtaatggtactctggaagatttttattttcttctttatacttttttgaagttactggatttcttatcaatgagcatgtctacttttatagttagaggagggaacaccttataaatgaagctgcttattttttaagtaagagaagctattattgtttacttgaaatgatataaaatattcctcttcttaaactttcttatagccatttaaatggatgttccctggaaatgctaagcaggccttccctacttatcacagattcattcaatgctacatatgtacagcctagaagaaaacagagagatgagcagcttctgagtacgtattctttcacgtccttattattattattattttgtaactttttgtatatttagggaatataagtacataaaagtacaggtttctttttttttttgagacggactttcgctctttcacccaggctggagtgaagtggcgcgatctcggctcactgtaacttccgcctcctgggttcaagtgattcttgtgcctcagcctcccgagtagctgggattacaggtgtgcaccaccacgcccagctaatttttgtatttttagtggagacagggtttctccatgttggccaggctggtcttgaatttctgacctcaggtgatccacctgccttggcctcccaaagtgctgggattacaggcatgagccaccacgcccggccacaagtataggtttcttaatgcatacgttgcacagtggtgaagtttggccttttactgtatccgtctccagaatcgtgaatgttgtacccaatgtataatgtccttttcaaggagctgtggaaatgcatggtagtgggaatgactgtattctgtttagcacttttcttggtcataagagattggttaactttagtatttttgaaaaaaatattatgtgaccatcagtttttgtataagaagaaacttagctggtttgaatttaacttttgtggaacagtgtgtaaagattggcttctttttgccagtcagtacatagctagctatccctggcactcactggcatatgtctgtatgtaaagacctcgtacaaatctattagaaaaatatactctaaaagaaaaatgaggccaggtgcagtggctcacgcctgtaatcccaccactttgggaggctgaggcaggcggatcatgaggtcaggagattgagaccatcctggctaacacggtgaaaccccgtctctactaaatatacaaaaaattagccgggcgtggtggcgggtgcatgtaatcccagctactcaggaggctgaggcaggagaatggcgtaaacccggaaggcggacttgcagtgagctgagatctggccactgcactccagcctgggctacagagtgagactccgtctcaaaaaaaaaaagaaaaatgaacaaagagctaagtggataaatgaggctgtaaatattccactaattttgggtgttttacactttaatatagtaggccattgctgcttgcttcatcttacattctttttttttttttttttgagatggtgtcttgctctgttgcccaggctggagtgcagtggcacagtctcggctcactgcaaccttcacttcccgggttgaagtgattcttctgcctcagcctcccaagtagctgggattacaggcatgcgccaccatgcccagctaatttttatatttttagtggagatggggtttcgccatgttggccaggctggtgttgaactcctgacctcaggtgatcctcctgcctcagcctcccaaagtgttgggattacaggcgtaaaccactgcacctggccttatattctttttaaataagctataagggatttcagcagggaaaattggattccatttttaaacatgttttcaaccattgtttttagttcatctactttaaaagtacaactattttttttttttttttttttttgagatggagtcttgctctgtcgccaggctggagtgtagtggcacaatcccggttcactgcaacctctgcctcccgggttcaagtgattctcctgcctcagcctcccaggtagctgggattacaggtgtgcgccactacgcccagctaatttttgtacttttaatagagacggggtttcaccatgttggccaggatggtcttgatctcttgaccttgtgatccgcccacctcggcctcccaaagtgctgggattacaggcgtgagccaccgcgccctgccactaaaagtgtaactattaataatataccgtgttgcaccaactttaagaagctcaagccagacactgtggttcacgcctgacattgtggtcaatggtcaacactttgggaggctgaggcaagatgatggcttgaagccagcagttcaagaccagcctgggtaacatagtgagacccccatctctttttttttttttttttgagatgtagtctcgctctgtcgccaggctggagtgcagtggcgcgatctcggctcattgcaacctccacctcctgggttcaggtggttctcctgcctcagcctcccgagtagctgggattacaggcgtgtgcaaccatgcccggctaattttttgtatttttagtagagacggggtttcaccatgttggccaggatggtctcgatctcttgacctcatgatctgcctgccttggcctcccaaagtgctgggattataggtgtgagccaccatgcctggccgcaatccccatctctacaaaaaaaaagaaaatttttgccagacgtggtggtacaggcccgtagttccagctgcttgggaggctggggtgggaggattgcttgaggccaggaggttgaggctgcagtgagctatgatcacaccactgcactccagcctgggtgacagagcgagaccctgtctcaacaaacaaacaaactgaaaaacaaaaaaagtagcggctctttaagtcttagttttgctagagttcagttttaccacatatttccaaggggactttcatctagaggaaggaaatccataaagatatacttgttggaagggaatatgatctatattttattctataggcatacatacatacaaactatgtatcatacatagttggcctttgtagctgctgttccacatctgaggattcaactaactgtggattgaaaatatttgaaaaaacaataaaagaagataatgcaatagtttaaaaaatataagtaaaaaaaaacagtgtaacaaccatttacatagcatgtacactgtattaggtattataagcaatctagagatgatttaaagtatataggaggatgtacgtaggttatatgcagatatattgtttttttgaggcaaagtctttctctgttgtacatgctggagtgtagtggcacaatcacgactctctgcagcctcaaactcctgggctcaagcagtctccctctagcttcccacatagctaagaccacaggcatgtgccaccatgcccggctaatttgtttatttttatagagacgggatctccctatgttgtccaggctggtcttgaactcctggactcaagccatcctcttgccttgacttcccaaactgctgggattacaggtgtgagccattgcgcctggccaccattttatttgagggacctgggcatctgatggttttggtattcgtgggagtcccggggccagtacccatgggtactgagggatggctgtatatataattatgtgagtgtatatatgtatgtatataaatttgggaattcatcataacggagttcactggggtggataggcgagaccagggtagcccggaaacaccaggctggttacatttggcctggtcatacaattttctcagtgatacacacaccattttctatgtgtattatgatgtataaagtgttgaggactactgatttataattttttaatgaagaaagattgagagttaatgacactgaatatatgaagagatattcaacagaatcaaaagcagttgtaatgacctgaacaaaattccttcattttgtacttggcctagtagttgcttatttgtaaattatagtctttctaataaaaacagggagataaaattatctttaattttgtagcatagtattgttacgttctatggggattttacattcttgttttctagcaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtttgttctcatgttgtcacttgtaataagtttgctacagtgattgggtctgtggaagtgggcgtcttaaatgttttttggattttatttttctcttgaagagattgttaataagatgataacttggcattaaccatttactgtcctgtgtgctttaaatgtattatttaatttaatccctatttattctattaagtagtttccattgtgtccctgttttaaagattaggcaaattgcttcccttctaactcttagtatcccagtctgtaaaatggggacaaaaatagaacctacctcatagcattggcatgttagaattcattgttctttcttttaaataagctttttgccttgaaatagcaatctttgggagtaagattttcatttagaacatataccttgccttttcaaaaagatttaaggtgatttatatgtgaaatataatgcaaaattggttttctttgggatgaaagtgagggtgggataatctaatgggaaatggaagcagaaaataagctgcttgtcaaaacagtacaaatttaagcaaccagtgggggtaaaagatagaacttgaattccttgactattagagaatatattgaagttataatatagtatttctaattcttgtcatctttccccccatgttaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagaggtaagcacttgtatgtgaactttatcttaaaactgtttgggggatacattgtgcatgatgtaaaaaaatagtgaccaaaaataaaacttgaaattgttttaggatttttatcagaattactcttgagagccaggagtggtggtgtgtgctgtagtgccagctactcgggaggctgaggcggaaggaccactcgagcccaggaatttgaggtcagcctgggcaacatgccaagacccaccccccatctcttaaaaaaaaactactgtggaagagagcctttaatagcacaaatttcagagttccttaactggaggttctcattcttctttgagatggggtcttgctttgttacctagtctagagtgcagtggtgctatcatagttccgtgcagcctcaaactcctgggcttaaaggatcctcctccctcagcctcctaagtagctggaaccatagacatgtgccaccatgcctggctatttttttatttttattttttggaaagacgttgtctcattatgttgccatgggtggtctcaaaagaaattctcattcttaaacttttccgtggtaccctctagtttacccagagggtaagcatatacagggttttctcaatctgtgaaaggttcctttcctgtctcttgcttaatttaaatcagactctttcctaaagacgttctttatcctgtagccccctgaagtaattactctttctttcagtgtttcatgtactttgaatggagtacacgtcttccttgttctgtattgcagcttcctagctacttatcttccatttgcagtttttgccttcagacctgctgatatgctgacccctccttgtttctgacatttaatgatctcttggtcattctgttactcattcatcatttgaccctgattcacagtcttcctgtccacttgtgttcaggactttattctcattgactttagcatccatgtgtatgatctgtctggttcttctcagttacttggcaccttatttcttaatcttttccttcgtcttacctcagacatccattcctgctatcatgctatctgctcctgtggtcattgcctgtaaccttcttatggctgaacggtctccagttctccacctcaagcatatcattctgaatttacagctgactttccctattattcccatgacaacaactcttctgttccattgggactttcagttcgtgaacctcaccttttacagtctgtcatccttccagccttaaactcagtggtccacaattaagcaaaattttgcaaatacatttaactctcctacacttctgttttagttgcctggaaaggctttgaccttagttaaaccatttgcttggtttgtgcctgtacttaagcagctttatgtttctgaagttaaacattatggtgtagacagatttgttttcacattcataacttcacatctcaaaaggggaccccataccagtactcagcatttggtaggatgttccctttctcacggtaaggtaattgtatatcttctttctcctcaaacatcctacagctcactctcagccttcattcatagcacatgatcttgtctcaaacttaatgtagaagtcaaagcagtgagtcaggaattcctttatctttccaccactaaatgtactaacttgattctgcatctgcatttgctgccttatctcttgttataggaacaagactattagctcactaaccagtatacccaaagatcatttgcttaataaccagcccatcaaatctatcgatttttcaaaattagtatatcattaaagtttgtagcaattgatatagtgggatggttaataactgccagagttgtacaaaggtttagctgactaaaccttaacatagaactgtaacaaaccttaacataaagcagtatcataaagctgcttctcattttgtctttgtagcactcatataattatttaattagagacagactctcactctgtcacccagcctggagtgcagtggcaccatcatagctcactgtaccctcaaactcttaggctcaagctgtccctacaccaccccctaacccactccaccttccaaagtgctgggattatacatgaaccactgcacctggcccttagcagtcattttaaggaaagtttagtttgttaaaagctatgtggtagagatatctgtctgccaactctacttaagaaaatcataacatcagtaactaaaatctgagatatatgtactataattatagaattgttgagcaaggattctgagcaagtatagcaaagtaaaatggtgtctttggggttatttagtagctcagaaatacaaggttaaaagaactaagaaatacttgaaacaatttcatcagataggaaatactgaatttgaaaattttaattactagaaattcaattaggtctaataaaccatttgaggaattagtaaaagaaaaatggtttaagtttggaaaaaaatagacaatgatgtttagaagcatgctaaagaaatgagaaacagccaaaacatcaaatgttaagtttttgacctttttaataactaatgctgatgctcagggaccttttcttgctcaccttcttagcgatagttcttttgcagttatccctcctatcttcattatctagcagttttccctctacttgatcacatccaaaacaatttttattcttcccctactcccaatactgttctgtcttatctcagacagcacttcccacatattcaagccaaaaatttggaagtttaaaaaatgttcactgaatcgtaatatgtaccaaaacctacgttaagtgtatagcatgatgaacttttacaaaaattgaatgcacctgtctagcctgtaccctgatcgagaaatagaatatttctgtggcatgttgggcagatccaactaaggtaaaaaatagaaatggtaaaaaaagaaatagagggctgggcgtggtggctcacgcctgtaatcccagcactttgggaggcagaggtgggcggatcacgaggtcaggagttcgagaccagcctggccaacaaagtgaaaccctgtctctactaaaaatacaaaaaattagcctggcgtggtggtgggcgcctgtaatcccagctactcgggaggctgaggcaggagaatcgcttgaacctgagaggtggagattgcagtgagccaggatcgcgccactgcactccaacctgggtgacagagcgagactccatctcaaaaaacaaacaaaaacacatacagttcactctcttaaccatttttatgtgtacagtacagtagtgttaactatatgtacattgttgtatgacagatctctaaaactttttcatgtagcaaaactgaaactctgtacctattggataacagctcccagagagagcttttaaacattcatcatttcatgtcattcacttgcttaaatggctccaaagccttccttcttctctttcaataaaatccatgctacttacacaggcttcttagatcccatatgatctaatccccacctaccttctgaccttagcttattccactttctctatgccctacggtgcatcaggatctttgtactagctgttcttctgcctatagtgttctttcctggctttgcgcatggctggctcctggtcattcaggcctcaggtttaaccccctcaggtaggcctttgactacagatttaaaatacctgcctggtttagctgcccatcaccttacttgaagtatttttcctagcactcatcaccatctgatgtatttcttttttgttgtcttcctcttcccaccatcaactagaatatgaattccatgagaaaaaggcccttgttttttggtatccctagcacccagaactgtgcctgacatattggagggcttcagtgagtgcactggttgaattcatgaataatcaaaaaagtgaatatggaataaactagatttctgattatgttagataagaaaagtttaccaagtatggtattttttcatctatatctaatgcccttctaagtcaagtcttactcatttagaaaaagcaaaaatgaacaacgaaggattaataggttggagtagatttggattagaaaaaggagtaagttggaggtaatacggtgaaggagtaggaagaaaaatatttttgagttggttattctagaaatctgtttctgaataagccattaatcttacatattttaaatgaaaaataagatggagataaaaatttattatagcaacaggcataaactaaatcacagaggtaaatactttgttaaagattattggtgggtaaaaggcatctatgtaggttgctaactgtttttaaaaaaaacccactattttctgaatgaaacttattttcaaataagttattaggcaaatgtgagatgccaaatataaacatgtatttatttgtttattttaactttttattttttgagacagggtcatgtcattccctgtcacccaggctggagtgcagttgcatgatcatagctcactgcagtcttgaactcttgggctcaagcgcgcctcctgcttaagcctcccaattagttcgcactgcaggcatgtgccgccatgcccagctaatttaaaaaaaaatttatagagatgggaacttgctgtgttgcccaagctggtcttgaactactggcctcaaacaattctcccaccttggcctcccaaagtgtgggtattataggtgtgagccactgctcctggccttaaacatgtaaatcacccatttattttatacatgaaaataatctgattttggtttaatttttttgtttttacttgtctcccctccccttaccccactgggcagcccctgaactagaatagtttcagagagattcccccttttccattacttttaattttgaaaaaatttcaaacaggaaagttacaaaaatattatacccagattccccaattgtcaacattttactggatttgctttatcacttatatacacataaacacaatattactttttctgaaccatttgaagaaaaattgcaaatattttatcattatctctaaatattgccagtgtgtgttacctaaaaacaagggcaatctccagcaaaactgtgttacatccattgaaatcaggaaatcaacattgataccatcctaccatttcacccattgaccccattcagcattcaccttttaccgatgaccacaatgtcctttataattaccctttccttttttgtccaggttcgcatccatgactacatactgcatttaattgtcataactgttgacatttttgaagcatatatattctgggttttttttttcttattgatatactaatacctggtttttattttatttttttaaagagatgggagcaaggtgtggtggcatgtggctgtagtcccagctattgaggcaagaggattgcttgagcctaggagtttaaggcaagcctgggcgatatagcaaggcctcttctcaaaaaaaaaaaaaaaagaaagaaatgtatatatatatatgtagagagagagagatgggaccaaattatcatgtattccacataccctgagacttgtattttcacttgagtccttcttgaacaatgtaagaagatatgggtctaccttacatagtacctggtatattacaaacatttaaatgtttttggataaataaatgtaagctttttagtaattttataatagtacattgtatatgtgtgctgtgattatttaatctcgtggttctcaaaagtgtggtttgaggacgcctgggagtccctgagaccctttcagggagtccacaaagccaaaactatttttcataatactggtaagatgatatttgccttttcactgtgcctacatttgtactgatgagtaagatcagtggtgcataaagtgcttacaccttggcctaaaactccactagtagccactgcatttttcaccaccgtacatacacgtcattaaaaaaaaaatgctagtttcacttaagaatgtccttgagaggctgggcgtcatggcccatgcctattcctaacactttgcgaggctaagatgggaggttcacctgaggccaggagtttcagaccagcctgggcaacagcaacactctgcctctacgaagtataaaggtatattaaacaaaagaaatttgaaagagaatgtctttgaggggccagacatactggctcatgcttgtaatcccagcactttgggaggctgaggtgagaggattgcttgaggccaggagtttgagaccagtctgggcagcatagcgagaccctgtctctacaaaaaagaaaaaaaagtccttgagggaatagtaaaagttactaatattactaagttctttcagtaaaagtttttttgtttttttttgagatgggtcttgctctgtcgtctaggctggagtgcagtggtacgatctcggctcactgcaacctccgcctcccaggttcaagtgattctcctgcttcagcctcctgagtagctgggactacaggtgtgtgccaccacgcctggctgattttttgtagttttagtagagacattgtttcaccatgttaaccaggatggtcttgatctcctgactttgtgatccgtctgcctcagcatcccaaagtgctgggatcacaggcatgagtcactgcgcctggcctagtaaaagattttttaaaataatttgggtgacaagatgggaagtattaataaagaatttgcgttgtgtactaaagtacaatggctatctccaagaaaaacacttgtatgtttatttgagtcgtgagttaaactagccacttttttctgggaacaccttttttttgttggtattttttttttcttgtgtttgagacggagccttgctctgtcgccaggctggagcgctcggctcactgcaacctctacttcccgggttcaagcgattctcctgcctcagcctcccaagtagctgggactacaggtgtgtgccacgttgcccagctaatttttttttttcatatttttagtagagatggggtttcactatgttggccaggctggtctcgaactcctgacctcaggcgatccacctgcctcggcctcccaaagtgttgggattacaggcgcgagtcaccgcaccaggccctgttttgtgtgtgtgttttttttttttgagtttgggtctctgttgcccaggttggagtgcagaggcacaatcatggctcaccacatccttgaacttctgcgttcatgtgaccctcctgcctcagccttcctaccagctaggactacgggtgtgtttcaccacacctgtaatttttaattcttttttgtagagactgggtcttgctacgctgcccatatggtctcgaactggcctcaagcaatcctctcacctccgactcccaaagtgctagaattacaggcatgaatcactgtgcccagtctggaacaccatttttatgtgaaataatgacagggttattcagatttgggtatttggcagacattttcttgaaaattaatacattgagcctgtcactctaaagaaaacaattgacagcatttgttggcttaaatctgataaaattctaattttcaaatgaaaatttagaattttggaaaacttatacccagcactgtgagattgacaacttaaactgaaaagacttctgataagattggtggtgatatttacaaatgtgattttaaaaatattgtcaacatttgtaagatctggataacttggtgaactagtattttccaaataaccaattaattatgttagaaaataatgcacaaattaaaagatccattcaaaatttaaaatacaggctgggcacagtggctcacacctgtaatcccagcactttgggaggcagaggcaggaggatggcttcagttcaggagttcaagactagtctggataacatagcgagaccttgtctctacaaaaaattaaaaatcagctgggcatggtggtgcacatctgtggtcgcagctattcaggaggctgggaggtagaagggttgcttgaacctgggagttcgaggctgcagtgagcagtgatcatgccactgcactcatcgtaggcaacagagtgagaccctgtctcaaaaacaaaacaaaacaaaacaaaaaacaagagtgtaagatacataaaaaaaaaaaaaaattaacacaacagagtataaaaagtctattagtatggtttcaggttctgcgttaaaactaaccttgaagaaactaccactttctgagttttaatgtagtatcaaagaataatatccatgaaaggactatttacatatttttcccttttcaactatacatgcgtataagcctggattttcttcatatactttaaccaaaacaacatattgcaagagactgaatggagaagcaaatgtgagaatccagctgtcttctgttgagctagacattaaagagatttgcaaaaatatagaataatgctataggccaggtgcggtggctcatgactgtaatcccagcactttgagaggctgaggagggcagattgcttgactccaggagtttgagaccagcttgggcagcatgtcaagactcggtctctacaaaaaaaatacaaaaattagctgggagtggtggatggctgaagtgggaggatcgcttgaggctggaagattgagctgcagtgagctataattgcaccactgcactccagcctgggcaatggagcaagaccctgtctcaaaaaaaaaaaaaaaaatgccgttcttcccactatcttttttttgctttggaaaatgtaattattttttgtaaaaatctgttaatgttgccatgtggttttatttattatttatttattattattttttcatttttgagatgtagtttcgctcttgttgcccaggctggagcgcaatggtgccatctcggctcactgcaacctccgcctcccaggttcaagtgattctcctgcctcagcctccctagtagctgagattacaggcatgtgccatcacgcccggctaattttgtatttttagtagagatgggctttctccatattgatcaggcttgtctcgaattcccgaccttaggtgatctgcccgcctcgacctcccacagtgctgggattacaggtgtgagccgtcgcgcccggcctattattattattaatttatttatttttgagctggagtctcactctgttgtccaagctggagtgtaatggtgcgattatggctcactgcagtttccgcctcccaggttccagcgattctcctgcctcagcttcctgggtaactgggattacaggcatgtgccaccatgcctggctactttttatatttatagtagagacggggtttcaccatgttggccaggctggtctcggactcctgaccttaggtgatctgcctgcctcgacctcccaaagtactaggattacaggtataagccaccatgccctgctggttttattattttttaaatgaacagataaatattttaaaaattgctcagttttaatttctgataaggtagacattgataaatataacccacaaaaacaaaaagctctttggggttctctaatttttaggagtctaaggtagtcctgagataaatatatgagaactactgatttaatcattccattttgatggattttaaaattttgtccagttttttactactataagcattgctgcaatgtacgaatgtactttttttttacacatttgtgattgtttcagtaggataaattcctagaagtagaaatactgtgtcaaatgtcaaattttatttttagatgttagcaaattgccttttaacatagttgcactaattttccaacagataatggaagaaggtactctttccccatgtatggcattgccaatctcatagatgaaaacaattatgttttttatattttgtgcttttcaaaaattagtaaaattaaggatcttttcatggccagtagttatttgtctttcttattttgtaaattgcctttttaagtatcttgtgctttttcatgtgttgatcatccttttcttaactaatttggaagagctcttaggaaaaaatcatttttattggtcgtagtgctgaaaatatttttctgtttcttttttgtttttcttttcagtttcttattttgagatttaaaatgtcaaagggagtttttctttattcatgttgctgtatttatttatgtttcccattatggcttttgggcctcacctactccaaattataaaaatgcttatctgtattttcttttcctgattggtgatttttaaccagtttgattgtttggttgattgagacagggtcttgctctgtcagactgaagtgatcctcagtctcagactcaagtgatactcagtctctgagtagctgggactacaggtgcatgctaccactactggcttttttttttttttttctgagacagagtattgctttgtcacccaggctggagtacagtggtgtgagcacagctcactgcagccttgacctcccaggctcaagtgatcttccactttaaccacctgagtagcggggacaacaggcacatgccaccactcctggcttttttttttttttttttttatgtggagacaaagtctcattatgttgcccaggctagtctcaaactcaagtgattttcctgccttgcaaagtgctaggattataggtgtgagccaccgtgcccagcctcccagctaatttttaaattattcctagagacagagtcaacctatgttgcccaggctggtcttgaactcctggcctcaagcagtcctcccacagtgctaggattataggtgtgagctactgtgcctggccaaccagtttgatttaaattaaacccattctagatgatgtgtgacagctcaattttaatactaatctaaataggacctataattgtatgtaatggaaacttgattaatttcagaggaaacaatcagtttaaagatgatagagcaatttagagatgtgatgtatctcatatcccactgctttaaccccctaatattaacatattaacatttccttttgtcttttatttttttttagttgaggaaacgtgtgaagcttgaagggaaagaacttgaagaatacttggaaaaagagaaactaaagaaagaagctgccaaaaagcttgagcagtcaaaagagtgagtcattttcagacagattataaatttatggatgcaatttgagaagaatgtgtccttgacttaaatgtttcattgaaaatatttttaaattttcgtaagacttaattttgttacagacatctttcaaatgtctagaataccagatcctgtcagtgctaatattattatgcatttatttgttatgttttataaaatgtcagtccaataaagttgaatgttattccagtcatgcatcacttaatgatggggacagttctgagaaaagtgtcgttaggggatttagtcattgtgcaaacattaggatatatgtttacacaaaccttgatggtatagcctactgtgtatccagagtatatgatatggcccattgttcctaggctacaaacctgtacagcatgttactgtactgaatactgtaggccattgtaacacaatgttaagtatttgtgtatctaaatgtatctaaacatagaaaaggtacagtaatcttatgggacctctgttgtatatgtggtctattgttgttgaccgacataactgtatattatcatttaatattgaattaataatattgagtatggattcagtaataaattgataaatattaatttaaaatatctttgaaactttatgaccttgatctattctaaaatcctcctagggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaagtatgtgagcaaaacaaacttttctctcttacaaattggaggtattaactgtgttatcatttcatttcagtgaatttgatctttcacttgatctttctagtcacatgtatggggttagcttctgagtacctcagcctgaagacacagaagacttgtaacttgaaacataaaaatagagatgctgagaaacatctagagaatattgagagaaaactggcagtttatgacttagttgtgtaaaggtttaaaaacatgatcacgtgatcaagacttttttcccccacttaaaaagagaggaagatgtaggataggaagaactttggggctgtgtgtggtggctcatgcctgtaatcccaacactttgggaggccgagatgggaggatcacttgagctcaggagtttgagaccagcccaggcaatatagtgagacccccatctctatctttaaaaaaaaaaaaagaactttggatggctggtgattgcatttccaatggattatgtcttaagtattatacaagttttatgagattaagaggaatgtgagatagcatgagtgaaatcatggaaaaatctacaaaatctatactgactattagaaaaacaactgcaatcacatgttgtaattgcaaatttgaaaacactactatcctgtgtggaaaataaaaaaagaaaaacatgatacaggccaggtgtggtggctcacgcctgtaatcccagcactttgggaggccgaggcaggtggatcatgaggtcaggagttcaggaccagcctggccaagatggtgaaaccacatctccactaaaaatacaaaaaaattagccgggcgtgatggcaggcacctgtaatcctagctactctgggggctgaggcagagaattgcttgaacagggaggcggaggttgcagtgagccgagatggcgccaccacactccagcctgggtgacagagggagactctacctcaaaaaaaaccaaaaaacgcaatacatacagccatctggtaattgatatgaaattgcatcagctttggatgaaatgtatatttaaatcttgagatatgtgaggactccaaaaattatgccacctactagtcatatatgttatgtagtattagcttgctttttactgcttctaattagagacttattatttagaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaagtaagtgcttttgtgacattttgaaaatagattataagataaaatttcaagcatttgaattatataatttacattatgtcaagcaaaatttctgaatattctttagtaagtttgtgcttttaaaatttatttttgtatgaagagacttgtgaagtatggtggcatgatattttctcttcattaatggtatttgaatgccaaagtaattgaattggtggtggtggggggtgcttaaattgtaacattaaattgtacatttatatgaagaaaaattatttttggcctttttattctgtaagcaggtgaaagggaataatgtgactcacagtttaatttttctgagtaactgcttgtttcataaaatatactccttaacttaaacatctctaagaccctaatgtctggaaaatactgttgtgatctgaagtagttagaaaccttttttctcccgctttctacttagttaaataataccagtaagtgatcattttggaatttcttttaagtcatcagagaacaaagttttttatttgtccagtaatatcatttagtatatatttttgggtgtagataaaatctaaataatacagatagggccgggcacggtggctgatgcctgtaatcccagcactttggtaggccgagataggctgatcactcgagatcaggagtttgagaccagcctggccaacatggtgaaatctcatctctactgaaaatgcaaaattatccctgcgtggtggtgcatgcctataatcccagttacttgggaggctgagtcaggagaatcacttgaacctgggaggtagaggttgcaatgagcgaagatcatgctactgcactctagcctgggcaaaagagcgagacccaatctcagaaaaataaaaacaaaaataaaataaatcatacagatactataacatgtgtatttctcaaatcctagtgttatatattgtatacatgataaaagccatttttttttagaattatgagaaaagtaatcttgaataatcatatctaattacagagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtaaacatgccaggagttgccattgagtagaaataagtactttttgttgcaggttaggacagataacattagaaataccgagatgtgtgagacagacatggatggtctcctgccctagcagacctcatagggtatggggcttagaacaaggaaataccatttatcatgttgttgtgccactgagagaagaagtacaggatgctatgagagtatcaagaggggaaaccacccacatttagaggtttagaaaaggtttcctacaggaagtgataactaatcctaactgatgtttagatgggttgtcaggacagacagagtaggaaagggggggaagagcgttctaggcagagggaaccatatttgcaaaagtacagaggtgaggaaaatgattaagaattcaaaagttttagaagaattcccggatatcaaggttctactcctaattggaacaaatggagatggataccaaatataggactagcacagtagagagataaattttgtctggtaatgggagatggtgtcagtttaaggccagagtgatgtctatatctggaagaaatggatgtgcacataccaggcaggaaatttattctgggcagagtaagaagaagcaaccttccaagaatatggagatgtgaaattctgtggtatattcaggaaaggacaagcagttcagtacctactgaagtatgccaagtactagaggatgggagtgatcagtggttctcaaccttgactgcacataagaatcatctggggagcttcgtgagggtcagagggactcagtttttctggtcttaatcttaccagttatgttagaaacactggatatgacgctctgatatactttttgttttaattgccatgtgattccattttgtagtcagggttaagaatctctattttggaaagtaggcaggggcccaatgatctgcaggtaatgaggtcattgcaggtcattgtgggactcagatgagtgaaagattttccaattttaacatattaccagaggtagaaaatgataataggttatatttaatttgttaatatgtattctgtgggttttatttctctccccctcctttgcatgtctaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggtaaaaaaagcatgtgcttttttgatttcttcctgaatttgtcatccttctagttttcatgtcttttggtttttttccccccttctaaaactaagtgggtctgtggaaccttttatatttttaaccatttaaaatatatgtcagctgggggcagtgactcacgcctgtaatcccagcactttgggaggctgaggtgggagaattgcttgaggccaggagctctacatcagcctgattatagggacaccctgtcagaaacctagtcggcatggtggcatgcacctgtaatctcagcttagaaggctgaggcaggaggattgcttgagctcaggagttcgagactacagtgagccacaattgtgccactgcatctagcctatatgatagagtgagaccctgtcttgaacataaaatatgtctcacatttgggctgattttggagtttttaaaaaagagaacttgtgacatgcttctgtgtgtatgtctctgtgtatatattaattctatatagctaaggaatgacatatctttagcaaatcttttaaggtacataattgtttcatgattttttttttttggtctggatttttaaattttaagtttgatgattgtgaggatcacctgcctgcttccagtcaggagatttatagttttctaagaaagtcatactgttttttttttgttttgttttgttttttgagatggagtctcgctctgttgcccaggattgagtgcagtggtgtgatcttgtctcactgcaacctccgcctcccgggttcaagcgattctcctgcctcagcctcccaagtagctgggattacaggcatgagccactgggcccggctagtttttgtacttttagtagaaacggggttttgccatgttggccaggctggtcttgaactcctgacctcaggtgatccacccatctcagcctcccaaagtgctgggattacaggcgtgagccaatgcacccagccaatagtcatacctccatttttttatgttattcagttcaaataacttttggttttgatatagttagaaatctttaagtatagatataatttagtctagcatttacatattcttgagaggtatctagttaactagcaagattctaggtaattaaacttggaaaaatattaaaactatgaatcctacatgcatgtcaagtgatgtcttcagccctactatgaaattaagaatagagagacagcctctgttgttggattcccttctagtacaaccctcaaaattgggaggaggaataagaatatttttttcttctgtgctaaagctaatgctcttcaaagtaatgtcaaagcagaaagcagcagcattaggcaagaaccactttcgttactgattgtagaacctatggcatccattacatttgctctgaggaaggagggacagggaaaatgggattggggaggaaacgtcttttgaagtaagcaaatgactgggatctagaaaatgaatttttggttcagtcctgcccatggcacgctagttgaccccattatgcaagtgggtgagtgaagagcctaacattaccaaacgtctctgttatgatgaggcatgactaacaaaactgattgtgaaacagaaaatgtgaagggctttgttaaataatgttaaataatggggtaaaatttagaataacaacttggaatgtgatttacagtcttgaaatgatctgtcaaaggacttcagggaataatagaaaatctcttagagataatgtagtattttactttattcagtacagttgtatgtctggtgttttacttgaagttattctttcccctttgaccttatctaaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagagtaagtgtgttttcaataagggctgaattgaacacatacgtctgatgttttgtcattttgaaattctgtaattcttgtttggtattttcacaaaactgaagatcagtaatttatattcatgatcatgacctcaaaggcttacagaagtcttattgacttgaaggcttatgaaagactcttgaagaaatgatatataattttattgtaaattttaattatttgaatcttctgacatttatgtctatgtaaaattcatgacttcaatattatatccatatgctgtgaatcagagcaacccatgtcctgaccaatcataaagtaatctatttcatatatttcggttattatgtctgcatattaatgaatagaaaatgtactaaagaattttttttatttggtttctagacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgagattcaacttacataccataaagttcactcttctaaagtgtacaattcattggtgttagtatatttacagagttgtacaactattaccactatataatcccagaacactttcatcactccaaaaagaaacaccatacccactaccagtcactcctcatgcccccttcctatgacccctggcagccattaatctactttctgtctccttgaatttggattttctggacacttcataaaaattgaataatacaatatatgaactttta

SEQ ID NO: 6542 - DNA, 667 bp, Homo sapiens
tttcagagtgcatcactgttgtaacatgtatcagtaccctttttgtgactgaatattattccaccgaatggatataccacattttacttatccattcaaccgttgatgtacatttgagttgattccaaattttggctattaagaatgctgctctgaacattcatgtgcaagtttttttttttttgtatgtacatatgttttcaattttcttggatatatatctaagaattagaattgctggatcatacagtaattctgcttaaccttttgaggagctgccaggctgttttccaaagtggctacaacattttgcatttccaccagcatgtgtttgagggttccattttctcctcattcttgacaacatttattactccctttttaaattttagtcatcatagtgtgggtgaagaagtgtctcactgaggttttgatttgcatttccttaatgactgatgatgtggagcctctttccatgtgtttattgactttttatatattttggagtaatatctgttcatatcctttgtccattttcaatttgtttatgttcatatcctttgtccattttcaatttgtttatctttactgttgagatgtaagagtttttttatatattttctggatactaaaccattatatattgatttgcaagtattttattcca

SEQ ID NO: 6543 - DNA, 5825 bp, Homo sapiens
tttcagattcttcatgtttttatttctctcagaactttaaaatgtgaacattcgataatctagccagtctttacttccaggtaacttcttcactgggttgcaattccctgtgtggaaagcaaaaaaggaagaaatggaaaaactgtaaataaaactgtgatacgagataaaaggggaagtcagaagaatgattgcaatatttcattttctttttttttttttttttttttgagacgaagtctggctttgtagcccaggctggagtgcagtggcacgatcttggctcactgcaaactccacctcctggcttcaagcgattatcctgcctcaccctcccaagtagctgggattacagctgtgtgccaccacaccgagctaattttttatatttttggtagagacggggtttcaccatgttggccaggctggtctcgaactcctgacctcaaggaatccacctgcctcggcctcccaaagtgctaggattacaggtgtgagccaccgcgcccggtcaatattttattttctattacaccgatccatttaaaaaatttacatattagattcatcatatgtattcttttcattcatgattttaacttttaccatattgttagcttcatttttctgggttaaagaattgtaattacttagtttatctttatatgaaagctattatctctgctcagtgagttcattcgaaatgttttctaaaccctttccagcttattttctttcttgaaatccctgatttgtgaatcacttctaccatctctccatacccactgtggatgctgctcagttctcttgcccctcaggcttcctcctacccagctgtatgcccactggcaggcatcctgtcttgctaactggaactctctgctgccagaggagccatctctagaggcacaatgggaccaggcagctgccagttgctatcactctaccaccaggtctaaagctctcaggtagtgctgctaagaacacagcacctagctgctgttattactatttatctcagctatagcatgtcttaagtaagataatatatgacaatatatgtggaagctgtatataagctaggttttggccagctacttttaaactgtttctatattaaaatgcactttgaattaaaaaaagacgatactttcaaagacctgaaacagcctattcattaaatgaagactttaaattctagaggtaatcatactgttttatccaaggattcaataacaaacaagactaaaaacagtatcatttgaatctaagtcctcaagggggaaaaattaccccttctgtttatttttggcacatatcaaaaagaatattccccaaatttggccaattgctggtttaaaaaaatgcagactaaccttttaaataacatactcttgttccggaaggcagttagccgttcatcactctttctgtctaaataacatccaatgacaaatcccatagggacaagaacatgaacccagtggtcccgcacaatctgaagtaagttcaccatgatagctaaaagaaaaaaaaattatcagaaatacaactgctttgttttttttttgaaatagcttttaaattgcatctgggccaggtgcggtggttcatgcctgtaatcctagcactttgggatgctgaggtgggcagatcacttgagattaggagttcgagaccagcctggccaacatggcaaaaccccatttctactaaaagcacaaaaattagccgggtgtggtggtgcgcgtctgttatcccagctactggagaggctgaggcaggagaattgcttgaacccaggaggcggaggttgcagtgagccaagatcgtgccactgtacttcagcctgggcgacagagcaagactccatctcaataaaataaataaattgcatctgaaacaagaagatgatagacatagatgtaatagatgttaaaagcctaatacgcctctttgtttgcctggcatcagaatgtagtataatactttaaaatctaattgatgaagattacatacgggacaatgattaatataaaattacaccacactgggtctatttattacattttactactagcttcaatagtgatgtgatacgatacagagcagagaaacagagatggtatgtaaaaaaattctacctgcaacagctgattgtttgcaccctcctcatgttgttttggaacttttttttgtaaaagagacaaggtcttgctatgttgcccaggctggagggcagtggctattcacaggcactacagctctcaactcccgggctcaagcattcctcctgcctcagcctcccaagtagctgggactacaggcatacaccactgcacctggctctcatttaggacttttacttgtgtaaaacatatttagaacctctcacaatgcaaaaacaaatttaatacaattttgccagaaatggaattctttaggtaaagctgtaattactgaaaactaaatttagaaaggaaattaaaagatatgagagaaaaaagaaaactatattcaataatgtcactgtagatatgaatataaattactctaaaaaaggtaaaggggccgggtgtagtggctcacgcctgtaatcccagcactttgggaggctgaggcgggtggacgacaacaaggtcaggagttcgagaccagcctggccaacatggtgaaactccatctctactaaaaatacaaaaattaggtgggcgtagtggcacatgcctgtagtcccagttactcaggaggctgaggcaggagaattgcttgaactcgggaggcagaggttgcagtgagctgagatgacgccactacactccagcctgggggatacagcgagtctctgtctcagaaaaaaaagaaagaaaaaaaaaggcaaagggagaagaaaatttacttttatagagtgactactaggtggctcatgcctgtaaccacagcactttgggagactaaggcggatggatcgcttgagcctaggagcttgagactagcctggttaacatggcaaaaccctgtctctacaaaaaatcaaaaaattagctgggtgtggtagtatatgcctgtagtcccagctacttcggaggctgaggtgggaggattgcttgagcccaagagacggaggttgcaatgacctgagatcacaccactgtactctagcctggacgacagagcgtgatgctgtctcaaaaaaaaaaaaaagactactaggttactaggtaccagagccatcatctatttctatacgtaatgtgaaataactattatttacattttacagataagaaaacagcttaatccaaatagctattaagtacagagctggagttcaaattcagcttcactctacagctctggctgctattatagcccatgcctaagaaaccccttcctgaattgatgtttatggtacttaaaagcttttaaatgctgagtttccagaaggtagatgaggaggaatagaactataggtttttccttatccgaaatgcttgggacccgaagtgttttcgattttttgattttgaaatatttgcatgcacataatgagctatcttggggataggaccgaattaaaacataaaattcatttgtgttttatatataccttatacacatagcctgaaggtaatcttatatgaaacttttttttttttttaaatagtctcgctctgtcacctaggatggagtgcagtggagttataatagtccactgcagtcttgaactcctgagctcaagtgatcttcccacctcaatcttctgagaagctggagctacgggtgctaatttaaaaaaattctttaaacatttttttttgtagagacaagatcttgctatgttgcccaggctggtctcaaacttgtggccccaagtttcacatatgggggcattttggatttccaacattctgatcagggatactgaacctgtaatagacatcatgtggaaaataaattgcacaattcaataaaaacatagttggattgccaattttctgtaaaaattcgtgcatacagatgaattcaaaatacacctgtgtgcgtttggactaaactaataaatcatgtacaatgactaagaagacatatgacaacatcctagaaagacaatacattattgccaacaaaagtgcttagcactaagctgtgctaggactatgtagactgaatttctgcctctcctcttacactggcatgcttatacaattcatacttttttctttcctttttttttttttattttgagacgaagtttcgctcttgttgcctaggccggagtgcaatggcgcaatcttggctcacagcaacctctgcctctcggattcaagggattctcctacctcagcctcccaagtagctgggattacaggtatgcgccaccatgcccagctaattttgtatttttggtagagacgaggtttctccatgttggtcaggctggtcttgaattcccaacctcaggtggtccgcccgcctaggcctcccaaagtgctgggattacaggcgtgagccaccgcgcccggccgttcaagtgattttcttgcctcagccttccgagtagctgggactataggcaggtgccaccacgcccggctaatttttgtatttttaagtagagatggggtttcactgttggccgggctggtctcaaactcctgacctcttgatccggccacctcggccttccaaagtgttgggataacaggcgtgagccactaagcctggccatacttttgtcttttaaaaggcaaggtgggccaggtgcagtggctcacgcctgttatcccagcactttgggatgctgaggcgggtggatcacgagatcaggagttcgagaccagcctggccaacatagtgaaaccctcgtctctactaaatatacaaaaaattagccgggtgtggtggcgggcgcctgtaatcccagctacttgggctgctgagacgggagaatcgcttgaacccgggaggcggaggttggagtgagccgagattgcaccattgcactccagcctgggtgacaagagtgaatctctgtctcaaaaataaaaaagcaaagtaaaagggtaagcacatcatttaggcgcaacggtgtcggctcaagaggatttgcgatttggaagagagcgaggttagcgagaagacagaaggctggaacttggacgaatgtaagctgctcgcggaggggaggcagcgtcttccctgcttcaggccaggcgtgggatccgggccggtcttctctccagtccggttagcgggcggtcactgggtcacatctctacggacgttttcctgttatgacagcctcagaaaaccctttccaaaagctccggcccggaaatcccatcctccacccgaagaaaaccccattttcctttcccgtcaccttcgttcggaagccccggggaagcccagaccacccctccacacatgcacagcaccgagggcttgcctagaaccctccccgccaccgtcgccgtgatcctcgtcgcggcggccccccgggctccccaaacccacctgcagcctcagcgcctacagcgaccccgagaccaagggcaacagggaactcaacccgcgccagtggaagctgcgacctcgggacctgccattcgccgcgcccgcacggagcagaggggtgacgccagcaaatcatactactttttcctcctcagggttgactcctctcattttttttttttttagcttccaaacattaccaataatttctgaataaaatttcgctccagacagacgaggcgtgcaggcgtgaccgccgtcgccttccgacagcaccgtgcccaccccccggagatggtctcgcc

SEQ ID NO: 6544 - DNA, 5824 bp, Homo sapiens
tttcagattcttcatgtttttatttctctcagaactttaaaatgtgaacattcgataatctagccagtctttacttccaggtaacttcttcactgggttgcaattccctgtgtggaaagcaaaaaaggaagaaatggaaaaactgtaaataaaactgtgatacgagataaaaggggaagtcagaagaatgattgcaatatttcattttcttttttttttttttttttttgagacgaagtctggctttgtagcccaggctggagtgcagtggcacgatcttggctcactgcaaactccacctcctggcttcaagcgattatcctgcctcaccctcccaagtagctgggattacagctgtgtgccaccacaccgagctaattttttatatttttggtagagacggggtttcaccatgttggccaggctggtctcgaactcctgacctcaaggaatccacctgcctcggcctcccaaagtgctaggattacaggtgtgagccaccgcgcccggtcaatattttattttctattacaccgatccatttaaaaaatttacatattagattcatcatatgtattcttttcattcatgattttaacttttaccatattgttagcttcatttttctgggttaaagaattgtaattacttagtttatctttatatgaaagctattatctctgctcagtgagttcattcgaaatgttttctaaaccctttccagcttattttctttcttgaaatccctgatttgtgaatcacttctaccatctctccatacccactgtggatgctgctcagttctcttgcccctcaggcttcctcctacccagctgtatgcccactggcaggcatcctgtcttgctaactggaactctctgctgccagaggagccatctctagaggcacaatgggaccaggcagctgccagttgctatcactctaccaccaggtctaaagctctcaggtagtgctgctaagaacacagcacctagctgctgttattactatttatctcagctatagcatgtcttaagtaagataatatatgacaatatatgtggaagctgtatataagctaggttttggccagctacttttaaactgtttctatattaaaatgcactttgaattaaaaaaagacgatactttcaaagacctgaaacagcctattcattaaatgaagactttaaattctagaggtaatcatactgttttatccaaggattcaataacaaacaagactaaaaacagtatcatttgaatctaagtcctcaagggggaaaaattaccccttctgtttatttttggcacatatcaaaaagaatattccccaaatttggccaattgctggtttaaaaaaatgcagactaaccttttaaataacatactcttgttccggaaggcagttagccgttcatcactctttctgtctaaataacatccaatgacaaatcccatagggacaagaacatgaacccagtggtcccgcacaatctgaagtaagttcaccatgatagctaaaagaaaaaaaaattatcagaaatacaactgctttgttttttttttgaaatagcttttaaattgcatctgggccaggtgcggtggttcatgcctgtaatcctagcactttgggatgctgaggtgggcagatcacttgagattaggagttcgagaccagcctggccaacatggcaaaaccccatttctactaaaagcacaaaaattagccgggtgtggtggtgcgcgtctgttatcccagctactggagaggctgaggcaggagaattgcttgaacccaggaggcggaggttgcagtgagccaagatcgtgccactgtacttcagcctgggcgacagagcaagactccatctcaataaaataaataaattgcatctgaaacaagaagatgatagacatagatgtaatagatgttaaaagcctaatacgcctctttgtttgcctggcatcagaatgtagtataatactttaaaatctaattgatgaagattacatacgggacaatgattaatataaaattacaccacactgggtctatttattacattttactactagcttcaatagtgatgtgatacgatacagagcagagaaacagagatggtatgtaaaaaaattctacctgcaacagctgattgtttgcaccctcctcatgttgttttggaacttttttttgtaaaagagacaaggtcttgctatgttgcccaggctggagggcagtggctattcacaggcactacagctctcaactcccgggctcaagcattcctcctgcctcagcctcccaagtagctgggactacaggcatacaccactgcacctggctctcatttaggacttttacttgtgtaaaacatatttagaacctctcacaatgcaaaaacaaatttaatacaattttgccagaaatggaattctttaggtaaagctgtaattactgaaaactaaatttagaaaggaaattaaaagatatgagagaaaaaagaaaactatattcaataatgtcactgtagatatgaatataaattactctaaaaaaggtaaaggggccgggtgtagtggctcacgcctgtaatcccagcactttgggaggctgaggcgggtggacgacaacaaggtcaggagttcgagaccagcctggccaacatggtgaaactccatctctactaaaaatacaaaaattaggtgggcgtagtggcacatgcctgtagtcccagttactcaggaggctgaggcaggagaattgcttgaactcgggaggcagaggttgcagtgagctgagatgacgccactacactccagcctgggggatacagcgagtctctgtctcagaaaaaaaagaaagaaaaaaaaaggcaaagggagaagaaaatttacttttatagagtgactactaggtggctcatgcctgtaaccacagcactttgggagactaaggcggatggatcgcttgagcctaggagcttgagactagcctggttaacatggcaaaaccctgtctctacaaaaaatcaaaaaattagctgggtgtggtagtatatgcctgtagtcccagctacttcggaggctgaggtgggaggattgcttgagcccaagagacggaggttgcaatgacctgagatcacaccactgtactctagcctggacgacagagcgtgatgctgtctcaaaaaaaaaaaaaagactactaggttactaggtaccagagccatcatctatttctatacgtaatgtgaaataactattatttacattttacagataagaaaacagcttaatccaaatagctattaagtacagagctggagttcaaattcagcttcactctacagctctggctgctattatagcccatgcctaagaaaccccttcctgaattgatgtttatggtacttaaaagcttttaaatgctgagtttccagaaggtagatgaggaggaatagaactataggtttttccttatccgaaatgcttgggacccgaagtgttttcgattttttgattttgaaatatttgcatgcacataatgagctatcttggggataggaccgaattaaaacataaaattcatttgtgttttatatataccttatacacatagcctgaaggtaatcttatatgaaacttttttttttttttaaatagtctcgctctgtcacctaggatggagtgcagtggagttataatagtccactgcagtcttgaactcctgagctcaagtgatcttcccacctcaatcttctgagaagctggagctacgggtgctaatttaaaaaaattctttaaacatttttttttgtagagacaagatcttgctatgttgcccaggctggtctcaaacttgtggccccaagtttcacatatgggggcattttggatttccaacattctgatcagggatactgaacctgtaatagacatcatgtggaaaataaattgcacaattcaataaaaacatagttggattgccaattttctgtaaaaattcgtgcatacagatgaattcaaaatacacctgtgtgcgtttggactaaactaataaatcatgtacaatgactaagaagacatatgacaacatcctagaaagacaatacattattgccaacaaaagtgcttagcactaagctgtgctaggactatgtagactgaatttctgcctctcctcttacactggcatgcttatacaattcatacttttttctttcctttttttttttttattttgagacgaagtttcgctcttgttgcctaggccggagtgcaatggcgcaatcttggctcacagcaacctctgcctctcggattcaagggattctcctacctcagcctcccaagtagctgggattacaggtatgcgccaccatgcccagctaattttgtatttttggtagagacgaggtttctccatgttggtcaggctggtcttgaattcccaacctcaggtggtccgcccgcctaggcctcccaaagtgctgggattacaggcgtgagccaccgcgcccggccgttcaagtgattttcttgcctcagccttccgagtagctgggactataggcaggtgccaccacgcccggctaatttttgtatttttaagtagagatggggtttcactgttggccgggctggtctcaaactcctgacctcttgatccggccacctcggccttccaaagtgttgggattacaggcgtgagccactaagcctggccatacttttgtcttttaaaaggcaaggtgggccaggtgcagtggctcacgcctgtaatcccagcactttgggatgctgaggcgggtggatcacgagatcaggagttcgagaccagcctggccaacatagtgaaaccctcgtctctactaaatatacaaaaaattagccgggtgtggtggcgggcgcctgtaatcccagctacttgggctgctgagacgggagaatcgcttgaacccgggaggcggaggttggagtgagccgagattgcaccattgcactccagcctgggtgacaagagtgaatctctgtctcaaaaataaaaaagcaaagtaaaagggtaagcacatcatttaggcgcaacggtgtcggctcaagaggatttgcgatttggaagagagcgaggttagcgagaagacagaaggctggaacttggacgaatgtaagctgctcgcggaggggaggcagcgtcttccctgcttcaggccaggcgtgggatccgggccggtcttctctccagtccggttagcgggcggtcactgggtcacatctctacggacgttttcctgttatgacagcctcagaaaaccctttccaaaagctccggcccggaaatcccatcctccacccgaagaaaaccccattttcctttcccgtcaccttcgttcggaagccccggggaagcccagaccacccctccacacatgcacagcaccgagggcttgcctagaaccctccccgccaccgtcgccgtgatcctcgtcgcggcggccccccgggctccccaaacccacctgcagcctcagcgcctacagcgaccccgagaccaagggcaacagggaactcaacccgcgccagtggaagctgcgacctcgggacctgccattcgccgcgcccgcacggagcagaggggtgacgccagcaaatcatactactttttcctcctcagggttgactcctctcattttttttttttttagcttccaaacattaccaataatttctgaataaaatttcgctccagacagacgaggcgtgcaggcgtgaccgccgtcgccttccgacagcaccgtgcccaccccccggagatggtctcgcc

SEQ ID NO: 6545 - DNA, 667 bp, Homo sapiens; identical to SEQ ID NO: 6542

SEQ ID NO: 6546 - DNA, 1716 bp, Homo sapiens
ctgatgatgtaaaaggaaatacagagaaaagcaagcatccttctcccactcctgagcctgtaatcatagggcctagggcttctctgcagacagaacccagccaagacttttcgtaaatgccatgtgcacttcagggcttggtttgttctattatatttagggatgcggtgctgagatgcttgcctgcagaacagcaaaaacctctgacttcattattgttattcagagtaaccagggtcattgctctctggcttgccttaaagccagcaaaggcaattgcccatccctgggcttttggtctggaagagaccgttggcatcattattcagccccctcacttttcaggtaaggagctaatgaagacaacattcccagtgacacacggcaagttactgtggtgttggggtttcagtgtcaggagtctcctctcttcctctggcatttctgctactatgccaggctggctcctttcagtagacataacatcattgaaaaataccacaagtgcccctgtggagagcagagcagatagccattaaaattacaaaagcttatgctttttggcccaacatttccacttcaaggcattcaattcttcctatagatacactcatgtgagggtaaaatgatctctgtataaccttattctttgcaacactgattgtaataaggaaatattggaagcaacccagatgcctatgggtgggaggtgagttacataaattagggaccatccacacaaacagaatatgtgcagctgtgaaaagactgggccacctctccatgtgcaataggaacagctccatcttgccaggcgtggtggctcacacctgtaatcccagtactttgggaggtgaaggtggggcggatcccttgagcctaggcattccagaccagcctgggcaatgcagtgatatgctctcattgtgtaaataaaacaaaataatacattatttgctttgcagatgccactgccgccaggagccctgtaacatcagccatcgtcaaccccaccgtgttcttcaacatcaccgttgacggcaagcctttagacctgcgtctccttcaagctgtttgcagacaaggttccaaagccagcagaaaacttttgtgctctgagcactggagagaaaggatttggttataagagttcctgctttcacagaattattccagggtttatgtgtcagggtggtgacttcatacgccataatggcactggtggcaagtccatctatggggagaaatttgatgatgagaacttcatcctaaagcatacaggtcctggcatgttgtccatggcaaatgctggacccaatacaaatggttcccagtttttaatctgcactgccaagactgagtggttggatggcaagcttgtggtctttggcaaggtgaaggcatgaatattgtggaggccatggagtgctttgtgtccaggaatggcaagaccggccagaagatcaccattgctgactgtggacagctcttataagtttgacttgtgttttatcttaaccaccagaccattccttctgtagctcaggggagcaccctccaccccatttgctcccagtatcctagaatctttgtgctctcgctgcggttccctttgggttccatgttttccttgttcccttccatgcctagctggattgcagagttaagtttatgattatgaaataaaaactaaataacaaaataataataatagta

SEQ ID NO: 6547 - DNA, 491 bp, Homo sapiens
ggccccagacaggaaacatgagaaaagatgatcctttgggaccagctgacagataaaatgccacatgcacaaggaactaaataagggccgactctgctgaggcccggaagttctgctgcaggaagagggaagggaggctcacggggatcctctcctgatgcccaggtggctgcctctctctaggctgcactttttccagctgtgaaatgaggttgttgggatggggggggtcctttgtaaggtccgcggtgtaactcatttcttgcagagaattttgaatgcctttgcctcttcacagcatcctgcttcagacacttgacctgtggcgtgggtgttattatttcccacctcccagatgaagaaacagaggcacagagaagtaacttcccaaggtcacacagtggatctgtagaggacccaggatgtaggcccagttctgtctgacccaaagtctatttcttttagacacttttatactcactctggtaccc

SEQ ID NO: 6548 - DNA, 801 bp, Homo sapiens
gaggtgaatgagctggcgtctccaggtccacactagtcactggggaatcaggggagtcccaacagctgagggcatgtgacagggaaactctgcagcttgcaagtgtccctgagtgtgcatcagatgctctgttcctccacggcagagtcgctccactagagagcctggcgccagtcaccaagactccctgacccttgtctgccaagaagaaacagccaagcctttgctgtctctgagggtctccctcgggtgtccctggcagactgcaccagcctcacaggcatctcccaagccatgggtcagggatgagtctctcggtggcttggtggctctcagtgtgctcagcagcaggtgaggggcctaccccagggcagtgctcggcattcagaaggccgacaggaaaccagaagtttccgaatattatggccccatctcctcttcagtcttcctttccctgaagctcttgtaaacccctttctttcctagctcaacacaacaaaagaaaaccactggataggccgggcgtgctggttcatgcctgtcatcccagcgctttgggaggcccaggcgggtggatcacctgaggtcaggagttgaagaccagtctggccaacgtggtgaaaccccgtctctactaaaatacaaaaattagctgatggtgcgtgcctgtaatcccagctactcaggaggctgagacaggagaattgcttgaaccgaggaggcagaggctgcagtgagccgagatcgtgccacttcattccagcccgggtgacagagcgagactccgtctcaaaaaaaaaa

SEQ ID NO: 6549 - DNA, 800 bp, Homo sapiens
gaggtgaatgagctggcgtctccaggtccactctagtcactggggaatcaggggagtcccaacagctgagggcatgtgacagggaaactctgcagcttgcaagtgtccctgagtgtgcatcagatgctctgttcctccacggcagagtcgctccactagagagcctggcgccagtcaccaagactccctgacccttgtctgccaagaagaaacagccaagcctttgctgtctctgagggtctccctcgggtgtccctggcagactgcaccagcctcacaggcatctcccaagccgtgggtcagggatgagtctctcggtggcttggtggctctcagtgtgctcagcagcaggtgaggggcctaccccagggcagtgctcggcattcagaaggccgacaggaaaccagaagtttccgaatattatggccccatctcctcttcagtcttcctttccctgaagctcttgtaaacccctttctttcctagctcaacacaacaaaagaaaaccactggataggccgggcatgctggttcatgcctgtcatcccagcactttgggaggcccaggcgggtggatcacctgaggtcaggagttgaagaccagtctggccaacgtggtgaaaccccatctctactaaaatacaaaaattagctgatgatgcgtgcctgtaatcgcagctactcaggaggctgagacaggagaattgcttgaaccgaggaggcagaggctgcagtgagccgagatcgtgccacttcattccagcccgggtgacagagcgagatccgtctcaaaaaaaaaa

SEQ ID NO: 6550 - DNA, 827 bp, Homo sapiens
gaggtgaatgagctggcgtctccaggtccactctagtcactggggaatcaggggagtcccaacagctgagggcatgtgacagggaaactctgcagcttgcaagtgtccctgagtgtgcatcagatgctctgttcctccacggcagagtcgctccactagagagcctggcgccagtcaccaagactccctgacccttgtctgccaagaagaaacagccaagcctttgctgtctctgagggtctccctcgggtgtccctggcagactgcaccagcctcacaggcatctcccaagccgtgggtcagggatgagtctctcggtggcttggtggctctcagtgtgctcagcagcaggtgaggggcctaccccagggcagtgctcggcattcagaaggccgacaggaaaccagaagtttccgaatattatggccccatctcctcttcagtcttcctttccctgaagctcttgtaaacccctttctttcctagctcaacacaacaaaagaaaaccactggataggccgggcatgctggttcatgcctgtcatcccagcactttgggaggcccaggcgggtggatcacctgaggtcaggagttgaagaccagtctggccaacgtggtgaaaccccatctctactaaaatacaaaaattagctgatgatgcgtgcctgtaatcgcagctactcaggaggctgagacaggagaattgcttgaaccgaggaggcaaaggctgcagtgagccgagatcgtgccacttcattccagcccgggtgacagagcgagactccgtctcaaaaaaaaaaaaaaaaaaaaaaaaaaaaaaaaaaaa

SEQ ID NO: 6551 - DNA, 100 bp, Homo sapiens
cttgcagtgagccgagatcacgccactgctctccaccctgggcgacagagtgagactccatctcaaaaaaaaaaaaaaaaagaaaagaaaagaaaagaaa

SEQ ID NO: 6552 - DNA, 279 bp, Homo sapiens
cttgcagtgagccgagatcacgccactgctctccaccctgggcgacagagtgagactccatctcaaaaaaaaaaaaaaaaagaaaagaaaagaaaagaaagtaagtattggggcggggcatgatggctcatgcctgtaatctcagcactttgagaggctgaggcgggcagatcaactgaggtcgggagttcaagaccagcctgaccaacatggagaaaccccatctctacgaatacaaaattagccaggcatggtggcacatgcctgtaatcccaacta

SEQ ID NO: 6553 - DNA, 192 bp, Homo sapiens
tttttttttttgagacggagtctcgctctgtcacccaggctggagtgcagtggtgcgatctcagctcactgcaacctctgcctcccaggttcaagcacttctcctgcctcagcctcctgagtagctgggattacaggctcccgccaccatgcccagccaatttttgtatttttagtagagacggggtttcac

SEQ ID NO: 6554 - DNA, 4333 bp, Homo sapiens
tccagattggaagtggtttttctgactcttattttggttttgtttgctttctgaaagttgttactgacctgaaagtgtagcgtcgtgaactggggaaggagagaagagaggcaggatgagaatcgtggagtgcggaggcaggtagcccgtggggtgcctcctgtgctcggtggagctggaagccgcttaggtgccagagctttttctgtgaccaaattctggcttttgaaataacccagtaacagttctctatcttttcattctgcccgctcctcccacagcctggtccctcagaggaaaggaaggacaaggagtgctttgcagcacgtgcccctggcggcgtcatggtactttcctggccctgctgcccctgcccgtccgtcttttatgatttttatttactcgtattggtttttttaaatttctattttttgcagaactgagcctttttctgccctgcctttctcctgtttgtctttcctttgtggttgatattgtgttgtcttctccaaagtatttgtcattagaaacttacagcaagcgtatactttttagcatgtcagtatttttattatgttgccctccttgtctttgataactgcctgtggacgctgtgtaaactttctggtaaaaatccttttttttccccctgtagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccagggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagaaagtataaaattgaccggcatcatgagagacggaagatgccgtgttctcagccaaacaagcaactctttccccgccaggcactgtcgggtggggtcaggccagcttttaaacactggggactggatcacagaaaaacagtggttttctgtccctggaaatgaataggcacaaagacccacttggctgtgggcagactactcttcaataagatttgggtgggaggaggaacattccttttgctattttgagctgagacaatataaatattcaaactgtgccatgcataaagcattgaattctcagggcacctcttcttccccttaccccttttaaggccatcccctccattaataataatccaggtagttgtgaaaatcgtgcttctatctgatcccttcttagtttggcttttcatcccatcagaacaagtaaacgtaggcgccacagctcttgtgagtactgtctccctcacggtgaatgagcctcctggtgtttcgtccaagaaaagaaagggtgtcactggaaccacagccctttttcattttataaactgcctcttcatgttgcctgctcaagtttccacctagaattgctatcactgtggctctttctaaaaatctttctatttaactggttcactgaaattagtcatagaaaacttgtgatttggtgaagaggcattccttgtaataaccaaatgacttgggatggtgtgcatagcaagggcagtgttacacttatgaggactgtctctagcatccaggaagtctctgggtctgagggatggaaagttcttcctgctatgaatgagagtggactcttcccctcacccccaactgaaaccacaaacaaccagaatcttctggaattctgacttagagtcgttgttatagaagaccttgttgctatggaacatgaaactgtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttcccggcagcacgcagctctgcggcctccagaattcccctgttctgagcttgatgcccctagcctgtcccctacctacttcctcccctcctctctagccctctcacaggggtgattgctacctctctgttttcttgggcctaggcaagttttagaggagttcccaagcattgttatgaggccagtgtgctcgctgggctgggcgggatggcctgggcttgtgtgtggcctgagggctctcctggggccttctcttttcccagtcacctttggagccacagaagcagtgcactcattggatgtctgttcttaacacagcttctctttctacattaaaaaaaatcattattgcattttggaaagcagtgctcatcaaaagcaacttttaaaacctattttattgttcctttaaatgttctctcccgctgaaactgccctggagaggctatctgctgctcttccatttacccacatcaggttattctccatgtcactcagtggagatgactccagatgtgtttaaagactggacaattcacctatactgtgtaggaaattacctccttaattacctggtagaattgtcagcagacatgttcatccgatgatagtactgcagttttctattaataatttgcagacttttatctaacctgcactcatgtacagattattaaaagttttaaaatgtaactgatcagtattgatcaatcattgtcttgatttttttttacagcgtatatttctaatcatattttttaaagccaagagaactggttgaatgaatgtttattttcctgaaggtatttttaagataaagcttcctaatggcgtgtaaactttgcatatgtatgtagtttgatacatattgtcacatttgaaaatcttgtgggttgtaactggttttatacaaaatatcgaatagtggaaattgtataattacaatcatgtaattaaaagtattaacccaac

SEQ ID NO: 6555 - DNA, 2184 bp, Homo sapiens
tccagattggaagtggtttttctgactcttattttggttttgtttgctttctgaaagttgttactgacctgaaagtgtagcgtcgtgaactggggaaggagagaagagaggcaggatgagaatcgtggagtgcggaggcaggtagcccgtggggtgcctcctgtgctcggtggagctggaagccgcttaggtgccagagctttttctgtgaccaaattctggcttttgaaataacccagtaacagttctctatcttttcattctgcccgctcctcccacagcctggtccctcagaggaaaggaaggacaaggagtgctttgcagcacgtgcccctggcggcgtcatggtactttcctggccctgctgcccctgcccgtccgtcttttatgatttttatttactcgtattggtttttttaaatttctattttttgcagaactgagcctttttctgccctgcctttctcctgtttgtctttcctttgtggttgatattgtgttgtcttctccaaagtatttgtcattagaaacttacagcaagcgtatactttttagcatgtcagtatttttattatgttgccctccttgtctttgataactgcctgtggacgctgtgtaaactttctggtaaaaatccttttttttccccctgtagtctctccatttcaaggactaaaacagtcttgcgttaagtaaaaacctgtgaccagagctgaaggaagactctaggactgaaaactgcaacagaaattagcacaatttgaaaacaaaacaaaattgcaaaagccttagttgctttttccacctaagaagttgatcaatggagaaaatgtccactggagtttgaataatgaactttgagtttgggtgcaagcaaatgactcagagaagggtccagctctcaagctgaatgacaaacatgctgttgtaaatttagtctcaggtgtaaatacccaagccctctggtacccacggagctggctggtctgtggtgcatgtgtgtccctgtgatggcaatcattgtagttgctggccttcagaagaattgaggatctgatggaggttttttatgtatttattttctgttcaccttgtgaccctgtgtcaaaatttataaagatacaaaaggcattactgaaatggtactttctgtaatttgatactatttggcttaatcatcttcacttgactatttgtaatactgttgtaatgttaactctgttaagtacccaagctgcttgtcttccaccaaagagtgctttattaacaagaatctgtgaaaatcacatttaaacactgttgcatgttgtaagaccaggtggtaccttagtaacctaaaacttgcaagagaatattaatggtagctttagaagactcaggaggagaaactgacttcagagttggaagatgttgcaagtcgttcctttttctgtccttcagggactgaagaactgggaggctgcccattgtttggttgccagtcatacaaattaaaatcatatttccttccatgaatggaagaaacacactattggtttttccccttggaaacagcaatcccaaataatgtcggcttacaaaaaaaaaaagttaccacttttttagagtccttccctgtaacattggattttttttttcccttatgagatccacctaaggccattgacgtggcctgcgatctcagtgacaatgatctgcttctggatctcactgttgcctttggttagggaacacaactagtaactctgcagagtgccttctcccgcagccctactggaacacagcagagtctgtgccatgaagcagttacagaaacagaattgatgtgctgctaaaaaaaaaaaaaaaatggggcccgaaataaaagaatatatagtactcacctcagttccttccataagaagtgggtggtttaatgattgttaagccatttttgcctgtgccgggagcatggagggctgagatgtcgacaggcagtgggaaacaaatgccctcctaagccacaaggcgtgcgccagattagtaggcaactccattttaagaagctgcctttttcacaaaactggaagaaataaaagcggttggaataaacaagttaaaagtctttaatgcaaaaagtaattgaaaggcagtgcctccattttggtgtactttcttggaagagaagtataaaattgaccggca

SEQ ID NO: 6556 - DNA, 3652 bp, Homo sapiens
aatgggctcaagattgttacattatgccaaatgaattgggagtcatacatttagtttagtacacgaagcagtaagtgaaaagagccatgcataacaattctgaagtatgggccgggtgcggtggctcgcgcctgtaatcccagcactttgggaggcggaggcaggtggaccacttgaggtcaggagtttgagaccagcctggccaacatagtgaaaccccgtctctactaaaaatacaaaaattagccaggtgtggtggcaggcacctgtggtcccagctactcgggaggctgaggcaggagaatcgcttaaacatgggaggcggaggtttcagtgagtcatgatcacaccactgtactccagcctgggcgacagagtgagactctgtctcaaaaaagaaaaaaaaaaaattctgaagtatgactctaattttgtaagcgtaagtatactatatatgtatagaaatatagagatgtataaatatttatatacctacaatacatctgtatttatagatgagtaagtttctatatatgcatagaaataagacaggaaaaatatgctatgatactaataaaagttctggttggtgggacagttgggatttttttcttttttatcgtcttattttccaatttttctacaataaatgaagggaaatgggagtgttttaactgacactttttggtgagccaagctattaaaaattcaggctgggcgcggtggctcacgcctgtaatcccaggactttgggaggccgaggcaggtagattatgaggtcaggagttcaagaccagcctggccaagatggtgaaactctgtctctactaaaaatacaaaaattagctgggtgcagtggcgggtgcctgtaatcccagctactcgggaggctgaggctggagaatcacttgaactttggaggcggaggttgcagtgagctgagatcgcgccattgcactctagcctgggcaacagagcaagactctgtctcaaaaaaaaaaaaatcaaataaaaagcctatcgttgatgacagttaattgttaattttgacatgtcttgaaggggcatattctttttaggtagagtgctcaggctttttttttttttttcctccttacatggagttgcacaggctggagagcagtagtgttttctcggctcactgcaaacttcgtcttccaggttcaaaccattctcctgcctcatcctcccgcctcatcctcccaagtagctgggattactacttgtgggtggcatgtgccaccacacctggctaatttttgtatttttagtagagacggggtttcaccattttggccaggctgatcttgaactcctgacctcaagtggtccacctgcctcagccccccaaagtgctgggattacaggcgtgagccacggcgcccggccgctcaggcttttgttaacagcgtagtgtgtcttgcacatttaattctgctgtttgcttttttagattatgctttttaggttacagaagagtagagtccgggagcctggctggcacttgccaggtcatatcgtcttcctgtgaggaaggaagggctggccttgcctctgtttttctatctaggtctcgttgcgttttcatgtcactctagtaacctgaactcctgcctctctggagaagtggttcctggttgcagcaagcatctgcctcaggtccctggcagggatgctttgagggtcctaaggtagatttcagagtcagtaatctggactgaatgttgaaatgacccaaagcagcttccaggaatttgggatagttctgaaaaccaaaaagacttcttttaaattccaaaatggactttcagagatgatgtggagagcaaaaggagtctaacagtgaggattaactgggactcacagtttatttccccaccttcctctaagtgggttctttctttgtgcctcttttgggactttgtcctgtgttcacatcaccctacctgttatccacctacagcttacaaaagaaaggcaaattatgtataggttttaagaattggagttagccaagctgtagcctggagcttttatcctactgaatattattcataatatcatactaaatagtattcatttctgtttggagggcaagagggaattagtatattggtgcacggtctgattctggacaaaatagtatgagctaagattgttgagtaaatttaaagtattgagttgaaatctttaaacagcagtagaaaaaaaaatagagcacccttttggggtcctttcatccctacctgcaacgtagcaggtttaccagttcctactggtttgtcatcatctctgcggcacatgggaacttgaccttccattttcatgttccttggcatccaggatgaagactccacccaaactcgctttgcgcttaattggtgcttttgatttttggttttactgagaggctcttcagctttggggaactttttcaaaaacgtcaaaagagcaattacttggggcagctgaaaaaataggagtgatgtcttaactatttgtctttgggaaaaggtgccactgtttctcacagaagatgactatcccctcgtgtatccatttgaagctgtgccacatcgaaacctaaatctcatgtggccacaggtctgggacggcggccaggcagcctgtgtggccctcggtcctgccagggctctgtgtggcaccttctcattcccttccctgagtctggagagggaggtgagtgggcttctctacctcccacttcctgttagagctataaatccatgctaacctttctcttttaagaattaataaatccagtgaataattggctccgttgaatcggcctgttttcagtgttctcacatgacctctctgaagagctctcttagaacagtcttggaaatttcatcatgccccgagtgagagcctgcagccacctcatttgctcgcattcactcatgtcttcacgcagcccttccgctggtgcgtgtttgttagcttatgctgtttcttttgggcaggctcttctttttttaaaatgataacttcattcattttctaagaaactggcatgtacaagttactttaattctgagttgtatcactaggaaccatcactttctgctgcagctgccaaaccaaacctaaggtccggggctctggagtgctttgtacctaattcttcatattgtgggggctggggagagaaatgctcaggttctttccttagcatcttttttttttttttttaaatgagacagagtctcactctgttacccaggctggagtgctgtggtgcgatcttggctcactacaacctccacctcccaggttgaagtgattctcctgcctcagcctcctgcatagctgggaatacaggcgtgcatcaccacgcctggctaaaaattttcttctgtatttttagtagagatgaggtttcaccatgttggccaggctggtcttgactcctaaccttaggtgatctgcctgcctcggcctctcaaagtgctgggattacaggtgtgagccacggcgcccggcctctttccttagcttctaaaaccacgagtgttttcaggagcccttcagttgggagcagctgcatctaggacctctaacttcttcagtgttctcgggtggctttgctggtgtcacacctgccact

SEQ ID NO: 6557 - DNA, 152 bp, Homo sapiens
attacaggtgtgagccacggcgcccggcctctttccttagcttctaaaaccacgagtgttttcaggagcccttcagttgggagcagctgcatctaggacctctaacttcttcagtgttctcgggtggctttgctggtgtcacacctgccact

SEQ ID NO: 6558 - DNA, 3484 bp, Homo sapiens
cataacaactctgttctttcctcctggcaggtgacagagctgaatgagccactgtcgaatgaggaacgaaaccttctgtctgtggcctacaagaacgttgtgggggcacgccgctcttcctggagggtcatcagtagcattgagcagaagacatctgcagacggcaatgagaagaagattgagatggtccgtgcgtaccgggagaagatagagaaggagttggaggctgtgtgccaggatgtgctgagcctgctggataactacctgatcaagaattgcagcgagacccagtacgagagcaaagtgttctacctgaagatgaaaggggactactaccgctacctggctgaagtggccaccggagagaaaagggcgacggtggtggagtcctccgagaaggcctacagcgaagcccacgagatcagcaaagagcacatgcagcccacccaccccatccgattaggcctggctcttaactactccgtcttctactatgagatccagaacgccccagagcaagcgtgccacttggccaagaccgcgttcgacgacgccatcgccgagcttgacaccctcaacgaggactcctacaaggactccacgctcatcatgcagctcctccgcgacaacctcacgctctggacgagcgaccagcaggacgacgatggcggcgaaggcaacaattaaggccccaggggaactggcagcgcacgcggatgctactactgcagtctttatttttttcccatgagttgggggtcgggtgggggagggaaagggagggatgaccttcccagggagaaacccacgacctgtcctgtctttgatcgcctctttgacatttttgccaaaataccactagtggaaagtcaggctagctgtgctggtattggaatagcagcctcacactggcgtctggactgttctgtagattcatgcaagtggagctgtctgtctctaatttaacttattgctagataatagggttttcagatgaaaagaaaacttaaagaggaatggccctcattcagtaagttctgtggttccagtaaggatttttatgtacatacgctctcgtctctcgttttgggtactttctatctcatctgtctcggctctgcatgttttccagggtgtagcctacagacatggaacagtgtaaatcccagactgacagacttagaacctgaggtctcattcatccttatggtttaggccttgccagttttccgaagtctctgattagttgacagtattaacactaaattgcagtttacagtatttctacattacagccatatgtaacatcaagccatcgattgtgtacttttcctttgctagttgtttgggctttaacatccttattcagccttatccaggttggttttgctgttgatcggtctcctaggctaaatgagaatgaaagcgacttcaggtcaggtggctgtgggattttttttttttggtccttctttcctcttaacgtaaatccaccaccaaaattattaatcctcttgagagaaacgtgaaacgccacaaaaatagagaaaattcaggtctgtatgtcatggatcgtgttggtattttcagagaacatcccgcttctgaagctgctgcagctccctcctcagggatcacactgccgtcacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaaaaggaagagctatatccttaaccattctgtccaatttcgggagccttgtcagtgtgtcagtttttcctccccgaagacactccttccccaagtaattgtaggaagataaaaaaactgttaccagataacaaacactgaactcctatttgaccagaactttttcctctcgagatagttttttctttttaatgaaaaaagcataggaattggagattggcttgtctcacgcagccagtgcacatttggaattgacggaaacaacgttgctatttccacccatttgttttcggcagccttaaggccctcattctcatttcgggtgaatctgtctatctgtgaacgtggcccgcatgtgcattcttttttttatatatataaagtcagtgacgaggaactcccgagacgtgtaatgacaccacacttgttttctttgtttctttgttttatttaggcaagaagaggtgtgagtaattgaggaaaaactgacagatgcttttgctaataccaaaattgagcttacaattaggaactgagtatgtgtaacaggatacaggtgacagtgaagatagaagaaccacgatgaccacagactcaatgtgctctgtaacatcgcacagtttacccagcatgactttccttaggaggccccctcctcacgctagagtaaaagtcccagttaagtgaagcctaccagaagaactagtagaagaagctttgccgcttttgtgcctctcacaggcgcctaaagtcattgccatgggaggaagacgatttggggggggaggggggggggggcagggtaggtggggctttccctaatttatcttcatgtccagtgagcagtgttgcgtttttccttgtagcatttggaaatgatttactggaattacaaaacctatttttcctttaaatttcagctttggctctggctgctttttagaataatgcaagataaaaatcacacctgagggctgaaaacggagagggaatgggagacttgatatttaagcagcttgaatggtttttcttttctttatttttaaagaaatgcacttgcctatgatactgtctctccagtgaaatgattactcctccattactctattgatacaatattgtgcatgctagtgttgtatttctatacagtagcttgaaattgattaacttatactgtaggtgttatgtattcctatgacaaaaaaaattaagtcttcaaattttttaaaggttttttttttttaatttaatttttccttttgggggtaaagtttgctctaccaaatagtgattgtaacaaattgatctgttttggatgttgctatagtgacatgcagttatatattttgtttttaaaagggggggagcaaaagaaacaccagtgttagcttaatcttaatgtctggtgtttgtcatggtgaaattataactattacagtgttggagaacaacaaatatgttctctgaatgagcctttgtgctttttgtcatgttatgcagtgaactatttttaaggtctaatcagtgattatttttccagctccgtgtttctctaaggaattatttcacacacggaccatctttagcagtttcctcagtgatggaatatcatgaatgtgagtcattatgtagctgtcgtacattgagcaaataaacttacagatctgacgccagtgctccttagctt

SEQ ID NO: 6559 - DNA, 1218 bp, Homo sapiens
catcatgccattgcactccagcctgggcaacagagtgagaccaggtctttttgaaactctgtctccaaaaaaaaaaaaaaaagaaatcagccatgcatggtggtgcacacctgtagtcccaggtactctggagattgaggtgggaggattgcttgagcccagtagtttgaggctgcagtgaggtgtgatcatgcctctgcacttcagcttgggaaacagagtaagaccatgtctcaaaaagaacaaaaaaagactttcttatttgtctgatatacctgtatattaccttatgaaagaagcagaaatccccattttgcagataagaaaaccaaagcccagagaaatgaagcggcttgtccccaagattgcttagcgaatgatggagctgggaaaagcccaatcttccgttatttgtggacacatcagaattcagcatgagtgacagcggtctgctggatgacagatcgtcagtgcagaatgagacacgaggtgcctgtgtttattcatgcaggaggagtgtttgcagaagtgccgggaacaagaggtggtggagcaaagcatctctttcctggtttccttctgctctgaactcaagtagtacccaccccctattcttcccctcttttgagtctgtttcactgagggcacggctggtaggagtaacgttgtccagcattaaaacagagcatcagtaatgtctaggaaaatgttaactttaacaacaccactaatcagtttagagaatatttgagcgtgtagcacttgctgatcattcattcagaaaatgaattgcctgccataaactaataagcatgatttggtttatgttttgatttaattatctctgagtagatgctgcttgaagtaatgactgtaatcacttttgccaagcataccccccgtttataatttaagaaaaaaaatttttttttttttgagatggggccttgttatgttggccaggctggtcttgaactcctggcctcaagcagtcctccccacctggtgtctcaaagcactgggattacaggcatgggccaacatactgaacataatgattcaaacatagaaaaaaaagtctcctggtagttcagttcccccatgccccaggagtttagtacaggggtgtccagtcttttggcttccctgggccacattcccttgggccacacataaaatacactaacactaacaatagttgatgagctaaaaaaaaaa

SEQ ID NO: 6560 - DNA, 158 bp, Homo sapiens
ggcatggtgctgggtgtctgtaggaccagctactcgggaggctgaggcaggagaatcacttgagcccaagaggtggaggttgcagtgagccaagattgcaccactgccttccagcctgggcaacagagtgagactccgtctccaaaaaaaaaaaaaaa

SEQ ID NO: 6561 - DNA, 865 bp, Homo sapiens
agaaagaaaatattgtcttttttctttcctcactcttattggatatttgtttagtcctaaacaaagtagctttagcttttaatcatactcattactgtatttttgttcaatgtttcttgatttctgcctactttattaataattatctctttatttcagtttggtctgttcttctctttcaatgaatctaatagaattcatggctcattttatttcaatgtctttatactttctggtcagtgtatttaaagttatacattttcctctgatttctgctttagttgtgccctgcatgattttatatgcagagatattgttgtcattcaattctaagtatcttataatttctcttatgatttctgcttaagcccaagggtaatttaatagcaggctttttagtttcaggactaggtaacatttttggctctttttaaaattattgtttttctaactttatttcagtagagttagggaacatattctgatgttgattcattggaattgtttgagcctttctctctgtaattgttacaaatttaatttttgtgaatattccatgtgagctaaaaaaaatctgtttttgttctctggtctccaccctaatgagactttagaaattctcagctgtaatccatgatccctggtctaataaaaagaagggtgtaaacatggacctgaccttcagatggggagggggaggcaaaagaacacaactgaaaatgctcccccagctacattgaggaggggtaaatggtaggagggagctagggagagaacatttaaagggtgttgacagagtttaaataggtggtgatagggacttgaagtgatagcaaaaacaaaaaacaaaaaacaaaaaaaaaaa

SEQ ID NO: 6562 - DNA, 865 bp, Homo sapiens; identical to SEQ ID NO: 6561

SEQ ID NO: 6563 - DNA, 16347 bp, Homo sapiens
aatctttttctttctttttttttcttttttgagacagagtctggctctgtcgcccaggctggagtgcagtggcgcgatcttggctcactgcaagctccgcctcccgggttcatgcgattctcctgcctcagcctcctgagtagctgggactacaggcgcccaccactacgcctggctaattttttgtatttttagtagagatggggtttcaccgtgttagccaggatggtctcgatctcttgacgtcgtgatgtgccccccttggcctcccaaagtgctgggattacaggcgtgagccaccgcgcctggtcaatcacaatctttttctgaagctagaaaacactgacagtactgagtggatagatgaagtcctgattctccaagtattcgtttaaacacagcccatttctcttactcccatgctttgatggaataatatttatgagtatagtgcaccatggtgatgtacacgttctgtcactagcacgccttaccgtaagattaaagagaagtgcttttctgcttaccaagtatcatttacaaacctaacagatttaaaactttgttctccatagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggttagtattaatttgaggatttttgtagctttgggcagaaaactttgtggtcaggtttaataactcatgattaaatactgggaattctgattcagtgccaagggttctgatgtatggacagggaagcactggtgtcaatcactgttcacttgaggcagttccgcgccagtgggtgagcaggggttaaattggtgggagttttgatctagcaggacttgggttggctctgggttataccgtgggccagttagtaagagaagaagtaatgatgggcaagaagagtcatggcttatttcaaggaaggtttaggaaaacttatttagctgtgtgtgggtaaatatgaagaggctaggtgtattagtatgttctcgcactgctatatatacccgaggatgggtgtggtggctcacgtctgtaatcccagcactttgggaggctgaggtaggtggatcacctgaggtcaggaattcaagaccagcctggcaaacatggcgaaacccggtctctcctaaaaataacaaaaaattagctgggcatagtggcacacacctgtaatcccagctacgcaggaggctgagtcaggagaatcgctggaacccgggaggcggaggttgcagtgagctgagatcgtgccgctgcactccagcctgggcgacagagtgagactccttttcaaacaaacaaacaaaaaagaagtacctgacactgggtaatttataaagaaaagaggtttaattggctcatggttccacaggctgtataggaagtatagtggcttctgcatctggggagacctcaggaaaattaccatcatggtggaaggggaacgggaagcaggtatggcttatacggctggagcaggaggaagacagagggggaaggtaccacacacttttaaacaacaccagatcttgggagaactcttatcatgaggatgggcctacggggatggtgctaaatcattagaaattgcccccatgatttagtcacctcccaccaggccacactccaacactggagattacagttgaacatgagatttgggtgggtacacagatccaaaccacatcactaggggagaaggtaaggtagacttaccttcagtgtctgatgttcaatgtctgaagaactaaaatattttcaacttttttctcttttaaactttcatttgatgttactaaatagtatggacttaattagggttattcagtgaaattgtatgtgaaatactttttaaaatgcagatttctaggttttacccagcagatataatacaaaagttttagagtgtggagcctaagacgtgttgttgttgttttttgagacagggtctagctctgttgctcaggctggagtgcagtggtgcgatttcagttcactgtaacccccacctcccaggttcaagtgattctcctacctcagcctcccaagtagctggaattacaggcacgcaccactacagtggttttttgtagttttagtggagacgggattttgccacgttggctaggctggtcgtgaactcctggcctcaagtgaacgatccccctcggcttccctaagtgctgggattacaggtgtgccaccgtgccggccagatttgtgtatctttttagtgtttcgcattgatggaatcttccattcagtggaaatttgttgagtgcctgttatgtgcctagcaagtgaaactgaaggcagaagttgtattctaggggagctgagattctagggattcttatcataatagtctgacttggttattagaatcacctccagtagattactttggggtaagagaaagagggataagtacttggctgtatgtttaccaaaaacggaatttaaatcattaacagtccctaattcatgaatagagcaataaagaaatcaaaaagataatggcaggctctctcagatatttttgaaatgtattctgaggaaacacctatattcactctgataaaagctagataaaaggcctaaattttctgcagtagtcaatttaagaacaaataacttttctagatagtggcatttttcctttgtgacatagtaatgcagattcactttgtagctaacttttgcaaagagttcctgcagagcagctttttttctactttgtattcctccatgtttttttctgctgccactgcccacagagttcaactttctgtttatggggccgatgtaggactcaatgtaataaagcaacagcagtgtcttgagaaagaagtttcattagcaaataaaacatttgctaataaaaaatttgcttctaatttttaaagctgaagaaacgtgccacactggaaggataatccacgtcaccttgttaaaggtgatcttggctaggcgcggtggctcacgtctaatcctagcactttgggaggccaaggcgggtggatcacttcaggtcaggagtttgaaacgagcttggccatcgtggtgaaaccccgtctctactaaaaatacaaaaaaaaaaaaattagctgggcattgtggtgcatgcgtgtaatcccagctaatcgggaggctgaggcaggagaatcgcttgaacccgggaggcataggttgcagtgagctgatatcgtgccactgcactctagcctgggtgacagagcaagactccatctcaaaaaaaaaaaaaaaaaaaaaaggtgatctcttagacttagatttaatatactgcaatatgttgtcccagaagcgaaagacatttacaattggctggaagtagaatttgagccactaaaactctgtgagcaagtcattcggtgatcactgatgggtagcattggaccaacaactagggcatctagattagagtcctcattgtgcccacagagtgtagacttctagaaggataccagttagtgtcaagtgaatggattagctgactgccaagaggcatttgtcaacttcttgagttgaccatatatccaaggtcaatacctgagcgttaggcttccataaccaaatttatgagacagagtgattccattatctcaggaaaagactcaaacattcctaagagtgacttttaaatcggaaagtaaaccaatcatgtattttagtgagaaatataatttagtagattatggcagcctttcacatttccctattcggaaggggactgcatgaagaatctaaaataacttgataggaatgaaattagagctgggaatttttttttttctcttaaaggcagattctaagttagggaattttatttgtatgcatataccacaccttattgcagtaaagatatatggatgcttataaggaggaagtgttagaatgttgtaggatttcagccttgtacccattttacattagagttaaccttagacctgagtgctcccatgtgtgggtgccctccttgcttggggatgcgatctgccaatatttgcctcagttttgtcacccactctctatgggtacacacttctgtgctttgctctatcccagcagttattttgtccttgggttaacagttcctaaaaaaaatgacatattccatggtaaaattgaagtccatataaatggggtaatatgtgaaattcttttctcaccgctatgtttgtgagatttattcatgtgttctatgtagctgttcttttttgagcatttttgtttattttatgaatacaccatatgtgaattctccccagtttggggctattagaaatagtgctgccatgataatttttgtgtgataatttatataaaagtaaaactggtattttccttgttattggtaataaaatattctattggccacagtagttgtctttgtgaatatttaattggttgtagttgtgttttttagagtttcatttcctttttacatacttgtggggcttttcacggtaggttaatgtgcatagtgtggggcaaaagacccagcatagttgtactttggattcatttttggtaaatttagaggaggttgaggcttgatgattttttaaatcattttccagatttccaatgctatcatttatactaagttcagaattttagttggaaaatttcctttggcagttacatcttttgttttgcttactgtaggtcagatttaatgtactacaatatgttgtcccagaagtgaaagacctttacaattggcttgaagtagaatttaacccattaaaactctgtgagcgagtcacaaaggtaagcctttgtatttaagttctggttgttaccacagagttggccttcttgcagttttgggttgtattcatatttgttaagagagaagttttgtcctatgtgttggaattcagtgcacatttcattgtcttttttctttatttcaagagaaaagatatatctgatgtgctcagcaaacctttggaggttaattagcagcatgactaatttagccattgctgccagtcaccttcaaacaagtatcagtagcttcatgatacattttgtatttctttgcattggatgatgtttttgtatattaaaaaaaaaagagttttagatgttttagtatctcttatgtagaaagtgtgattctctttcaatttaatggattttataggttctaaattgggttagggaacaacctgaaaaggaaccggaattgcagcagtatgtgccacaactgcaaaacaacaccatcctccgccttctgcagcaggtaaaaataaaaaaataaaaaaagttttgtgatgttatgtgctcatcatgaaactaaaaactggaaaaatctagaactgcctaggaagtgagaacctccccaagttctgcccctggcaaaaattagtctatttattaatttgaaaatcagaattattatatttacatattttgtaacggacgcttttgttttttggctgaacactgtctttgggcatttttccttgttagtaatgtagggctaccttattccatttaaggtactgtggtgtatttattcagactctcttgatgaaaacctgtattcctagattttttttttccctgttagaaatcttgtagcattgagcatctttcatacatgtatctttgcatacttctattactttctgtggcataagaagtggaattagtcatagggtttatggatttaaagctttaatagctattcagaagcctggattaatagaccccccaccatgagtgaatgagacagccttttcatatattttagtccaggggcttaagtcagtaagtgctcccattttgttttccatttgttgcatttgggaaggagggcgttttattatattttcatctcagtatttgtgcacatttcattgacctgctttcttttatgtgagtagtgttatttcttatgtgctatacaaataattgaaggctaattagcagtataactataaatagtaatgctgccagtctccttcagacaaaaattctataagaagtgtttaaatatattcggtaagtagcaggtttttaggcttttttgttttacaacaactaggatttgaaaagattataggtttgaggaatagtatgataatggttctcaaagcatggagtttagagtcgatggtctgggattagcattctggctttaacaatgtactgctaacataaattctctggcataatttctacttcccatgactgtcatgagattgcacataaaaagtgctgaataaacagtggctagtgttattaaccctttgttttctatgcaggtgtcacagatttatcagagcattgagttttctcgtttgacttctttggttccttttgttgatgctttccaactggaacgggccatagtagatgcagccaggcattgcgacttgcaggtaggtatgtgctgtaaggagacaggagaaggcccttgagggctagaaagacacataccttctgtttctcagcttttggtacagtgataccattttaaagtttactgagtgaacttttccagcttttgtatatgacattcttctgttactttttgacttcatgcttacttgtggatttaaccattgataatttaattttcaaaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactggtatgcatcttcccggggaaataaatcccagaagttttgagggactcttaacgccatgccatgtcttttacaaaaaggtttgagacaatatctgagagaagggatttatgatatgtttcctatagaattgtacttggtagttttgttatttgatcaaatacacaaatcattgagctttcttccattgaacaaaatactactctgtgtaggtaatgtaatagggtggattatgttacagaaacaacagagtggacataggattcctcaaatagtgaaatacagtgactggatttttccctcctgcttaagttatttcttttttttcttttttgagatggagtctcactctcacccaggctggagtgcagtgatgccatctcggctcattgcaatctctacctcctgggttcaagcaattcttgtgcctcagcctcctgtgtagctgggactacaggcacgtaccacgtgcacagctaatgttttgtatttttagtagagatggggtttcaccatgttggccatgctggtctcaaagtcctggcctcaagtgatccacccgccttggcctcccaaaagtgatggggttacacgcatgagccactgcctgtaacaagttatttcttgtatgtgagctctgttaatgaacacctaaggtaggtttggtgcagagaaaagttgtcttatctaggagagcttctttagctgcgtcattgctattaaaagactgaataggagcaacaccatagcatttaataccgaaaacaaacagcttggatagtgtcatcttccattatcaaatgcagatacatagaaaggcagtacatcaggattattttgtaatttctttgatgcctaataccagagaatgttaattttggtcatgtaaaaaaattcatttgtttttgaagcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagtacgtagcatcttagttattaaaaaattagttttatccaggtattttgtactcttagaaccacagtcctttaccatttgttggcttactgggttatttcatgcattttggtacagctggtcatgactaaatctgtgagtaagcatatgtttattgctctgtgaagttttgtgttttttttgagacggagtattatcttgtcgcccaggctggagtgcagtgacgtgatctcagctcactgcaacctccgcctcccgggttcaagtgattctcctgcctcagcctcccaactagctgggattacaggcgcctgccaccatacctggctaatttttgtatttttagtagagacagggtttcaccatgttggccaggctggtcttgaactcctgacctcaagtgatctacttgcctcagcctcccaaattgctggggttataggtgtgagccaccacacatgacctgtttcatagacaccttatacacatagcctgaaggtaattttgtacactattttacataattttgtgcatgaaacaaagttttgaatgcattttgactgacctgtcacatgggtcaggtgtggaattttacacttgtggcaccatgttggtgctcagaaagttttaaaattgggagcatttcagattttgggtttttggattaggtttgcttaccctatttagtagagtctgggtagatgtaggttggagtagtgagaaaaggatgtatggatatttttttccttatggtcaaatggaaataaggctattgtataatatttttacatttcctaaattatcacccattgtaacaataaaagcaatgtaggattttattctagaaagcagtgagttatgttaggcattgcttgtttctctttattaacaattgtgcatttgtattacctttcaggaccttgaggaattggatccagattttatcatggctaaacaggttgaacaactggagaaagaaaagaaagaacttcaagaacgcctaaagaatcaagaaaagaaggtaaatgaaagggttggtaaacctttcacataccaagttaagagagattttttaaaactacgtgtgttttcgtgtcattcagattgactattttgaaagagccaaacgtttggaagaaattcctttgataaagagcgcttacgaggaacagagaattaaagacatggatctgtgggagcaacaagaggaagaaagagtaagttttttatttaattgtaatatttttagattgtaataaaatcctctgccagtaatggaaccaaggattcagaattgctttattttgtattcttctgctagaaatggtgctctaatggctgcctatgaacagattggtagaaagagggaaaatttcacaatagagattacaaacgaaacttggaaaacaaaggacaactgaaaagcccattttataaaaaactgctttatatacactttaaatgggtaaattgtatggcatgtttatacatctcatagttttcattttacttgcagaattgtgcagccatctccacaatctaattttaaaacacgtctcaaaaagaagttctaaacccattagcagtagtcatccctattcttccccaccaccccagccctaggcaaccgctaaactactcctttctctagatttgctgattctggacattttatataaatggaattgtgtactgtgttgtctttcgtgactaaacaggtcattccatagttttgttaacttatagtatattttatatttacctaatgatacaaaagcatggtttacaaatgcttacggcaccaaatatgtaataaaagtgagtaagcagatctactttaaaaaagtaaccataagcaggaggcaaacatcggtgtagggtgtgataggagaatgcagccttttcttggtttaatctgattgttgtcccttggagattaatgggcctaggattgccagcccttcccatttttttttctggaaaagttggaatttttgtgataattctcttaacatgtaaataattaaaaactaattagaaaagtgctgcagaccaaattgggttgatttggagccttcagtttttcatgtagggtagaaaagaaatagccatatatcatcttgcattgatttccaggtgtttttaaggatgaaaatgcctttaaaaattaaaccatggtgtttgttgttaccatgtcatatttattattttattttattatatataggcacaccttgttttattgtgcttcactttattgtgcttttgtgttacccaggcaggtctcaaagtcctgggctcaaacgattctcctggctgggcctcccaaagtgctgggattatgggtgtgaatcacacctcccccagccccccatattattattatttttattcttatttcttcttttacatattaaaagtttgtggtaaccttgcattgagcaagtctgttgacaccatttttccagcagcatgtgctcatttcatgtctctgtcacattttggtaattctcaaagtatttaatactttttcattatatttgttgtagtgatcagtgatctttgatgttactgttgtaattattttggggtgccacgaaccacactcatagaaggcggtgaacttaatctgtaaattaagtctcttctgactgttctaccgactggccattcccttactctctgtctctccctgtccttgacccttcctattattccctgagacactaatatgtatatatttatttgagacagagtttcattctgtcgcccaggctggagtgcagtggcgcaatctcggcacactgcaacctctgcccccgccgggttcaagtgattctctggccgcagcctcccaagtagctgggattacaggcgcctgccaccatgcccggctagtttttgtgtttttagtggagatgaggtcaccgtgttggctgggctggtcttgaactcctgacctcaagtgttctgttcgcctcagcctcccaaagtgctgggattataggcgtgagccactgtgcccagctcctgagaggtaatattgaaattaggctaattaacaattccacaatggcttttaagtgttcaactgaatagaagagtcacctgtctcactttaaatcaaatgctagaaatgattaagcttagtgaggaaggcatgttgaaagttaggcctcttgcactaatcaagttgtgaatgcaaaggaaaagctttttttttttttttgagatggagtttcgccgttgttgcccaagctggagtgcaatggcgcaatctcagcccaatgcagcctccgcgtcccagttcaagtgattttcgtgcatcagcctcccgagtagttgagattacaggcatgtgccaccacacccagctaattttgtactttttttttttttttttaattagagacggggtttctctatgttggtcaggatggtctcaaactcctggcctcaggtgatctgctcatctcggcctcccaaagtgctgggattacaggcatgagccaccgtgcctggcccggaagagttcttgaaattaaaaatgctactccagtgaacacataaacagtgagaaagtgaaacagccttattgctgatatggaaaaagtttcattggtctggatcaaaccagccacaacattccctttagccaaagcctgatcgagagcaaggctataactctcaacagttaataatacaaatagctgagagaggttagaaagccgcagaaggccaggcctggtggctcacgtctgtaatataagcactttgggaggccgaggagggcagatcacttgaggtcaggagtttgagaccagcatggccaacatggcaagaacccgtctgtactaaaattacaaaaattagctgggcgtggtggcagatgcctgtaatcccagatactcaggaggctgaggcaggagaattgcatgaacctgggaggcagaggttgcagtgagctgagattgcgccactgcactccaccctgggcaaccatgggagactctgtctcaatcaatcaatcaatcaataaaggaagctgcagaagaaaagtatgaagctagcagaggttggttcataaggtttaaggaaaaccgtctttatgacataacagtacgatgtgaagcagcaagtgctgatggaggagctacagcaagttattcagaagatttggctgagatagttgatgaaggtggctacacttaaacaacagactttcttacttttttgagagacagggtctcactctatcacccaggctggagtgcagtggcgtgatctcagctccctacagtatctaccccctgggctcaagtgcccacttcagcctcctgagtagctgcgaccacaggcatgcaccaccatgcctagctttttttttttttttttttttgtatttttagtggagacaggctctccccaggcttcccaggctggtctcaaactcctgaagtcaagcagtctgcctgcttcagcctcacaaagtgttgggattacaggggtgagccatggtgcccagccaatagattttcagtgtagatgaaacgaccttctgttggaagaagatggccagctaggtctttcatacctagagggaagtcagtgcctagcttgagagcatcaaagggtatgctcactgtttaggggttaatgcagctgctaactggaagttgaagccaattctcgtcattccaaaaatcctagggtccttaagaattatgctgcatctaccctttctgtggtctgtacatgaaagaacaaagcctgaatgacagcatatctgttaatagcatggtttgctgaatattttaagccccctgttgagacctactgctcaaaaaaaaaagttttcagaatattgctgctcattgacaatgcatctgatcgtatgacagctctgacagtgatgtataagagagattaatgtttgttttcatgcctgttaacacagtatgcattctgcagcccgtagatctaggaataattttgtctttcaagtcttattatttaagaaatatatttcataaacctgtagctgccatagtgattcctttggtggatctgggcaaagtacgttgaaaacctgctggaaggaattctttattccagatgccatttgtgattcgtgggaggaggtcaaaatatcagcattagaaagagtttggaagaagttgattccaagcctcatggatgacttggaggggtacatgagtagagtggagaaaataattgcagatgtggtgaaaacagcaagagaagtagagttagatgtataggctgggtggggtggctcacacctctaatcccagctctttgggaggctgaggtgggcagattgcatgagtccaggagtttgagaccagcctgggcaacatggtgaaaccctgtctctacaaaaaaacaggaaaattagccaggcatggtggagtgtgcctgcagttccagctacttgggaggctgactgaggtgggaggatgcagaggttgcagtgagctgagatggtgccattgcactccagtgcttgggtgacagagacagaccctgtcttaaaacacacacacacacacacacacacacacacaaaaccaaaaaagactataacctgaagatgtgactgaattgctgcaatctcatgataaagcttggatgggtgaggagttgcttcttatggatgagcaaagtaagtggtttcttgaaatctcctggtgaaaatgctacgaacattgttgacctgacaacaaaggatttagaatattccataagtgtagttgataaagcagcagcagggtttgagaggattggatcaaattgaaattctactcttgagttaaaaaccgtcaaccagtgccacatgctagatgaatcttttgtaagaggttgcaatcagtgtggcaaacttcattgttacctattttaagaaattataccatagtcaccccatcctttagtatctgccatgctgatcattcagcagtcgtcaacattgaagcaagactccactagcaaaaagattatgactcattgaaggctcaggtgatcattagcattttttagcaataaagtattttttgttttgttttctttgagaacaggagtctcaccatgttgtccaggctgatcttgcactcctgggctcaagtgattctcttgcctcagcgtactactgcatctgacttacagtattttaaaattaaggtttgtacattggtgttttagacatgctattgtatacttaatagactgcaaacttctatatgcatcggataaccaaaaaatctgcgttgcttgctttattgcaatattctttattgtggtggtctagaaccaaacctgcagtgcctccaaggtgtgtccgtgtatcataatttttcctttataaagttcctggtatcatggggctaaatgaaaactgtctctcctaaatgcctcaggattactttgtctacctcttgcccgtaattgccttctggggacctattgacatggatgtagttaacgttttcatttttatggcatgacagaaggggcagtggagcagcttctaatttttcaagagtatttctcagtaatttggggttaatgagtaaaaaaaaaagtgcattgaaatttcacaatatttgtacttgcagattactacaatgcagctagaacgtgaaaaggctcttgaacataagaatcgaatgtcacgaatgcttgaagacagagatttattcgtaatgcgactcaaagctgcacggcagtctgtttatgaggtgagcttgctgatttttgggaaatgtttattcatgagctttctagtattggcctaagggttctcccttaacaaattggtatattctttattgagttactatgtgtaacggtcattcaaataatagaaatttttggatgatatttcataagcaaaacaatcatcaaaattgttctaaaggtgaaagttgaatgcataatttaatacaagttttgtttactgtttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttgtacattatgctacctgtttaataccagaaaagtggaactagcactagggggaagatatggctgggaggcacacttagtaacctaatcaatggtctagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagagtaagacagaagtcttgtcgatagttccctttctagaaagg

SEQ ID NO: 6564 - DNA, 2259 bp, Homo sapiens
gcagcagggtttgagaggattggatcaaattgaaattctactcttgagttaaaaaccgtcaaccagtgccacatgctagatgaatcttttgtaagaggttgcaatcagtgtggcaaacttcattgttacctattttaagaaattataccatagtcaccccatcctttagtatctgccatgctgatcattcagcagtcgtcaacattgaagcaagactccactagcaaaaagattatgactcattgaaggctcaggtgatcattagcattttttagcaataaagtattttttgttttgttttctttgagaacaggagtctcaccatgttgtccaggctgatcttgcactcctgggctcaagtgattctcttgcctcagcgtactactgcatctgacttacagtattttaaaattaaggtttgtacattggtgttttagacatgctattgtatacttaatagactgcaaacttctatatgcatcggataaccaaaaaatctgcgttgcttgctttattgcaatattctttattgtggtggtctagaaccaaacctgcagtgcctccaaggtgtgtccgtgtatcataatttttcctttataaagttcctggtatcatggggctaaatgaaaactgtctctcctaaatgcctcaggattactttgtctacctcttgcccgtaattgccttctggggacctattgacatggatgtagttaacgttttcatttttatggcatgacagaaggggcagtggagcagcttctaatttttcaagagtatttctcagtaatttggggttaatgagtaaaaaaaaaagtgcattgaaatttcacaatatttgtacttgcagattactacaatgcagctagaacgtgaaaaggctcttgaacataagaatcgaatgtcacgaatgcttgaagacagagatttattcgtaatgcgactcaaagctgcacggcagtctgtttatgaggtgagcttgctgatttttgggaaatgtttattcatgagctttctagtattggcctaagggttctcccttaacaaattggtatattctttattgagttactatgtgtaacggtcattcaaataatagaaatttttggatgatatttcataagcaaaacaatcatcaaaattgttctaaaggtgaaagttgaatgcataatttaatacaagttttgtttactgtttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttgtacattatgctacctgtttaataccagaaaagtggaactagcactagggggaagatatggctgggaggcacacttagtaacctaatcaatggtctagagcgggaagagagagagcgcgccgaacgagcaaaacgcgaggaagagctacgagagtatcaggagcgggtgaa

SEQ ID NO: 6565 - DNA, 2260 bp, Homo sapiens
gcagcagggtttgagaggattggatcaaattgaaattctactcttgagttaaaaaccgtcaaccagtgccacatgctagatgaatcttttgtaagaggttgcaatcagtgtggcaaacttcattgttacctattttaagaaattataccatagtcaccccatcctttagtatctgccatgctgatcattcagcagtcgtcaacattgaagcaagactccactagcaaaaagattatgactcattgaaggctcaggtgatcattagcattttttagcaataaagtattttttgttttgttttctttgagaacaggagtctcaccatgttgtccaggctgatcttgcactcctgggctcaagtgattctcttgcctcagcgtactactgcatctgacttacagtattttaaaattaaggtttgtacattggtgttttagacatgctattgtatacttaatagactgcaaacttctatatgcatcggataaccaaaaaatctgcgttgcttgctttattgcaatattctttattgtggtggtctagaaccaaacctgcagtgcctccaaggtgtgtccgtgtatcataatttttcctttataaagttcctggtgtcatggggctaaatgaaaactgtctctcctaaatgcctcaggattactttgtctacctcttgcccgtaatttgccttctggggacctattgacatggatgtagttaacgttttcatttttatggcatgacagaaggggcagtggagcagcttctaatttttcaagagtatttctcagtaatttggggttaatgagtaaaaaaaaaagtgcattgaaatttcacaatatttgtacttgcagattactacaatgcagctagaacgtgaaaaggctcttgaacataagaatcgaatgtcacgaatgcttgaagacagagatttattcgtaatgcgactcaaagctgcacggcagtctgtttatgaggtgagcttgctgatttttgggaaatgtttattcatgagctttctagtattggcctaagggttctcccttaacaaattggtatattctgtattgagttactatgtgtaacggtcattcaaataatagaaatttttggatgatatttcataagcaaaacaatcatcaaaattgttctaaaggtgaaagttgaatgcataatttaatacaagttttgtttactgtttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttgtacattatgctacctgtttaataccagaaaagtggaactagcactagggggaagatatggctgggaggcacacttagtaacctaatcaatggtctagagcgggaagagagagagcgcgccgaacgagcaaaacgcgaggaagagctacgagagtatcaggagcgggtgaa

SEQ ID NO: 6566 - DNA, 7442 bp, Homo sapiens
cagagcatcaccgcagaaacaaaggctccagcctccggacaccatgtctgtgcgcttttcttctacctccaggagacttggctcttgcgggggcactggctctgtgaggctctctagtgggggagcaggctttggggctggaaacacatgcggtgtgccaggcattggaagtggcttctcttgtgcttttgggggcacctcatctgcaggaggctatggcggaggtctgggcgggggaagtgcttcctgtgctgccttcacagggaatgagcacggcctcctctctggcaatgagaaggtgaccatgcagaacctcaacgaccgcttggcctcctacctggagaatgttcgagccctagaggaggccaacgctgacttggagcagaagatcaaggggtggtatgagaaatttggacctggttcttgccgtggccttgatcatgattacagcagatatttcccaattattgacgaacttaagaaccaggtaagaaacgccatggcgtgagtgttagcactcctgagagtgtttagccactcacagatgcacaaatgtataagctatcacaataacagggctttgccctcagcttctaaattttaggagttcattttcaatattaaaaataatttctaataaattctaatatttgaacatggcacgtccatcatgtagtattaggtatatgcttttggtaatattaaaatatcaaaagctgtccagtgtctccagttatatatttataggctttcccatagaaagagctttttttaatgcttggggtgggaaatacaagagaccatacccagccaggcacagtggttcagcctgtaatcccagcactttgggaggccaaggcaggtggatcacttgagattaggggttcaagaccagcctggccaacatggtgaaaccctgtttctactaaaactacaaaagttagccgagcgtggtggcacatgcctgtaatcccagctacttgggaggctgaggcaggagaatcacttgaatctgggaggtggaggttgcagtgagccaagatcgtgccactgcactccagcctgggcaacagagcgagactcggtctcaaaataaaagacagagagagagaccatacttaaattacccatcttcaaaagaatggtctgattattagagacagatgccagaaatattactataatttcatgggtaattttatttcaaggaactttgaaatgcatcttaaatatttcctcaatcttaactaacttttcatttgtcagataatttctgcaactaccagtaatgcccatgttgtcctgcaaaatgataatgcaagactaacagctgatgacttcagactaaagtaagtagagctgaagataaatgggaaaaaaaagttgtctaagcattttttctcctttattcttctaagttatttgacgttgtctcaagcctttgttcttgtttattcatgtatttgttttaaacaaaatgcctgttagaatgagtaactagctgagcaacaaattttacttgggaaatttcgggactaacaaaaacgagtgtcaaagtcatatgagaaagaattttggctattcccattctcttgcttcaatgaaatgtatttattgcatgatagatgacctaactgaaatgtgtttttttaattaattaattaatttatttatttatttattttttggagacggagtctcgctctgtcgcccaggctggagtgcagtggcgcaatctcggctcactgcaagctccgcctcctaggttcacgccattctcccgcctcagcctcccgagtagctgggactacaggcgcccaccactgcgcccggctaattttttgtattttttaatagagacggggtttcaccgtgatctcgatctcctgacctcgtgatccgcccgcctctgcctcccaaagtgctaggattacaggcgtgagccaccgcgcccggcctgaagttttaagtattatcttagtagttttacctcaaagcttagtctgagttgtatgatgatctaaaaagtgatgtgccatgtctaatgactaatgatgaaacttccaaatacttttctaaggtttgaaaacgagctagcgcttcaccagagcgtggaggcggacatcaatggtttgcgaagagtcctggatgagctgaccttgtgcagaacggacctggagatccagctggaaactctcagtgaggagctcgcttacctcaagaagaatcatgaggaggtagaagctccacccggctggctctcacaatcgcctccctaccaaattttaaaactaatttcagatgataaatataatgtcttaaattaacattcaagaaggaacctgtcagtttctccataaggcttagattgtttgagacgcttctattcattcttctcaaaagaaacaaacctcccaaaaagtttctaaccctatagatcttgtccatctgactcctttaaaaatattcaggccagaagcggtggctcatgcctataatcccaacactgtaggagacccagaatggaggatcgcttgaggccaggatttcgaggctgcagtgagtcataattgcaccactgcatttcagcctaggcatcagagcgagaccctaactcaaaaagtgcaataaataaaatattcagatcctaattccgttaaacaaatatctttcaggaaatgaaagctcttcagtgcgcggctggaggcaacgtgaacgtggagatgaacgcggcccccggggtagacctcacggttctgctgaacaatatgcgagctgagtacgaagccctcgcagagcagaaccgcagggacgcggaggcctggttcaacgaaaaggtaaaaccacgcttgggtgcgcccgggcgcggactcagccccagcgccctaacgcggcccctgccgttccagagcgcctcgctgcagcagcagatctctgacgacgctggcgccaccacctcagcccggaatgagcttatcgagatgaaacgcactcttcaaacccttgagattgaacttcagtccctcttagcaacggtaagcgaaaagttacaaaacagatttgctttagaaattgagaaaaaaataatcgaagagaattttcttccaacataattacatattttagtttttaaccattaattacagtgcttgacataagacatatttgcattttgcacatgacaatcctctttgcctacaaagtatagctggatgccaataattatgaaatattagaaattagcaaatacagtcaagatactggaaaaagaaaatcgttttgactttgaatcttctatcataagtcaaaatatcaaaaaccactcatatgtggaggctaaaaaagttgatctcagaagtagagagtgggataagtgcttactagagcctgggaaggggatggggggataggaagaggttggttaaaggatacaaaattacagagaaatagggagaatcagttcaagtgttctatagtactgtagaatgactacagttaagaataatttattctataatttctaatagttcaaggagaggattttgaatgttcccaacacacacaaaaaagataaatgtttgggaccatggatatgctaactgccctgattctatcactacacattgtgtgttttgaaatataattatggaaccccataaatatatacaattcttatgtgtccatttaaaaaaaaagaaaaaaaatcctactgcttaaagagagcaaaaatacatttgcaccactcctagcttcatctagcattccttttggccactcaattaagagcacttacaagttcctttgtaagtggcatagacagaggaaaagtcgaggcatgaaggctgactataaaactaaacatgtgtaatgataatcataactgctttcattaagggtttgcccagcacttccgcccacatgtgagtccacaacaaccccggggcatgggcagggcagacgttataactcatgtcattatttccaaaagaggactctgagattcgaagaagttaagcaattcccacagtcccacagttgggtatgaaggaatccagaagttctctccaaattttctaactcccaagtctatacttttcccactatggctagtaaaccaccagagtttatccacagatgaggctatgaatgtatataaaatcaagactttatataaaaaatacttgcaggtgaaaggataagacactctcatcttcattccatgtaaaattgcagtgagtgttccctctgagtatatctgtaaacccattcagattcacaagccaatgaattgaactactgtatttaaagtctaagaaggtaattattttctgtggtttattctactcatggaacgtttatgcggtttactgcaggatgactttttaatagaagagctacaatcctcataagacaagactgtcacatggctagaaatgagtagcaaagtataggcggacttctagttgtgggtaaagtagcaaattgtgccacactctacaagcataggctatattggtgcaggggagggatctttcagtctgtgccctatgaagagacaatttcatcttttttagcacacctgggcatctgagggacattcagcaccagctgtgtcattctcaaatagaaaagtagtaggacatttaataaaggcaacaattaatattgaagaagtggaatcttttgggtaaatataattatttgcatgatgtaaggataattctcttaattatctcttaaatgctttggcttattctaaaacaccgtgaccttttctattaaaccatgtcttaccaaactacagaaacactccctggagtgctccttgacagagaccgagagtaactactgtgcacagctggcacagatccaggctcagatcggggccctggaggagcagctgcaccaggtcagaaccgagaccgagggccagaagctcgagtatgagcagctccttgacatcaaggtccacctggaaaaagaaattgagacctactgcctcctgatagatggagaagatgggtcagtattgccgccattgagaaaacaattcatttttaaggttactaaagatgatttgaaatcaagtacaaaatatctatgatctagatcacgcatagataatactcttttagtgttatttcagaatgcagtgaattcccaccttaaatcattatttttcagtttcctcagtaaaacagaataattaatataagcgctctatacttttacagctcctgttctaaatcaaaaggctatggaggcccaggaaatcaaacaaaaggtaaacaaaagctgtgttaggcattcagtgtttatttgtatgtgtttcaaatgatgttttatttcctatttatgaatttgataaattctaaacagtttatatgtggcattttagattcatctaaaaccaccattgtcaaaacagttgttgaagagatagatcctcgtggcaaagttctctcatccagagttcacactgtggaagagaaatccaccaaagtcaacaacaagaatgaacagagggtgtcttcctgaactccagcctctgagacagaatggcccccaaattaaaataccaaaatgaagctagtttcctaaataagggtccccttatttttctgcttttcttccaatgaattaagacaagttatttttagaatagtaccatttctttggctttttctctatggtggtgtttcaataaaagttcttcctgttgcaagtcatcttccctggttctggccaatctttgcattttagatataccctcccaaatggaagctgaattttgtctttaatttcttctgtttaattcaacagtcttcacaagttggaagtaagtttaatgtgaaaactagttggagtctttttgacttctctgtaaaattttgtctcctttgtctcagtacgaaaagtacttactgagaacacgctatgtgccagataacgaggataaaacagttaataagatccagtccctgaagtcaatatgctcatagatgtagaaataagaacctgaagaatcagaaacaaacttaaacataaaggaaaggctataagtagtgatatttgaaggtagaaggggaaaaagagagctgtgaggacaagggtaagaggagaattccagcaggcatctaattcataatcttgatcactccaccataacggtaggaattcacaagttctctccttcgtttttgccatccaagactgcagagccatgtggctctcaagtcaaaggtaacttttagtgcaataatttcagcacctaccattaatgaatctatttcaaggctgggagtgggaggaggttaaactcagcagaaaaccctccagaggtttatttgtgggtgagagatttggctccccctcaccaatcccgtaacagaaacagcctgtttttctctggaaccagtgtcctattactgaactctgtagaattggctcagcacagttgaaacacagtcactttcaagctgtctttcctcctctttttcccacacgcatgtaataatacctaagcgaatgtaaggcagataccctctcacttaactttttaattaaccagtcctcacatcatataccctcatatcaaaattaggaaaaggaaacatcctaccacgtaagagttgaaaagttacattcacgcaaaaacctgtgcacagatgtttataacagctttattcgtaattgccaaaacttggaagcaaccaagatgtcctcttggttgacgaatggataaataactgtggtacctctagacaacaaaatattatttagtgctaaaaagctatgagctatcaagccatgaaaagacacagaggaaccttaaatgtatattactaagtgaaagaagccaatctgaaaaggctacatactgtatgaccccaactatatgacattctgtacaaggcgaaactatggagatagtaaaaagataattggctgccagaaattggaggtgagggatgcacaggcagaacacagaggatttttaaggctgtgaaaatactctggataatatcataagaacggatacgtgtcattatacattttccaaacccgtagaatatacaacactaagagtaaacggtaatactaaaaagtctttaatttttttttttttttttttttttttgagacagtctcgctctgtcgcccaggctggagtgcagtggcgccatcttggctcactgcaagctccgcctcctgggttcaagccattctcctgcctcagcctcccgagtagctgggactacaggcgcctgccatcacgcccgtctaatttttttgtattttcagtagagacggggtttcaccgtgttagccaggatggtctcgatttcctgacctcgtgatccacctgcctcggcctcccaaagtgctgggattacaggcgtgagccaccgaatacttagctcagatttcacagtatttga

SEQ ID NO: 6567 - DNA, 155 bp, Homo sapiens
gggcatggtggcaggcacctgtaatcccacctacttgggaggctgaggcaggagaatcacttgaactcgggaggcagaggttgcagtgagccgagatggcaccactgcactccagcctgggcgacagagcgagactccatctcaaaaaaaaaaaa

SEQ ID NO: 6568 - DNA, 23917 bp, Homo sapiens
ggggcggggccggggctgctgtgggagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggtaattgaccagcgaacggaagtttgtggggcctgtgaacgctgctggccaagaggccctgccgagtggagccctgcttccgccagcgcatcagagactttgaagcaaagtgcagggggtcagggtggagagtggcggccccagcctcgcagggtaactgaactggatgttcttggctgcccagcgcttacaagtcccgtaccttttgtgccctgccaggaaacaagctcacatcttcctgtgggaaaccttctagcaacaggatgagtctgcagtggactgcagttgccaccttcctctatgcggaggtctttgttgtgttgcttctctgcattcccttcatttctcctaaaaggtatggcctatggagcaagcaggcgagttaggcaggagggtgcctgtgccctagccctgggactggtgtgtgcagctggtggaccctggaattgggacccgatggaacaggtagaacctgtctggggtgggggtggcaggggttgtgtttgttattgccaacccttcccagggttctgcttcgtcatgacttgctcagttccttttcctgtgtcccctgccttctggtcttcagaatgcccccgagaggcaggaagatctatgttacagttctggaaatgatgccctcccacccactcttggtccacggggtgctgggatggtagcgtgggattcggaagacttgcaccactgggtcacgttgttgctgatttggtgactcttgtcctcctaactagtctcactggtattgcgcagtggctgcatgaacattactcagcctgtggaggatgaagccatattcccttttaatgaacagaggacctgttaaaagtgaattggagattaattttaattatgtataatacctgaacacatccctatttaaattacgatattacaaataaggccaaatctccacaggtatttttaaaagccgttttttcgtgaaaaattatctttgatgtgataccatagaaagtatgcagtgctgtctgaggaggattcttgtagaaaaccacaccttcgtacagttgacaagacgtgcagagatagagggccccggggagctttaatctgggaagctttagaggacagacaatctgatttctacacaaaggaaactggaaaagcaaatgaaagagggagagggaagggggagcttccagaataagctggatttaagacgtttatctaccgaatgccaaatcggtaccttgttgggtccggattcaaacaaatatcattgccttcagtgattggcatattcaactctagccctgatgatgagggcttcttgttgatttgaacaatatgtaaacacttctgaagtctcttcttagagctgcatcccaaagcatttgtggatggaaatgatgtgaggtctggggtccatctcatcataacagggtcgggggatatagacaaaccaaggtttatcatgtggaaagacagtttaaagaaataacgtgtatggggcaaacatttgaatattacaaaggggagtacaatgaaaagtaagtttcccttttcagagactaccagtatgttttctttttgttgttgtggtttttttgtttgtttttgtttttattttgagacagagtcttgctctgtcacccaggctggagtgcagtggtgtggtgctcggctgacagcagcctccacctcccgggttcaagcaattctcctgcctcagcctcacgagtagctgggactacaggtgcctgccaacatgcccagctaatttttttttatatatatatttttagtagagatgggagttcaccatgttggccaggccggtcttgaacttctgacctcaggtgatctgcccatctcagcctcccaaagtgctgggtttacagacgtgagccagtgcgcccagccaactgcccacgtttaagattagttttccaggctgggcgcggtggcttacacctctgcactccagcctgggcaacagagcaagactctgtctcaaaaaaaaaaaaaaaagattagttttccagacattttgatctatacgtggaccagcatctttttttttttttttttttgagacaaggtctcgctctgtcacccaggctggagtgcagtggcgcgatctcggctcactgcaacttccgcctcccaggttcaagtgattctcctgcctcaccctcctgagtagctgggattacaggtgcccaccaccacgcctggctaattttcgtacttttagtagagacagggtttcgccatgttggccagtttggtcttgcactcctgacctcaagtgatccacccaccttggtctcccaaagtgctgagattacaggtgtgagccattgcacctggccttttttccaatagtcttgaatggatgtcaaattagagaattgcaagccactgaggctgactttgcatgggctattcggccattggagaagagtacaaagctggatttccattttgctcagggccctagagctcgtgtgtgtgctttctcttcaactcctgtcctttttgtcttcttcacagatggcagaagattttcaagtcccggctggtggagttgttagtgtcctatggcaacaccttctttgtggttctcattgtcatccttgtgctgttggtcatcggtgagtgagctatggctgagggcagctacctgacctagaccctggtctctgctgcaaaaccctttgccacttttgatgtgtagcatccagttttggctgctaggagacagaccaatgaaatgctgtgtctttctcttgagggagggaagaggctccctttgcccatgctgctgaccgctagtcggttcttcactttgaggcccctctaggccgtacatggtggctcatgcctgtaatcccagcactttgggaggctgaggtcggtggatcacctgagatgaggagttcgagatcagcctggccaacgtggtgaaaccccatctctacgaaaaatacaaaattagctgggcgtggtggcgggcacctgtaatcccagctacttgggagactgaggcaggagaattgcttgaacccacgaggcagaggttgcagtgagcctaaatcgcaccattgcactccagcctgggcaacaagagggagactccatctcaaaaaaaaaaaaaagaggcccctctagcagtgggcgtgggcttataccaagcagtttgtatgcagcttatgacggccaccttacattgctttttttcaagaccttggaaggagggacgcctaaggtttctgaggctgctcctcaggtcactctagaactgaagccaagagaagctaactggcctgtgaccttggtctgagtagtgctgctcaccagtcacttaaacagcagaattgcctggagcagggcctctaatgggggactgagcaaccaagcacacagtgaagtcctgccattccctgtagtagtaggaggagaacacagagatgtgtggcagcatatcttggggagagatcctagacctctctgcatctgggctagacttgaggttttcccaggtcgttccagctctgtagttctgtaaactctgacattgaggtgtacactagcaggtgcttgaaagataaactggtccaagggcaagcaggctctgggataaggccaggccaggtggtggtaagatgaaaggcagacattttgcaatgaggtggtagggtgaccatctggagacaagaatcaataaagctcttgtctgactggtagatgtttgttgttttgctgtggtaagtgatcgatatgtccccctgtttgggctccaaagtattggcttggctctgctgtggacaccactcttgtctcagagctgtggtgcctgcctaggcgtggaacactcctcccaccgagtcccagcagaaacactgagcgggtggggggctgtggttcaggggaatgtgcaaagcctcacccaccagcttcagcattaggcatttctccttcctgatgtctcagagcctgataggatatgttcaggctggactgcctctgaacaggccaagtgttacctgacagcttccaaccacatagggtaggtgccagctgcctgagcacctcagtgttcttgaaatacttggcaaggccccaagaggtagtagctctttctaaccagggttctcgccctgagcagcctccaagccaggagtaggtaggtaatatatgtgtcatccccaggccactgagtttttgaactgagcatgtgtgttttggcttttgggtctggggtgggggtaataactggggaggggagggaccatgctgaggatgattccctcagggtcttgccccttccccaaaccagaaggagtatgtttctttcctagagcagctgagtgggctggagagatcctttgcggaatccagtagttgacaaagccttcattcttttttgggatcggggaactgcttggaagttctagggggacatatggccatgatgactggctgcttcctactcccatgttaagaagcataatctagaaagatctgcagagccttcttcaaacagaagtgttagtcacaggtactagtgaagggtaaggggcataactagctagagctgtggccttgcttgggggtggggagggttgagcagatcctcctggaggatggagttgctgagggtgcaggatcttcccacctgggctgaggcccgagacagggagggctggtttctactgtgggacttgggttagtattgctcagtcccccatccccactattggtcattggccaaggtggtccttaggatggtggggttcctggatgcaggtgacagtgtaaggaaacatgtttatcttgtttttctgattacaaaaataatgggtaattattcttaaaaattcaaaagttgaatttagaaagttaaactccccataatcccatttcccacaggtaaccatcatgagtattttgttgtgcatttccagaggggttttgtatgctgacatctttaataaaatgtctacaacggtgggatcatacacacaaagtatttatgtttctttccacattcctgctgggacatggcaggaggagcattccacgcctgagctggtagcacagctctgagataagactgctgtccatagcagagcctagccaatactttggattgtgctttttctacctgctgcacgttagacatcttttttttttttttttttttttgagatggaatctcactttgttgcccagactgcagtgcagtggcgccatcttggctcactgcaacctccgcctcccaggttcaagcgatttcccctgcctcagcttccgagtagctgcaggttacaggcgcccgccaccatgcccggctaattttttgtatttttagtagagacgaggtttcaccgtgttggccaggctggtcttgaactcctggcctcaagtgatccgcccacctcggcctcccaaagtgctgaaattacaggcatgagccactgtgtccggccaacatctttttatagcaatctcattcttcttaaagatcatgtagtattctctcatgtggttgtgccgtaatccattctttataagcatcttcgaatcattgcaaatttatgcaaatacttctgtgggataatttcagaggtgaattgttgaacccgagggtatgaacattttgcattttatacaggtgtgctgtttttacccctgctaacagcgtttgagagtactcgcttcgtggtgctgagggatgggcagatttttataatgcaagatcaacataaaaactaagcagcctaaaaccggaaattaagaaccccatgaggccagtgccctgactcacgcctgtaatccccacactttgtgaggctgaggcagttgcttgcgctcaggagtttgaaactagcctgggcaacatggcgaaaccccgtctctaccaaaaatagaaaaagaaaaaattaactgagtgtggtagcacacacttgtggtcccagttactggggaggctgagaggtggaggttgcagtgagctgggatcgtgccactgcactcaagcctgggtgacagagtgagaccctgtaacccaccatacaaaaagaacctcgatacccatacagtgataccttgctcctctcatatgggagtctattaagagcattctttgggtacatcttagtgtattgacttaaaacgatgtctcaggatgcatggggaaaagcagtaggtttggcgtggctcaatttctacattagagacaaatataaatatatttttaactggagctctatatgtctaacagcggctctttcaggagcagaggctgctcactgactcagcaattatttcagtgcccactctgcacccagagctatcccaggccctgggaatatagtataaaagatttctgctcttatgaagtttgtagtctactttgggagagatggacccaaaaaatgtgtttaaagagaatttcagagatggatgtctattacgaagcaggtaacagtgtaatgtgactaaaaatgactttagatgtgaccacatttttattgtatatactgctagatgtgattatgttatgggatcctttccgtttctacattttgggtgtgtttgaactttcgatgagtgtgaattcctttcgtaatcagaataaaacattatagataataaaacccattgtaaagctttgaaatgaaacccttgactcctagctggtatcctgcaggtcttgactcctatttttttgtttgtttgcttgttttgttttggctttttcgagacagagtctcgctctgtcgcccaggctggaatgcagtggtgtgatcgtaactcacagcagccttgacctcttgggctcaagcgatcttcctgtctcagcctcccgagtagctgggactacaggtgtgcagcaccatgcccagctatttaaaattttttttttttttttttttttttttgttgagagagagtctccctgtgttgcccaggctggtcttgaactcgttggcctcaagcagtcttcctgccttggcctcccaaagtgttgggattacaggcgtgagccaccacatctggcctgggtcttgactcttaagcaccttaggtccccggagcaggcatttccatctccaggttcaacttatcattgtgggggttggggggctatgggccaacttgagatgaacagaacaagacgcggtgagggtaccatgggaaaaggaagccacccccatttccagaaactctttaggcttggttagcatcgtgaactgcagagcaagcctggggcctgtgtagaatggggccagggattgaaaagctggaggaaggagtgggtctgagggtgggagcttccttttttttttttttgagatggagtttcgctcttgtcccccggtctggagtgcagtggctcaatttcggctcactgcaacctccgcctcccgggttcaaatgattcttttgcctcagcctcccgagtagctgggattacaggcgcccaccaccacgccgggctaaattttttttttttgtatttttagtagagatggggttttgccatgttggccaggcttgtctcgaactcctgacctcaggtgatctgcccgcctctgcctcccaaagtgctgagattataggcgtgagccactgcacctggcctgagggtgggagcttctgataacagcatcccatgaggggtgtatgtgcatagaagtgggaagaactggggaggcggatttgagggaagtgagtctgacctgtctcatgccgcctgtctgcctggtatggccttatcttgccctagtgtccgctaaatgcccgtgtctcctctctgctccaccacagatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttgtgagtggggggttgagggggcaggtgctgtgaaaggagccatgggctagccatggacaccgagctcagtgggctcagtctcccccctgtgactttgattcctcctcagtctgtggcctggatcccaaagccctgtctgtgttagggaagccacatagttttctcctgacctccagaggcagcgtggagagtaggagagggctgcctgaaatatcagaagaccctcacacaccacatactctcaggcaaacagatgactatctcacggtctgtttgcatggagagtgagatgtaacggtaaggccttgccctcctctgggagaggaccttcagagtccagctcacaagggagcgactgaatgggggactctttgtgtccggggtgttgacctagggacagcaggtaaaagtggcacgaagaggctgggcctctcctcacctcagggccttccccacgtgaaactcgtaatgaggacatgttacattccatggcagccagagtatttctgatgatttttttggtaaaactaagtaccttaatcaaggctaagggtaactagtcgggcaaaactagaccactacgaagtgcctatttgagcctggggccctgtttgctgcctcctgcttcacatagccgttctgatcagcagggcctggctgggaggtggatgggagctcagaccatgtatgaaggcattggaaaggcgcttgctttgagggtggagctctcatcacttaatcacttctcaaaagaccccacctcttaatgctacggcagtgaggattaaattccaacacatgaagtttgaagggcactcagaccatagcaccaagtgattctcaggctcatggacagttattccccacttggttttgtgccccgagactcaagaatctccatgcctaggagattcttgctctctagtcacctggtgtgtcctgctttactaggcgctacgatgactacttgtcttaaaatctgttgtttagatgatctggtactctctgcgaccaagttggaaagaggggtggagctagaaaaggcaaacacatttttttcaagataatgggtttgatcacagatttgatctacaagcttgctgtcttcaaacttaggaaagtcaggaaggctgggaggagtcagacacataccctaaatttttcaggaagttccaaacaagtattatcttgtggtctgaggctgaaagggaagcagatctgaaagactgagtctcaaacccagaattctgagtgtgacagtcagcaaaatgaggaaaaaagaccacattgagagggaaagagaggaaactaggccatctaccagaaaagcatctagagctttaagaatggtatgggggaggggtgggctgggtgcggtgacttaggcctgtaatcccagcactttgggaggccgaggcaggtggatcacctgaggtcaggagttcgagaccagcctggccaacatggtgacacccagtctctactaacaatacaaaaaaattagctgggcttggtggtaggtgcctgtagtgccagctactcgggaggctgaggcaggagaattgcttgaacccgggaggcagaggttgcagtgagccgagatcacaccactgcactccagcctgggtgacatctcaaaaaaaaaaaaaaaaaaaaaaaagaatagtatcgggaaggtgaaaacctgccgggagctctgaatcatgaaagacatggagaagtgaggagaaggcagtcccttttatatgtctgtgtaaggaaggagatggagggtaggtggtcaagggcaaaggaaacactaggatgagaaaatggaaattacaggtgggcaagagtggcatccctaaaggatgtacttgatgagattatgtccagaagctgttgagatcatctgcagaaggcattgccaccgatgcttgaggatttgcagagtgggagagatactggcagactgcagcctggcaaacatcccaatttccaaagggaggagaaggtagatgaggaattgacctggggagggttgactttgatctccagccatgctctagaaagaatagcttgtatgcttttggaaaagaagagcgggatcattggtgactgctgtgaattcctggagaagttctgtcagccttctatagatggagtgtagatggatttttagcatgatgcttgccagtctgagtctgttcttaacgaccagatgccgaagtgtggggaaggtgctggcagaacagtgtagttaggtgtggtcctaacccacatgagtggctgccatgtggattggctctatccacacatacacatagaagccttagggggctcactctttttttttgagacagagtctcactctgtcgcccaggcaggagtgcagtggctcgatctcggctcactgcaagctctgtctcccgggttcacgccattctcctgtctcagcctcccaagtagctgggactacaggcgcccgccaccatgccctgctaattttttgtatttttagtagagacggggtttcaccatgttggccaggctggtctcaaactcctgagctcaggtgatctgcctgcctcagcctcccaaagtgctgggatcacaggcgtgagccaccgcgcctggcctgctttgttttttcagtgtttcctgcaagctgcaaatgggctgtgtggccataaggctggacaagagcatcacacagaaagccaaggtcctctagggtcacagccaccatcttagatttaactcttagactagcaaggagtatatatttctggcaaaattccagaaatgattaactagatcgcttatgggcaactggtgaatccacactgatctctgggatcaccgtttccttttctaagaagtcacgcaagaccaacctcatggcttttttggatcaggctactggatgggaacacgggagagtgcggcagctgagccaccacgcccagcctccacatgctttttaaaaacattcccgtgtttaaaaaaagttaaccacggggcttttaagcaccacatgctttaaatgccccttggtgacttgagtgttctactcagtttatcatgaatgtttttctgggacaactgacctgtttccagcatatttatttatttatttatttatttatttattttttttgagacaaggtctcgctccatcacccaggctggagtgcattggtgtgatcatggctcactgcagccccgcccttttgcctcagcctcccgagtagctgggactataggcatgtgccaccacgtgctgctaattttttaattttttgtagagacagagtcttgctctgttgcccaagctgatctcaaactgctgggctcaagaaatcctcccacctcatcctcccaaagtgctaggattacaggcatgagccactgtgcctggcctctccagcgttcttgagtgttcttgagtgtctacccaattcctcattggtggatgtcgagcctgcagctctgtttctgatgtcataaacagtggcctcagctagtcagctttctttgggcctcctgatcctcttggagcacccatgccactcctattatctgtctctttcttttttgttgctgttgatttttttctttttctttttctttctttctttcttttttttttttttttgagacagagtctctctgtgtcgctgaggccggagtgcagtggcacagtcttggcttactgcagcctcctcctcctgggttcaagcagttctcatgcctcagcctcccaagtagctgggactacaggcacatgccaccacgcctggctaatttttgtatttttagtagagacggttttgccctgttggccaggctggtcgtctctgactcctggcctcatgtgatctgcccacctcggcctcccaaagtgctgggaatacaggcatgagccaccacacccacctctctttctttccatgttctttatgtcccactgagaggctcagttcttgaacgcgagcaggtactcatggcgcgagcaggtactcatggcccgagcaggttagatggttaggagttaagggttccagacttcgtatgcaacttttctgcgtggtagagagcctgcctagtgggtattccagtactgctggcatgcagtcacctgtgtggattaacattttgcaagggtgtatgggttggagtggagcaggagagcctgaagtggggagaccaagttggaggttgtcagtgagacttgctgggaacctgaacgggggcagtggtacagtggtagtagaagtggggtggaggggacagagctgagaggcccaggtggagttgaatcagcaggcttttccagtctctgggagtctgagatgatcttggttctgctgtggacttgcggaatgcgaggacgcagccccctgctggaaagggagctctggctgcccatggagtaacactatcgtgctaggtgtgagggctggttgcagagtgggacttctggccaggcctgggggcagcaaggaaaggaggggacagggagagcagggttgagcaggggaggcctggcagatgagcaggatagggtgcttccgggcagtcgagcttgggttgctggcttcagaggcattgaggccagggcaaagggaatgtgctggcaggatggattccagcctccagcagagcgatagaagatcggggagcagaaggaagagggaagcaagatcaagaaggaggatgtgagcaggttagtggccaaggaggggagcacattctggagaaggcctggtgcttggcactagttttcagcgggactgggctcagaacacataggaggttagcctgagagctcccgagtagcctttgtaattgggaaagggggcctggcctgaaaggaaacatcacacctagaagcaagtctgtacccttggccccccatagtctgctgctgctgcctgggatagcagtgggagagtcccagcttcccagccaaagccttctgagcttttgtcctgcctctgccactactgtctcagtcctgtcacttgacccagaagcctggggctgctctgccctttcttcttgtcccatgtgactgcccaaccatcgtggccatttctcagtgtgtggcccagcagggtgaggcgctttcacggtgtcaagtagccaacctccagaagtcttcagcctgcagagctggactccacccatgaaacagcctgtagatgtcacctcctaagcctctctctcacaacccttgggaccactgctgtggtggggccaccaccatcccgtatagaccaagcgggctccctgccacctgccttcccccctttggcctgtgcaccccacttccagtggctcgctatcacatggatcctccaggacgcggctcccccacagtctctgcttcggcctccccctgtcatgaagcagtcatgtgggtctcatgggagagcctcacgtaacacatgctctcccccaactcgattctctgagcattttggggacctctgtgcggaacaccccctccagctgccggcccagccggcacctcctcttcgtgaatctccgaggcttccctgtggagcctgttccgaggggcccacaccatgttcccggctgacccatagcgctgtcctcgggtcccagggcagcctgcacacgcagctctgaggtgtggcacttggcagggttgcccatcgtggaaaacctgggctcttccccttcagactgttcagctcagtgccaagggcctggcacatatgaagggcgctgaaacatttggtgactgaatgggctgtcccgggctgacggcgacagctttaggtgcgtgcctgggttgaacttgttgggctttttagccaagaagcccagcttttcaggtcttaggagctatgacagtttgtgaaggcgggtccatcggggccacctccaggggaccacactggatgagccactggtttccacttgtggaagactccggcagtcgctcctgttcccttcctgccaaccttgcacttcgggggcacagctagcgagaggccctcttgagtcttggagtgtgttggggacggcagctccctctgggctggggtttgtgtgttcagaggacctgcactgccttctctgccttactcagcttaaatgacggtcaaggttaggcccaaagtgctggttagcagccagtcgcaggaaggcccctgtttgtgtggaagccccctgaatttttgctgacctgaacttgatccacaggcatcttttgtttcctctttacccctccagggtagaatcccatcgctgccattagcccagatggagctgcccgtgcttctctgctgagctgctttttcttcttttttaggttgagtcatctaatcacagactacctttgcctaagttgtcttacctcagtcggttgctctctaccctccagcttaccccaaacccctcagatagctggttttaaaaaagatacacagcaaaaccccagaaacccagctggtctgtgtcacttgttctcaagaagaagggaggacaggccagacccacacctgcccctttgccctgcgcttagtgcactgtcctcaggatgggtgagctccatctgggtcgtgggctggagctgccacaagtcatgttctcatttgaaacggcctccatttcccccagctctagccctcctcttcccgtcttctccagcgtctgtgtgctgggaggctacagggaaggccacgcagctgtaccaaaatggacttggggcagccctttggggcagccttctcgggtctgctctaggtgactctcccagttgtaacctgttttcctgattccagactggtgggtaagagtcgctgagggcagtggaagccctggtgttagtcattcttcttcactgaagccttcctgaggcgtcacctgacttgcttccttgcctgggcgctgcctcattttttttcttccacagctggggcgtgttcacccagagtccactggccaccctgcggtaggcctggaaagtcagcaggtggcgctgggacaccggctttctgccggctgggggctgaggagtgagcttatgtgaacaccatgtgtatgcaggggctgggggttgaatgacttgactcgcctgaaacccgtcagcagggcgggccgggggtggccacagcatggaatcttttggtcgggacttgctccttctccatttcctattaagcccgtgtcctcttccccttgctcatgggggaagacagggctgctgaaaagtgcttatgagccatggctctctccatttgatatggttggccctgtttctctagtctgtggagaggttctgtttctcctgccttctctggtttactcaaccttttataaaagcacgatagccctgctcagtgtccaacaacattctatcaagaaagcccagtcagattgaggcattggggctgccatgtgtcttccaaggccacatctggattctgttaagtttcgttcactggcctttttttggaccccaggccattctattggtgaccaccctgtatctgtaggagttgcctttggctcttaggttctttcctgttttctggaaatgaatagctaagaacagtgattcgggtaagactacttgggagatccagcagaggcagaagctaaaggccatgttcgtgccctgtcctgggggcctgggaagctacaagggaacagacaagcgcacgttaacgtgcctgagtgacccagtgtgagggagcgggaaaatgttctagaaggctggctcccaggctgaaaaatgccagtgatcagagaggacctggtctgcattgcttgggccctgggtgggggttgagggtgtgaggatgcagaggctggagctctgggttgtgccttcaggtcgcggcagtgaatgttttttccccctgcagccatgagcctggcttgcccatcagaacgggtctgagacggcgccttcccactcctgtcttctgtctcctctgttgctagactgagcagctctgtgtctgcctctgcccctcttggtgccaggctcccaggtgaacacaggtgcagtctaggcccagggagattctgtccagccttacgtgcagcctcaaatctgtcccctcacctgtcagggagcatttcctctcctgggagtgggatccagtcatctggaagcccagccccgcgccctccccccctttttttttttagctatacttgctggagtgggcggaagaccccttttcagtgtgccaggtatgggagtgcagagatgaaggcacagtgcccagcctaaagaccttcatagcctggtagggcagccatataaacggatggcagccacgcagagaacagagaatgaggtagttacatgcgggtgcctggggggctgctgcaggagcccccagaaggcgtccctctgatggggtgggagatccaaaagggtttctggggggaggtgaggattgagctgggtcgagaggacattccggcctggagaactgccacacagagccaggcgtgttccaggaatggtgaggggttaggtgttactagagcagggggccacgtggttagtgaaggaggagagctcactgagggcatgcgtgctggcagcaggtggcttaagcagagggctgacatggtcggatttgccttgctctgggaggtggatgggaaagccgtatggcagcagatagggaggaggcgccagcagtggggatgatggtgggcatgtttgcagttgacatggaaagtgctgggttgtggcttgggctgggggccaagagggctgagtccaaggcggtttgcctgcccaccactacagcaggggctacacgaggtggtcaggtcaggcaggacaagggaaggcccgttttggacaagctgagtctagaatgtctctggggacatccaggagccaatgtttagcaggaggttaggtatgagtctgggccacagagaaaaccctttcggggataagagtggctgggaggaaggtatagggtgtcagctgaagagtgcagaccccagagggagcagaataacagtgggaggagggtgttgcgaggggacctcaggagggtaacttagcagcagagcaaggagttcagggtgacctccggcctgggcggttaggaggccactggtggccctgctgctggcttggaagggcaggccttggccagcctaggttgaggaatatatgggagggaaaagaccaggggcttgggcagggtgactccaggaaggaggcagttgaaggtgaggttcctggggggagaatgatcccgggtcatccagcaggaagagagaggacctagaaggtgtgaaaaagaactatcgggctgggggtgcagtgggaggagtatgcccggggtgctgtgggggtggggagcgcctgtgagggttggcaagaggaaggggaaccggggcctggcagaggggagccccagactgtctcaaggctgggaactgaaggcctgggctggggctgagcagggccaggctttcggacacacacagcgtggatcttgcgctggactttgtgtatgccctggcctatcttggaagccctggttctcaatagccgggaagggcctgggacggtccgaaaagagctgggcctctgctgcactgccgcggaagcatttgtgttagctatctccctgggtactggggtgacagccatgggcactcaccagcagccgcttgcctggcctggtggcggggagtatagccttcagtcttgcttggtcctctctctaccaccaggtggcatgacccccacccctcaattccagctgggaggagcggtcctcttcctctttctacatcactgggatccgctctggggctgggcagctccttgccgggggcctgggtcttagtcagacttgcctttctttctaggcctctccattgacttctggccatgccgatgtgagtcagatgcattgtttctctctggctcctagggcgctcagtagcttcctccaccttcaggctgtagcccagtgcggggcaggctggtgggcagctgggggctgaggcagggaaacctgagccctaggccacgaggtcctgggccgctaattttagaaagcacatgtcactggaaactctccttctctgccaggaatcaacggcctggctctcctggtgctgccaggggcccctgggagcctctccccaaaccaggaacctcaggggtgtctcctggcccgggtgggtactttctgtcctgagtacatctggaaaggggctctgccgaggccctggagagccatggcttgggccagggaggtagctcaccttgtctgctctttactttctccagcccttccgggctgcccctggccatgagcagaggctgtgaagtgtgaaggcctggctggggcaggaggccacttcgactcttctgagtaagctgttgttgaagcactctggactaagcagatttgtctcttccttcccccaggccctgtgtgacccttgccttctgaggtgtgtgagaaaggaacccctgccttgttttgactgtttgaacgagtccttccctcctctcttcctgccagctaacatctcggggcaagggtgaaccaagggaaatgaagtggccattccaatctctgtttggggactagcatctgcctccagctgccacctgtttgcctgtctctcctggctgcttcagagaggcagcctgcgcctgtgtcctgattcctctacaccctccagcccaagaagacctcattcggggtgctgttacataacggatgtgttccagcgcagcctgcatgatgggttgggaaggaggctggccagagaagagagttctatcttacgttgggacctgggagctgttccctgttagtttagagagcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcaggtagatgtgaggatgcggcctggcatgttggaagtgcttggattgattagcttctctcgttaccttaccaaggcaagcccagcctcgcagggaggaaggtggtgctgtggcttgtctggcacgtctaggccccgacccggaaagtgccgcgttctgggacctcatgctgtagcgaggctcttcccagccccccaggctcctgcttccagcccctctgagagctgagggtggccgttgggcacagcggcagaggacggctcctgggccccaccttttccctcacgctgccagcaccaggttggcggcttctcactcggctgccttggcaagagggcaggtccaggctggagctaggtgtggagtgggagcaaccaggaggtgctcctgccagcccttcatgctctttttctcacttctcccttctttttgtaaataattgcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaaggtgagcccagcttcccgacccaccatggggcgtcctggtgttacactgtgggagccacattcttcagggcctcagtggccactgctagcctgtcacgctgggaaatgtgcctgaaaagccagagttgggtggaggcgcagaggggaagtcctcagtggggagagtatgcctgctggaggcgtctgtgtgtgagggtccgggtgaggaggagggtgttgctgctctcgtttccatccactgcttccagttagacccttccctgagaaaaatggcccctcagtgagccaggccctctgctgtgatccgaaggccctcagctaggcccttgttccctgcaagattgccgcaccccctctggaactcggggtctgtggcatccctcagtgctggagaggaggtgggggcagggtagttggccagtcttagacgtcccgtcaggaggtgagctgcaaggcaagctcggagggatgtggatgcagaggtgggatagagctggccaggccgactgggggctcctaactgcagtgagcggcaccatgtagggagcacgaggcaccgccatctgtggaggggttggtgagcaccatggagctgctgagccctgctgcttgggaaggaggcagggccaggggccaggggccaggggccagggcaggcaaggcgtgcccggcgagctgcagcaggtggccccgctggcgcttctctttccctcggcgggcagccacgccctggcctttgcctaggagctgggagcaagtggtggctcggttccgcgttgacatttccgaaggggcgtgtggccagggcagcttgaggaaccgcagctcggtggggaggatggggctggaacctctccctccctccctcctgagtaaccctggcctttggcacttttcccagggagctgctgttgacggaggcaagttggatgtcgggaatgctgaggtgaagttggaggaagagaacaggagcctgaaggctgacctgcagaagctaaaggacgagctggccagcactaagcaaagtgaggctcgacctcgtgtccttccccgcagggaagtccagaggagcctcctctgcccgctgctgcccattttgtgccaaagtattagtaacaagccttgcacgcacgctcgagggctggctgaaaacagaccaatagcaccctgcgcctccaaccccaatgcagccatgcttagccggcaggccagtgaggctaagtggtttgaatggggctcaggaggaaccaggctgcagttggtgggcctcgattgccctgcactagagcagtgcatgctggggctttcccgtccagagtgtggcacggtagccccagcatgcctgggggctgagaatgaggggagtgtgggagtggcgttcaggaggggagtgggcggctcccaagcggcctgcctgtctttggtctcccacgcatagacttaagtctggggcgttttcccccaataccacaggcctcgcctgctgctgctgtgtgcaaggcgtggttgtcattgggtctcgcttgcaggctgggatcttgctccctgtctcccactctcagcctccctggaggttacccttgccgagagccactagagttcctctccattaaagggactgggggatggcctctgtgtttcttttgctttatcttgagcttttttgtcagccctttccctctactttgggggcctgcaaaagcagaggggctttattttgagaagtagcctcctgtataacctcgtttgagatagatttgggccagtttctggtgtctgtagcagtcgggttttttccccctaattcctgtcttttcgtttctgttttcttggtcatttacatcatttcaagaactagagaaagctgaaaaccaggttctggccatgcggaagcagtctgagggcctcaccaaggagtacgaccgcttgctggaggagcacgcaaagctgcaggtcagccctcccgtattgctgcgcccagggcaggagagcagagcaggatgaggcagcccctgcgggtgcggagggaaccttccaggggcccaggggctggctgccctctccaccactccccctggccacctctgccctactgagtgggacccttcaccgggcaggaggggggtggcctggcagcagatgtaggcacttgccaaggcggccctcaggagtggcactggctcactaggctctgagccttcctaccttcgtgctcaggcgcagccatggtttggggcctggtcaagaacaaagaagcaggtgaaactctgggacccactgctggccttctttcctagggtgctggggagtgacgtagggcaaagatccctgggcaagtgagggcacaaggtgtcaaaaaggcaccttccctagcaggcgctagttgtggccatcacctgctgccctaggcctgatctgagtcctcagactagcttgggtgcaccaggccgcatctggaagcccaggcggtcttgacgttgggagtgagggccacataaatactcctaactttggacagctggcctcagtgcttggtggcccaagtttgggcaccacagcaggtggggaggaagggtccagcctcaaagggggcacccatgccctctgtatggggcaggcttggcagatgggcttcgagggcacctgtcaaaggtgtgcagagttgggaagggtctgatcaggtcttgaaggggactggatgccttgctgttccctgcagccaggactcagcccccagtgaggtcctggcagtcctccctggctggcgttaggtccagggctttccctagagcgtgggccagggctgacgctcccaccctggcaggcctttgggtgcagctggggagggggccccttgttcacttgaatagctgttgttaggagagaggggaaccgaggtggacctctggggcatggggctggaggtggcaggggaggagtggacccggccaacctactgctgtgggatttctgtccctttccaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacgtgg

SEQ ID NO: 6569 - DNA, 3699 bp, Homo sapiens
ggcaggtccaggctggagccaggtgttgagtggcagcaaccaggaggtgctcctgccagcccttcatgcactttttctcacttctcccttctttttgtaaataatcacgcctgcttagatgcctggtgactctcatcttgcagcaggccacactgttggcctccaatgaagcctttaaaaagcagatggagagtgctagtgaggcggccaagaagtacacggagaatgaccagctcaagaaggtgagtccagtttctcgacccaccatggggcgtcctggtgttatactgcaggagccatattctttagggcctcagtggccactgctagcctatcaccctgggaaatgtgcctgaaaagccagagttgggtggaggcacagaggggaagtcctcagtggggagagtatgcctgctggagacgtctgtgtgtgggggtcctggtgaggaggagggtgttgctgctcacgtttccatccattgcttccagtcagacccttccctgagaaaaatggcccctcagtgagccaggccctctgctgtgaaccgaaagccctcagctaggccattgttccctgcaagattgccgcaccccctctggaactcggggtctgtggcatccctcagtgctggagaggaggtggggccagggtagttggccagtcttagaagtcctgtcaggaggtgagctgcaaggcaagctcggagggatgtggatgcagaggtgggatagagctggccaggccgactgggggcccctgactgcagtgagtggcaccgtgtagagagcacaaggcaccgccatccgcggaggggttggtgagcaccatggagctgctgagccctgctgctcgggaaggaggcagggccaggggccagggcaggcaaggcgtgcccggcgagctgcagcaggtggccccactggcgcttctcttccccttggcgggcagccacgccctggcctttgcctaagagctgggagcaagtggtggctctgttccgcgttgacatttccgaaggggcgagtggccagggcagcttgaggaaccgcagcttggtggggaggatggggctggaacctctccctccctccctcctgagtaaccctgacctttggcacttttcccagtgagctgctgttgacggaggcaagttggatgtcgggaatgctgaggtgaagttggaggaagagaacaggagcctgaaggctgagctgcagaagctaaaggatgagctggccagcactaagcaaagtgaggcttgacctcatgtccttccccgcagggaagtccagaggagcgtcctctgcccgctgctgcccattttgtgccaaagtactagtaacaagccttgcacgcatgctcgagggctgtgtgaaaacaaacaaatagcaccctatgcctccaaccccaatgcagccatgcttagccggcaggccagtgagactaagtggtttgaatggggctcaggaggaaccaggctgcagttggtgggactcgattgccctgcgctagagcagtgcacgctggggctttcccatccagagtgtggcacggtagccccagcctgcctgggggcttagaatgaggggagtgtgggagtggtgttcaggagcggagtgggcagctcccaggcggcctgcctgtctttggtctcccatgcatagacttaagtctggggcgttttcccacaataccacaggcctcgcctgctgctgctgtctgcaaggcatggttgtcattgggtctcgctttcaggctgggatcttgttccctgtctcccactctcagcctccctggaggttacccttgccgagagccactagagttcccctccattaaagggactgggggatgtcctctgtatttcttttgctttatcttgagcttttttgtcagcctttccctctactttgggggcctgcaaaagcagagcggttttattttgagaagtaggctcctgtataacctcgtttgagatagatttgggccagtttctggtgtctgtagaagctgggtttttacccccgattcctgtcttttcatttctgttttcttggtcatttacatcatttcaagaactagagaaagctgaaaaccaggttctggccatgcagaagcagtctgagggcctcaccaaggagtacgaccgcttgcagtaggagcacgcaaagctgcaggtcagccctcacgtatcgctgcgcccagggcaggaaagcagagcaggatgaggcagcccctgcgggtgcggagggaaccttccaggggcccaggggccggctgccctctcccccactccccctggccacctctgccctaccgagtgggaccattcaccgggcaggagaggggtggcctggcagcagatgtagacacttgccgaggcagccctcaggagtggcactggctcactaggctctaagccttcctatcttcgtgctcaggctcattccatggtttggggcccagtcaagaacaaagaagcaggtgaaactctgggacccactgctggccttctttcctagagtgctggggggtgacatagggcaaagatccctgggcaagtaagggcacaaggtgtcaaaaaggcacctcccctagcaggcactagttgtggccatcacctgctgccctaggcctgatccaagtcctcagactagcttgggtgcaccaggccacatttggaagccaggcggtcttgacgttgggagtgagggccacataaatactcctaactttggacagctggcctcagtgcttggtggcccaagtttgggcaccacagcaggtggggaggaagggtccagcctcaaagagggcacccatgccctctgtatagggcaggcttggcagacgggacttgggcttcgagggcacctgtcaaaggtgtgcagagttgggaagggcctgatcaggtcttgaagggtactggataccttgctgttccctgcagccaggactcagcccccagtgaggtcctggcagtcctccctggctggcgttaggtccagggctttccttagagcgtgggccagggctgatgctcctaccctggcaggcctttgggtgtagccggggagggggccccttgctcacttgaatagctctcattaggagagaggggaaccgagctggacctctggggcagggggctggagatggcaggggaggagtggacctggccaacctactgctgtgggatttctgtccctttccaggctacagtagttggtcccatggacaagaagaaagagtaagggcctccttcctccctggcctgcagctggcttccacctggcacgtgcctgctgcttcctgagagcccagcctctccctccagtacttctgtttgtgcccttcacttcccccattcccttccacagctcatagctcgtcatcttggcccttgtccacactctccaagcacattacagggtacctgattgctacacgttcagaatgcatttgctgttatcctgcttggcctggccaggcctggcacagccctggcttccacgcctgagcgtggaggacacgagttagttgtagtttggcttgcggtggggctgacttcctgttggtttgagcccttttttgttttgccctctgggtgttttctttggtcccgcaggagggtgggtggagcaggtggactggagtttctcttgagggcaataaaagttgtcatggtgtgtatgtgg

SEQ ID NO: 6570 - DNA, 3699 bp, Homo sapiens
ggcaggtccaggctggagccaggtgttgagtggcagcaaccaggaggtgctcctgccagcccttcatgcactttttctcacttctcccttctttttgtaaataatcacgcctgcttagatgcctggtgactctcatcttgcagcaggccacactgttggcctccaatgaagcctttaaaaagcagatggagagtgctagtgaggcggccaagaagtacacggagaatgaccagctcaagaaggtgagtccagtttctcgacccaccatggggcgtcctggtgttatactgcaggagccatattctttagggcctcagtggccactgctagcctatcaccctgggaaatgtgcctgaaaagccagagttgggtggaggcacagaggggaagtcctcagtggggagagtatgcctgctggagacgtctgtgtgtgggggtcctggtgaggaggagggtgttgctgctcacgtttccatccattgcttccagtcagacccttccctgagaaaaatggcccctcagtgagccaggccctctgctgtgaaccaaaagccctcagctaggccattgttccctgcaagattgccgcaccccctctggaactcggggtctgtggcatccctcagtgctggagaggaggtggggccagggtagttggccagtcttagaagtcctgtcaggaggtgagctgcaaggcaagctcggagggatgtggatgcagaggtgggatagagctggccaggccgactgggggcccctgactgcagtgagtggcaccgtgtagagagcacaaggcaccgccatccgcggaggggttggtgagcaccatggagctgctgagccctgctgctcgggaaggaggcagggccaggggccagggcaggcaaggcgtgcccggcgagctgcagcaggtggccccactggcgcttctcttccccttggcgggcagccacgccctggcctttgcctaagagctgggagcaagtggtggctctgttccgcgttgacatttccgaaggggcgagtggccagggcagcttgaggaaccgcagcttggtggggaggatggggctggaacctctccctccctccctcctgagtaaccctgacctttggcacttttcccagtgagctgctgttgacggaggcaagttggatgtcgggaatgctgaggtgaagttggaggaagagaacaggagcctgaaggctgagctgcagaagctaaaggatgagctggccagcactaagcaaagtgaggcttgacctcatgtccttccccgcagggaagtccagaggagcgtcctctgcccgctgctgcccattttgtgccaaagtactagtaacaagccttgcacgcatgctcgagggctgtgtgaaaacaaacaaatagcaccctatgcctccaaccccaatgcagccatgcttagccggcaggccagtgaggctaagtggtttgaatggggctcaggaggaaccaggctgcagttggtgggactcgattgccctgcgctagagcagtgcacgctggggctttcccatccagagtgtggcacggtagccccagcctgcctgggggcttagaatgaggggagtgtgggagtggtgttcaggagcggagtgggcagctcccaggcggcctgcctgtctttggtctcccatgcatagacttaagtctggggcgttttcccacaataccacaggcctcgcctgctgctgctgtctgcaaggcatggttgtcattgggtctcgctttcaggctgggatcttgttccctgtctcccactctcagcctccctggaggttacccttgccgagagccactagagttcccctccattaaagggactgggggatgtcctctgtatttcttttgctttatcttgagcttttttgtcagcctttccctctactttgggggcctgcaaaagcagagcggttttattttgagaagtaggctcctgtataacctcgtttgagatagatttgggccagtttctggtgtctgtagaagctgggtttttacccccgattcctgtcttttcatttctgttttcttggtcatttacatcatttcaagaactagagaaagctgaaaaccaggttctggccatgcggaagcagtctgagggcctcaccaaggagtacgaccgcttgcagtaggagcacgcaaagctgcaggtcagccctcacgtatcgctgcgcccagggcaggaaagcagagcaggatgaggcagcccctgcgggtgcggagggaaccttccaggggcccaggggccggctgccctctcccccactccccctggccacctctgccctaccgagtgggaccattcaccgggcaggagaggggtggcctggcagcagatgtagacacttgccgaggcagccctcaggagtggcactggctcactaggctctaagccttcctatcttcgtgctcaggctcattccatggtttggggcccagtcaagaacaaagaagcaggtgaaactctgggacccactgctggccttctttcctagagtgctggggggtgacatagggcaaagatccctgggcaagtaagggcacaaggtgtcaaaaaggcacctcccctagcaggcactagttgtggccatcacctgctgccctaggcctgatccaagtcctcagactagcttgggtgcaccaggccgcatttggaagccaggcggtcttgacgttgggagtgagggccacataaatactcctaactttggacagctggcctcagtgcttggtggcccaagtttgggcaccacagcaggtggggaggaagggtccagcctcaaagagggcacccatgccctctgtatagggcaggcttggcagatgggacttgggcttcgagggcacctgtcaaaggtgtgcagagttgggaagggcctgatcaggtcttgaagggtactggataccttgctgttccctgcagccaggactcagcccccagtgaggtcctggcagtcctccctggctggcgttaggtccagggctttccttagagtgtgggccagggctgatgctcctaccctggcaggcctttgggtgtagccggggagggggccccttgctcacttgaatagctctcattaggagagaggggaaccgagctggacctctggggcagggggctggagatggcaggggaggagtggacctggccaacctactgctgtgggatttctgtccctttccaggctacagtagttggtcccatggacaagaagaaagagtaagggcctccttcctccctggcctgcagctggcttccacctggcacgtgcctgctgcttcctgagagcccagcctctccctccagtacttctgtttgtgcccttcacttcccccattcccttccacagctcatagctcgtcatcttggcccttgtccacactctccaagcacattacagggtacctgattgctacacgttcagaatgcatttgctgttatcctgcttggcctggccaggcctggcacagccctggcttccacgcctgagcgtggaggacacgagttagttgtagtttggcttgcggtggggctgacttcctgttggtttgagcccttttttgttttgccctctgggtgttttctttggtcccgcaggagggtgggtggagcaggtggactggagtttctcttgagggcaataaaagttgtcatggtgtgtatgtgg

SEQ ID NO: 6571 - DNA, 1204 bp, Homo sapiens
caccagctccccgaacttgggcgagaaggcccgcagcacgttggccgtgaggaacaccacgaggccggcgatggccgagggccaggctgtgccggctccacgggagcgggccgcccgaagcagggtgtaggaagtcacagccacgtccaggagtggcttggtcaggttggagtagaggtgggccacagaggccgcaaaggccaccacgtcctccgtcagagactggtcagggttgcgaagccgcccgtccatgttgctgacccggtagtaggtctgctgggagaagtagaggcggtaggcgtgggccaccagacggctgcggaacgacagggccagttggccctccaggtaacggatggcactgttgacgaaggtagcagggagggcgatgaggagccactgcagcagctgccagccaaaagcccgcgggtccttgcggacgatgcagcgggccagccttccgtccaggcgggccacatacaccgacaggaaggtgcggctcaccaaggcggccgagtgcagggccagcagccccgtctcccggcacaggacccgggggaacagcagccgcaggagccacaggagccgctgcaggaatacccggttcatgccagctttggccgccgcgaccccggaggcctcctgcgtgggctccccggcgggcgcctgaagacccctggccggggccaggcactggcgcaccaaggggtagactttgtgggctccataggccgcgagggccaggagcacggccgtgcgcttcagcgtgttcccccgccagggccggggcctggagagcaccggcatgtcacctgggctggctgccgcgtagggactggggctggtgcctggggcagcagttgaggcaggtggctggaaggattgttgctctgaccctgggcctgttgtctaggcaactggaaaccttgcgatggcccctgagactgtcgctttaggcccccggggtggtgctggggcccctggtgcggtgggctcagggccctccagggtcgcggcctcttcgggcagcccaagtggaggaacttggctctcctgtcctgtcagtgccctggcccctgaggtcagggccttgagaggtctcgggcagagggggcgtctcttcctctccaccttctcctcctcctcctcccccggtggcgcccctccccggggcaccaggcgcgtccgtccgctccgcagcctg

SEQ ID NO: 6572 - DNA, 469 bp, Homo sapiens
gctgaagagtgcagatcccagagggagcagaataacagtgggaggagggtgttgtgaggggacctcaggagggtaacttagcagcagagcaaggagctcagggtaaccgcctgcctgggtggttaggaggccactggtggccctgctactggcttggaagggcaggctttggccagcctagattgaggaatacatgtgagggaaaagaccaggggcttgggcagggtgactccaggaaggaagcagttgaaggtgaggttcctggggggagaatgatcccgggtcatccagcaggaagagagaggacctagaaggtgtgaaaaagaactatcaggctgggggtgcagtgggaggagtatgcctagggtgctgtgggggtggggagcacctctgagggttggcaagaggaaggggaaccagggcctggcagaggggagccccagactgtctgaaggctgggaactaaagg

SEQ ID NO: 6573 - DNA, 469 bp, Homo sapiens
gctgaagagtgcagatcccagagggagcagaataacagtgggaggagggtgttgcgaggggacctcaggagggtaacttagcagcagagcaaggagctcagggtgaccgcctgcctgggtggttaggaggccactggtggccctgctactggcttggaagggcaggctttggccagcctagattgaggaatacatgtgagggaaaagaccaggggcttgggcagggtgactccaggaaggaagcagttgaaggtgaggttcctggggggagaatgatcccgggtcatccagcaggaagagagaggacctagaaggtgtgaaaaagaactatcgggctgggggtgcagtgggaggagtatgcctagggtgctgtgggggtggggagcgcctgtgagggttggcaagaggaaggggaaccagggcctggcagaggggagccccagactgtctgaaggctgggaactaaagg

SEQ ID NO: 6574 - DNA, 9872 bp, Homo sapiens
ccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgaggtgagccgccaaacggggtcgggacggggccatgcctccgacgcgtgcgcggcgttaattccgggagcgaccagggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccaggtatggtgttaattcagataatagaaattgtcttggaaagatggatcccagtagctttttcgtatttttggcagtcgttcttaacgatcagtcttattaatttgattaactcaaaccacctctaggaggcaactcagttgcgtgtaccggacgaaatctagtttctggattttaaaagcttattcctgaaagcaaaaactttcatttcttttttgttgttgttattttcagttttacgtgcagaggataaaatatgtgaattgctgttttgtttgaagataaaacttttctctgtattcttttttagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccaggtgggtaatcttttttttaagtctcagttcagtttcatcgcctttgtcaacccagatatttccaggacaactttaaaggtaaaattaggaaaggtatagtactttaaaatttttcatgcctggaacacctttgtaaaaaaaaaaaaaaggctgtgaagtctgaatcactgaataatgtcaccatataggcatttaatttatgaccctttatctaaaatgccagaactatagggaatatagtactttagagacagcaaattattagactgtcttcaaaactaaatgattactaatagtgctgtcctttttgtttcagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaatgcttcctggaggtagctgtgtcttacctgagacttggcaggaggcagtagggcctgagggaacagcatttacagtgtcctaacggttatactgaaactttccacgtatacttgatggaacatcaatctgaaggcatcctacacttcctccatcagacctgatggtgcaagtgaacaccatcagtgcctttccagtttcatcaaagcagttattttagcttctctgacccaaggtatatcagttctattttaacgtacattacaaagactaatggttatacttagagacacgggtctgttggggacagcagtggcttagggtggctgtaatcccaggaaggaatgtggagaaggaaatgaacatttttttttttgagacggagtctcactctgtcgcccaggctggagtgcaatgtcaccatctcggttcactgcagcctctgcctcccaggttcaagtgactctcctgcctcagcctcccgagtagctgggattacaggcacctaccaccacgtctggctaatttttatatttttagtagatacgggatttcaccatgttggccaggctggtcttgaactcctgacctcaggtgatctgcccgcctcggcctcccaaagtactgggattacaggcgtgagccactgctccaggccagaaatgaacacttgatgactgagtgagtgagcctaccagctgaggatactaatgataagggctcacatttgttgggtgtcctgtgatgtgctgggcagtcctaagcccttgaccattctgttattttgaagctttaaggagatgcactaaatggaagtccatataatagagttggatggagtacctggaaattcagatggtccaacttgaatgagtgaataaatagggaaagctatctgattaaaagtgggtcccctctccatgtgtgaattgtcaagttgtggggattactcctgtttttcataatagttacgttgatttttcaggtgaagcacttgaggaagaactggattccatggcaaaacatgaatccagggaagataaaatttttcagaagtttaaaactcagatagcccttgaaccagaacaggtaaagtggagctcatagctcctcatcgtgttctcttcaggccatgttttatgagtataatctgtaagaaataacttcatagtaacattagtctgttccttaggagcctataaaagcaggcttttgttatcttgttagaggagttcctcacacagatgggccatgtagaaaggtgttttgcagtgctgatccatttaatagttactaaaagactaaaggttatactgtttatcatacagggttcattttctaaagcaagcatcagggatgggagatgaatgagatgttgcctaaggtacatgaggtttaggcaccattggcccccccgccagaaagaaaaaaggttatttttgcccatttccaacaggtaactttggcttgtaaaatgtgacatgttaacatttttctccttaacctcccctaccataaacgtaaatcacgaaagaaaactaaactcccataaaccagtcactggttcaaataaatacacaggaagaatagatctaggtcttaaacactaaggcagtttttagcaatgcatatgcttttagacaaaatacagaaaaccactcagttgctgtaggaagcttattacagtgaaatttacttatgtttgtagtagttttcaaaacactatgtttcacttggtatttgtccctcctaaaattttttaactatgaaggtaggcacagactctgggcagaattctgcaattagagcagaggctcattcttagtcccttcacaatatattcataggattaagttgccaacattaggtagtaaaagcatcatctgggagatatattttgatgccctctgagtcagataaactgaaataatcactttgaggtgattgagaaggcattagtggcacactggtacagccaggtctgatgggggaactgtgacatgccttttgggtcagtgctacatcaagagtaggaacattcatggagtagatagcatgttaccattggcaacttataggtaaggtattgattatttgaacatgatcttcattgattttagattcttagatatggcagaggtattgcccccatctggatttctggtgaaaatattcctcaagaaaaggatattccagattgcccctgtggtgccaagagaatattggaattccaggtatgaccttaaataaggaccatttagtgtgtaatcaccatgattgtttttaaacattaaaaacttcaccaaggtaatttgtgcacatgggtcaacatggcagtatggaagggtaccctataatgaaaatcatcagtttcctgcctcaccttggggctagttccctggaaggaactgtcttgtttttttctgtttcctagttttcagacacggtctattgactgacttctgtgacaatgaggatatctacactgctctccacctccagtgtggttatgtcattattattagtgcctctgttaacttttgttattttaaataatgtataccttcctttcttgttctagtaattaaagtctttgactatatactttatgagaggagtctttactgtttaatcttggtttgtggatttgttagaaaaaatggatataagcattaaagataaatgtccttccctgcccaaaaggatttgttagcatcaaaatccatttgggtagggtggaaatgctcttgagctatggattcactaaccttaccaaagtcatagctaatattggtttgtttctttgggtaaaaaaggaattatgaggaccatacacaaaactctgcttggttcttagtgccaaagctctcaatgtccaaattgaggtgacaggatttgtataaagtgattccatatcaggtggctattctgcctattcactctttgagttagactacttctaagattcctctctggtctctataactacattgatagatgtcctttctgtattcattactagtaattagtgtttcttgagtcaagagtaacaacatctgcaatgatacaaagtaaaagttgcccaaatagaagcctcagcccttttgagtggcatattagtaatgaaaataattcattaacagccacttgtgaacttctttctcaaatggaaaagaccaaacagaaggtgagaggggctttgaagtcataaggaagttttagattgttaaacatgttaattgtataatgtctataatcctgctttgtagtatgaggattgaaagaccaagatccctataatcatcctggctgagaaggtctcgtgctccctgctgtgaagcagctttctaactgtgtgtcaccctcttctcaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacagattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagcaaaaaaaaaaaaagttccaagtgtttttggcaatcatattggtgatagtgtttttgttactcttaagaatgttatggtggaggtgggaggatggcttgagcctaagagttcaagaacagcctgggcaacagttgagtgactttgtctctacaaaaattaaaaaaaattagctgggtgtgttggtgtgcacccgtagtcctggctagctactccagaggctgaggtggatcacttgagcccaggagtttgagactgcagcaaaccatgattgtgccactgcactccagcctgggcaacagagaccgtgtctcaaaaaaaattgcacatataacagataaagtaatgataaagtaaatacgtaaagtaaatgagtaattatgggacattctaattcctcatcccctatgtctttaagaattaaaaattctcagtgtagaaggaagagtgtaatacagaattggttaaataaaaaccctataagctttgaatttgaattggatatacaattggtaaaataaccctatgagctttgaattggacatattaat

SEQ ID NO: 6575 - DNA, 9878 bp, Homo sapiens
ccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccagccctggcctgcgagctgtgggccgcccgctctccttcctgctgcaggtgtatgcgccgctgcctggccgcccggacgccttccaccgctgcatcttcctcttctgctgccgcgagcagccgtgctgtgccggcctgcgaggtgagccgccaaacggggtcggaacggggccatgcctccgacgcgtgcgcggcgttaattccgggagcgaccagggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccaggtatggtgttaattcagataatagaaattgtcttggaaagatggatcccagtagctttttcgtatttttggcagtcgttcttaacgatcagtcttattaatttgattaactcaaaccacctctaggaggcaactcagttgcgtgtaccggacgaaatctagtttctggattttaaaagcttattcctgaaagcaaaaactttcatttcttttttgttgttgttgagtattttcagttttacgtgcagaggataaaatatgtgaattgctgttttgtttgaagataaaacttttttctgcattcttttttagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccaggtgggtaatcttttttttaagtctcagttcagtttcatcgcctttgtcaacccagatatttccaggacaactttaaaggtaaaattaggaaaggtatagtactttaaaaatttttcatgcctggaacacctttgtaaaaaaaaaaaaaaggctgtgaagtctgaatcactgaataatgtcaccatataggcatttaatttatgaccctttatctaaaatgccagaactatagggaatatagtactttagagacagcaaattattagactgtcttcaaaactaaatgattactaatagtgctgtcctttttgtttcagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatgcttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatctgtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagcaatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttaccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaatgcttcctggaggtagctgtgtcttacctgagacttggcaggaggcagtagggcctgagggaacagcatttacagtgtcctaacggttatactgaaactttccacgtatacttgatggaacatcaatctgaaggcatcctacacttcctccatcagacctgatggtgcaagtgaacaccatcagtgcctttccagtttcatcaaagcagttattttagcttctctgacccaaggtatatcagttctattttaacgtacattacaaagactaatggttatacttagagacacgggtctgttggggacagcagtggcttagggtggctgtaatcccaggaaggaatgtggagaaggaaatgaacatttttttttttgagacggagtctcactctgtcgcccaggctggagtgcaatgtcaccatctcggttcactgcagcctctgcctcccaggttcaagtgactctcctgcctcagcctcccgagtagctgggattacaggcacctaccaccatgtctggctaatttttatatttttagtagatacgggatttcaccatgttggccaggctggtcttgaactcctgacctcaggtgatctgcccgcctcggcctcccaaagtactgggattacaggcgtgagccactgctccaggccagaaatgaacacttgatgactgagtgagtgagcctaccagctgaggatactaatgataagggctcacatttgttgggtgtcctgtgatgtgctgggcagtcctaagcccttgaccattctgttattttgaagctttaaggagatgcactaaatggaagtccatataatagagttggatggagtacctggaaattcagatggtccaacttgaatgagtgaataaatagggaaagctatctgattaaaagtgggtcccctctccatgtgtgaattgtcaagttgtggggattactcctgtttttcataatagttacgttgatttttcaggtgaagcacttgaggaagaactggattccatggcaaaacatgaatccagggaagataaaatttttcagaagtttaaaactcagatagcccttgaaccagaacaggtaaagtggagctcatagctcctcatcgtgttctcttcaggccatgttttatgagtataatctgtaagaaataacttcatagtaacattagtctgttccttaggagcctataaaagcaggcttttgttatcttgttagaggagttcctcacacagatgggccatgtagaaaggtgttttgcagtgctgatccatttaatagttactaaaagactaaaggttatactgtttatcatacagggttcattttctaaagcaagcatcagggatgggagatgaatgagatgttgcctaaggtacatgaggtttaggcaccattggcccccccgccagaaagaaaaaaggttatttttgcccatttccaacaggtaactttggcttgtaaaatgtgacatgttaacatttttctccttaacctcccctaccataaacgtaaatcacgaaagaaaactaaactcccataaaccagtcactggttcaaataaatacacaggaagaatagatctaggtcttaaacactaaggcagtttttagcaatgcatatgcttttagacaaaatacagaaaaccactcagttgctgtaggaagcttattacagtgaaatttacttatgtttgtagtagttttcaaaacactatgtttcacttggtatttgtccctcctaaaattttttaactatgaaggtaggcacagactctgggcagaattctgcaattagagcagaggccattcttagtcccttcacaatatattcataggattaagttgccaacattaggtagtaaaagcatcatctgggagatatattttgatgccctctgagtcagataaactgaaataatcactttgaggtgattgagaaggcattagtggcacactggcacagccaggtctgatgggggaactgtgacatgccttttgggtcagtgctacatcaagagtaggaacattcatggagtagatagcatgttaccattggcaacttataggtaaggtattgattatttgaacatgatcttcattgattttagattcttagatatggcagaggtattgcccccatctggatttctggtgaaaatattcctcaagaaaaggatattccagattgcccctgtggtgccaagagaatattggaattccaggtatgaccttaaataaggaccatttagtgtgtaatcaccatgattgtttttaaatattaaaaacttcaccaaggtaatttgtgcacatgggtcaacatggcagtatggaagggtaccctataatgaaaatcatcagtttcctgcctcaccttggggctagttccctggaaggaactgtcttgtttttttctgtttcctagttttcagacacggtctattgactgacttctgtgacaatgaggatatctacagtgctctccacctccagtgtggttatgtcattattattagtgcctctgttaacttttgttattttaaataatgtataccttcctttcttgttctagtaattaaagtctttgactatatactttatgagaggagtctttactgtttaatcttggtttgtggatttgttagaaaaaatggatataagcattaaagataaatgtccttccctgcccaaaaggatttgttagcatcaaaatccatttgggtagggtggaaatgctcttgagctatggattcactaaccttaccaaagtcatagctaatattggtttgtttctttgggtaaaaaaggaattatgaggaccatacacaaaactctgcttggttcttagtgccaaagctctcaatgtccaaattgaggtgacaggatttgtataaagtgattccatatcagggtggctattctgcctattcactctttgagtcagactacttctaagattcctctctggtctctataactacattgatagatgtcctttctgtattcattactagtaattagtgtttcttgagtcaagagtaacaacatctgcaatgatacaaagtaaaagttgcccaaatagaagcctcagcccttttgagtggcatattagtaatgaaaataattcattaacagccacttgtgaacttctttctcaaatggaaaagaccaaacagaaggtgagaggggctttgaagtcataaggaagttttagattgttaaacatgttaattgtataatgtctataatcctgctttgtagtatgaggattgaaagaccaagatccctataatcatcctggctgagaaggtctcgtgctccctgctgtgaagcagctttctaactgtgtgtcaccctcttctcaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccggcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagcaaaaaaaaaaaaagttccaagtgtttttggcaatcatattggtgatagtgtttttgttactcttaagaatgttatggtggaggtgggaggatggcttgagcctaagagttcaagaacagcctgggcaacagttgagtgactttgtctctacaaaaattaaaaaaaattagctgggtgtgttggtgtgcacccgtagtcctggctagctactccagaggctgaggtggatcacttgagcccaggagtttgagactgcagcaaaccatgattgtgccactgcactccagcctgggcaacagagaccgtgtctcaaaaaaaattgcacatataacagataaagtaatgataaagtaaatacgtaaagtaaatgagtaattatgggacattctaattcctcatcccctatgtctttaagaattaaaaattctcagtgtagaaggaagagtgtaatacagaattggttaaataaaaaccctataagctttgaatttgaattggatatacaattggtaaaataaaaaccctatgagctttgaattggacatattaat

SEQ ID NO: 6576 - DNA, 426 bp, Homo sapiens
cattaaagccactgtagtagccaagggaaagcttcctttttgtcctctgaaggttcactgaaaagtcaactgacaaaaggcacattaattggagaaagggcatacaaatttattaacatgcacatgggggagaaccagagtgattttgctgaagccccaaatggggttcagaaacttatataccatcttgaggttacagaatgggggtttggattgtggcataacaggttatgcgggtggagacctggctgacaaccacggtcttgttatgtaaatgaaacctcctaagtagaactccttaaagagaacaggtggtacatgtttctttcagacctttgcaaaccaacagtaaaattctaaaccctccaaccgactgatggaccctctgcttgcccaagggcattctgaagttaacctgaaaaacta

SEQ ID NO: 6577 - DNA, 18491 bp, Homo sapiens
ctaacacttttataaactgcatttattgtacagagtactctgaagaaagaaaaaaatatgtacagccattcattttcattaacacatatattctgtcctgcaatactggagaggtggaatgtgtctggcacagaaataacccctaggagttataaattagaaaaacaacacttttaaaaaagatttttacttttctggtagaaatataaaaactgtggttcatggggaaaaacattaaaattaaaaagtccaatcaattatagaggtggctttaacacttaaagttttctccctcaaaccaacttgtcaacagcagtgtttaaaatctacatataaataaatgggcagcgctgcccagatagcagcacggtatgagcaactcacagtcacgctgcgcggtgttctcagtgcacaaataatgccccttcccggcatcccgcggtgggcacttacagaagggcatcacctggtgccacaccctgcaactcaacatccatcttctcacaacaccaccatttaaaggtaccaaaacaaactgatttgtttaaaaaaaaaaaaagaagggggtgggggaggcaagggtacatgagagccattacgtcgtcttcctgaatccctttagaatagggtagatgttttcaaatgcttcataaatttctgctctgactttagcacctaagaagacaagttggagtagagatgagagactgaaatggcacttcttaacatattaagatggtaaaattcttaccttaaagctgcaagcacaattctcaccatacccagtcagattaaggcacaggcatgaaaacattaatagtggaatcccttgtcacaatcttatttttgtttataaaacaatacttttaaaaaatcatcttagtgactccagcgtctcattctatagctcaagaggcatgtattcacacttctctccttggtcctgaaccaggccataaaccaagcaggacggcaatgataacaactgaatcttcttctctgaattgctgccttcaactagactcatttctgaatcttcctttcttgtctcataatcatattgctgaggaatcctaaagcttcagataactaattccaagtgaaaacgccatcttttgttcaatgcaatgctcacctcctcactgtaaatggaagtctgcttgcagagctgtggtcagacttccctgctctcactgtgcctttagtgggcacgtttctcatcagactttgggtgggaggcctttgtacaagaagctagcccactgtccgaacactgaaatttcttttcagcactgagaaaatgccatactcaaaacacttacaaactttcagatactacttcctgttacaacttacctgttaatacaacttttccagaaacaaaaataaggagaacaattctgggtttgatcattctgtagattaaaccaggaaataactctggctcataactagaaggaaaattgcaaaaagtttagaaatcaagagctttgtgtgcttttagataaaatgaggacctgtacaaggaaaaatactgaataaacaaactagtcaagaggtaaaacacagttcttcaagcagcatcaaaggatagaatagaataattaaagcaagtgaggccgacttgtagtcgtcagttgataaccactggatggaaggctatttgtcctcctatcactttaccctatttctattgaatctggattttctgatttaagaaaaagagccctgtagttatgtctgcagtctctatatcattagatataatgatatctaatgcagataataatcctttacttttacagtcctaataattactattacagtcctaataatcatttacttctaagatccaatactgacagtttaacttttaatcatatcttacctccttaaattgaaatattctctagctgacaattgtggtcaggaaatttaatcaaacttatatactagcctgagaattaacctatacctgattaagctgtctgactgaatggactattggtatatattctttttttttttgagacggagtcttgctgtgtcgcccaggctggagtacagtggcacgatcttggctcactgcaacctccatctcctgggttcgaatgattgtcctgcctcagcctcccatgtaactgggattacaggcatgcaccaccatgtccagctaatttttgtatttttagtaaagacgaggtttcaccatgttggccaggctggtcttgaactcctgaactcaactgatctgcctgcctcggcctcccaaaatgctgggattacaggtgtgagccaccaggccaggcctggtacatattcttctaagcctagtaatctcatttttctcagttcggagagactgaaaacaggatgcctctgtttctgtgtgtctgacctaagacaaaattcaggacaggcttctctgaggaagagtggaatgggtagacatatggaactcaagtgggagcttcctaggtgaaaagggaaatgagcatactaggcataaaagtggcaagtgcaaaggcctagggcaggaggaaccaagtgagccccaggggcacacagaactaatgtgcctgtgaacagacaccagaagaccatgagatgaagcagtgaggtgggcagggctgcctgcctgtgagtcttcacctgcaagtagcagggaagataattagaaagttgttcctatcgctcaacttcacactttgctggtagatctgacacaatgttgactaaaagagaagatccaaactgggaaaaaaaattgatacaaggttagggtcaattcatgcattccaagtgtattcagcaataaaacgataaaacatacagaagtagaatcaaattcattccagtaaaggggagttatgggtaccgcaaagtgataagggaagcagaggctggtgagggtgataaatatgactgagaacatcaggaagacaatgcaagaatacatacaactataaccatgtcaactgttctcatatactgaatattttgcatgtgttttattctgaacaatgtttagattataaatgaactgttgccaataacaatcataatacatttcagacttacctactaaattgttggtgggtgagcacaaggccttctaaccttataggaaacttcacatcacagctccccaccatattctgaatcttgaagtccaagaacttagctggaaaacccaacttctgtacaactctagcatattttcttgctgccagtctggactgttcttcactagggaaaggaaaaaagtgagttattcatactcagagccagctaaaatacttatttagactaataacttataaaaagtccaaaacagtaaactaataaagtgtaaactggtcagccttcttgcaataggagaaaagactgacaggcattcacaattccttataaagtattcctggatccttgacagaaaactgtaggcctgccaaaatgacctttcaatccgccaaattattgtagccctagattttatggatgtgaattatcaccatcatcagtcatcactatttctgtattttagcccatgcatttctactgagaggaaaactaacaaacttcattttgatcagaaaatgttgatgagatttattattgaacaatgtattcactaattctatcctcttttataccaagactcatcatgaatagacattcctatgtcatttgttgaataaactacgacttagcagttcagagcttacataagaaaagcagaatgtgggccaggcatggtggctcacgcctctaatcccaagcactttgggaggccaaggcggatagctcacctgaggtcaagagttcgagaccagcttggtcaacatggtgaaaccctatctctactaaaaatacaaaaattagctgggcatggtgccaggcacctgcaatcccagctacttgggaggctgaggcaggagaatcacttgaacctgggaggtggaggttgcagtgagccaagattgtgccactgcactccagcctaggtgactccaccaaaaaaaaaaaaaaaaaaaaaaaaaaagaaaaggaaagaaagaaagaagagaaaaaaagaaaaaataaaagagaaaaaggcaggcaggcaggtcgggcacggtggctcacacctgtaatcccaacactttgggaggctgaggcaggcggatcatgaggtcaggagattgagaccatcctggctaacacagtgaaaccccatctctactaaaaatacaaaaattagccaggcatggtggtgggcacctgtagtctctgctactcgggaggctgaggcaagagaatggcgtgaacccaggaggcggagcttgcagtgagccgagatcatgccactgcactccagcctgggcgcagagcgagactccatctcaaaaacaacaacaacaacaaaaaagaatgtgaaaatattaccataaagagactatcaggtgcaggggatcaggaagaacaaaaatcaagcatatatatatatgctacgcttttaaatttcaggtaaatgtattggtggtttcttgtcttgatgaaatagtcatccaactacatatacaatattcagttttcagatgctctgggacaaaaaggctaaatgctgcatgaaaagcttgccttgataaaccaaaagtttctgatgttccatgcaggggaaaacaagcaaacaaaaacgctcttaattaaagaggttactactgcatgttgtggccaaggggaagtgaaaggcaagaacacatccttgtcctgcattctgaaaaacctcggagatcaggagccagaatgtccacaccaatggcattcccatcactgaaagacaatttcaaacttcagaataagcaaaaatatccacagcccccttctatgtgttgatacctccaagtacatttaatactctttcatttaaaaagttttagtttatttgttcagttcatttatgaagctaatgtcactaattttccccctagtttttgacttctaccaagtatataagctctgtttagaacagtcagggccgcagagtactaaccttcagacaggatcacttcagatggagaatataggcaatgacattttataacaagggtgcattccttaagatctgcacaactcaaacactattaatgaaagctagttccagtgagaaggcaggtttctgcagccaacacatgtgatgctgtcacgctgccaggcccaataaggtctgcaaagcccttacaccattagcttagaagtgttttaattcttgatcaattttttcttccatttcaagatgtatttgtgttatttacaacatttttcacataaagggaattttattaatagttctgatgttgtattacatcttacctaatttttttcttttttctggagaaagtgtcttgttctgtctcccatgctggagtacagtagcatgatctcagctcactgcaacctccacctcccggatttaagcgattctcgtgcttcagcctcccaagtagctgggactacagacatccactaccacgcctggctaatttttgtatttttagtagagatggagtttcaccatgttggtcaggctggtctcgaactcctggcctcaagtgatttgcccgccttggtgagacaccacgcctgcccatatctaatttttaagaaaatgaaatcactgctatctaacattaatagaatcaaataataaataaataaataaaaataattaatagaatcatattaaaatggtttttataagaaagcaataataacatgttaaagtgctaacctaataacctaaaaacaatgagatatcaccttttcattcataacccatagaccagaagaatgaatttcttacggctacctcttggctcctgtgcacaccattttcccagaactgaaaatcagtgccgtggttcgtggctctcttatcctcatgattaccgcagcaaaccgctacaatggtcagagagaatcattagtgaggtcatgccaaactgctcaatgttgttaggcgaaccacccattgacaaaaaaatcacaactggtaggaaggacatagtacatctagttatcaaaatatttgttctgtatttctgtatatctgtaaaggatttgcatacaccacatgtaacaaatattcctttgcataaggagcagaaaataatcaattgtgactaagttataccaaatctgtatgttctttcacatgagcattccatcaagagaaatgtttgcaaaatttggttatgttctcaataaatacaagtgcttctgtttctactttatatttgctgcttatcatgactatagcttctctgatacattttgttttattaatatgaattttgaggcaaataaaccaataaaccttttctaccttaatggaattaataaatcagattacaagcctatcaatacgtaatgaagtaaaatcatgctttcaattggtctttagaaacaatattaatgtattaaacacataaatgcaaattaggaaaaaaacacagttttaacttttattttctgctttttatgcttgaaacatgttaattctttcagaaaattttcttgctaaggtggtaactcaaggggaaaatatttcaactgtgggttgaattaatggcctcagttattaggtacatgataaaaagcaaataattactttgaaacaacttaaatattttaatacatttaattatacaataaaaacctacatgtttctaattaagacgactctttgacaaactagattgctttaacaattttatttttttattttattaatttttttttttagagacaagagtctcactttgttgcccagactggagtgcagtggtgcaatcatggctcactgcagcctcgaattcctgagctcaagagatccttctgtcttggcctcccaagtagctgggattataggtgtgtgccaccaaccccagataattttttaaattttctgatgaaacaaggccttgctatgttgcccaggctcgtcttgaactgttggcctcaagtgatcctcccaccttggcctcccaaagtgctggaattacaggtctgagtcaccatgcctggcttttaacaattttagtttaaaacctgctctatgtcttccctgtgattttatcaacatctaaaaaagctagcagtatatagtagtttatatacgtcccaggaaaagcctagctattttgaatttccagaatttcctctactatttttattggttaaatatcacttaagaacgtaaagtaataaaattatgtattcaactaaatgtgattataatagatgaaagattaattcttagaatgctacatgtcatacagactcattatgagtggttaaaaggtgattttcagacccttagctgtctttcagatctcaggcattatgtttcagggattttaaaatgcaccctaagtccattacttaacatttctctcaacccagctaatgtttatccaaattactttgcctactatagctggctaacatcatccctatacatatacaaaattcttcacatgatcccaatacaatacatatataacttagcttattttatagactgctgtactcccagggattcttatatcacagacactcaataaaagatacaaaacaatgcacattttactttagatcttcattttattggtgtcaaggaataagcataacacaaactctttgatatacagattttttttttgaggcggagtctcgctctgttgccaggctggaatgcaatggcgcaatctccgctcactgcaacctctgcctcccaggatcaagtgattctcctgcctcagcctcccaagtagccgggattacaggcgcatgccaccactcccggcaaatttttgtatttttagtagagacggggtttcactatgttggccaggatggtcttgaactcctgacctcagatgatccgcccacctcggcctcccaaagtgctgggattacacgtgtgagccaccaagcccggccaattttttttttttttttaagagacagggtcttgccatgttgcctgggctggtggtgaactcctaggttcaagaaattctccttcctcagcctcccaaagtgctgggattacaggcattagccactgtgcctggcctgatctacagacatttgttttatagcgtgaaatacattaaaatatagagacacggcagaggagacaaaaaagaaaaaaaaaagaaatacattaaaatagatctaaccttgggattatattcggcgtttcgggcacgaagtgcaatggtctttaggtcaagtttacaaccaagattcactgtggatacaatatttctgtaagagatttaaaaagaaaacacgactatttaaattacttaagtttcattggatgaggcgttagaaattatgcagacatctgattatttcaaccaggctttacttttttttaattgctcacatttattgtttaacaagtatcatgcacatgttgagcattttatatagattattccatttaatacatataacgcactgaggtagaagttaccagtattcccacatttggataaataagctgaggcttaaaggtagagtgcaacttgctcaggacgcaatggctcccaagtggaggagccaggatttgagtctgtctgtctccagagcctgcccttagccttctcacagacaaactcaattctcatctgtgagctctgaaaagctaccaccaccaccctattcctaagtaactatttataatgaaaacaagcaggcatgaactgcccagttctctcaaagtaagtatcttttgaaaaacaagagctaagtgtctttagcaaaaaaaaaaggcaaaaccctgctttctcttctaattaactctcagtaaataaggataaatggagccatctgggtccactgacccttttcatttctcagtgttcttaaatcacttaacgaataacttatacaaggataaagatatactaaaaagcaactctattagaaattttaataaaaatttaaacaacaaacccacattttcattatacatttttctgcttatgaaagtatatatagttgaaatgggcaatgccctttgaatgcaattaactgctcaacaactgtctcgcatggacctggaaatcaccatcccaagaatatcgagtccagatttcaaatacataggttcaaatacaataggtttcagctcattgttgcttctggttctttttcttgtacagtctatgatacacaactgtaaagccaattaggttgatccacacaatgaatgttttcatttccatatcatctatttccttccaatcacccttgtatacacacctgcctttagcatttgtccacttatgaactataccaagtagattttagtatatctatcacaactttagtcacataattgttaaatgtattcttatatattttcattaattaaatatttaccttaatccctcttaagcctacaagatggagagggcactgaactaccacccgggagggttcttagtagatagtggaaattcaggaatgtggatgactggatgctctggggagtatcagaacagcaaaggcactcgcaagaaacaaacacctgactgtactgtttataatttattatttaaatcagaaatgcaaacttaaatattcctgggagtcagacaagcatgctggacacatgggagtggtatagacaagggtgagctaaaaagggctctctctaaaatcactaaaattactttgtttttaaaattgtgtgtggggtcaaacaaaattgtggaggcaagatttaggtctttgggtgaaagtcagcatccacgattacacaccacttagttccaaaaatgatgagagatagcttataaacaacaaccatatatgtaacaaggtgaataaatgcaaataggaaatactagatctaaagggagtatgaaggaggaaggtatctgtacaagaaaactgaggagatgcagagactgcaagtaaccttttaatttggtcataagctttctaaaatgaaaagctatacacttcttattgactggaattatttggaaatatttgctggtttttcaggaagatgaaattatttcctacccctactacactgttacatatagaacccacttcatttaggtagaaaaatccatttatgacaaaaacagtcgtcttcattttgtgggaaggacacagaccttcaaagatttatatgcagcacccatagtaaaaacaaaaaacaagaactaccagaaattatactgatattgtgactaaagacctaaaatagcataagggaaagagactacctaacattgtgatttagcgatatcagatacagggaaatgtctataatataataataacgacagtgaaagtcagattaaattttattggctcaggtatgtaaacacaaatgaccacatttctaaacctgttaagagccttttactgaggacactgactaagatagctttgcttccctttcccaaatgtgagataaagcaaattttgatacacaattaccgttagtgccactccctcccttaataaaaggatccatctgaaaacagagcaggaacataactcaaagggactcctaagtgggaggaaacataaaacacgaagtactcactgcagctgcggtacaatcccagaactctccgaagctggcgtggcaggagtgatgggggtcatgggagtcatgggggagggatacagtggagtggtgcccggcaagggtgcagttgtgagagtctgtgagtggaagagctgtggtgcctggcctgaggttccctgtgttgcctgctgggacgttgactgctgaacggctgcagctgccactgcctgttgctgctgctgctgctgctgctgctgctgctgctgctgctgctgctgctgctgctgctgttgctgttgctgctgctgctgctgctgctgctgttgttgttgctgctgctgcctttgttgctcttccaaaatagacagactattggtgttctgaataggctgtggggtcagtccagtgccataaggcatcattggactaaagatagggattccgggagtcatggcaccctgtggaaagcaaggagaaaaacaggttaggctggctgctgctaagtgtttgtggaactttcttggtggaacagcaggtcaggtgtgcaaagacagatgccttcggagaataatggggttattaaacattaattacggaagaaccagctattcttatacacattgctttcttctttaataccacacagtggataaacatgaagaaaaatggataaactgaacttcggaaaaattaaaaacttctgttctttgaaagacaccattgagaaaattaaaaggcaggccagactgggaaaaaaataactataatacatacatctgagaaaggactggtaaacagaataataaagagctctgacaactccataaaagaagatcaacaaataaaataataaaaaagggcaaaagatgtgaaggacatattacaaatgaagatacaggcatacctcggagatactacaggttaggttccagaccatctcaataaagcaagcggcatcaattttttggtttcccagtgcctacaaaagttatgttagcactaaagtctattaagtgtgcaatagcattatgtctaataatatgtatataacttaatttaaaaatgctttattgctaaaaatgctaacaatcatgtgagcctgcagcaaatcataatctttttgctgacagaggatcttgcctcgatgttgatggctgctgactgatcagggtggtagctgtggcaatttcttaaaataagactgacgaagtttgccacactgactgactcttcctttcactgaagatgtctctgtagcatatgatactatttgacagcattttacccacactagaacttatttcaaaattggagtcaatcctctcaaaccctgctgctgctttatcaactaagtttatgtaatattctaaagtcatcagttcttcaccaggagtcaattctatctcaagaaaccactttctttgcttactcacaagaagcaactcctcatctgttcaggttttatcaaaaaattgcagcaattcagtcacatcttcaggttcacttctaattctagttcacttgctatttccactacacctgcagtaacttccagcactgaagtctagaacctctcaaagtcatccacgagggttggaatcaacctcttccaaactcttattcatgttgatatttcaccctcctcccatgaatcatgaacattcttaatggcatctagaatggtgaatctttttcagaaggttttcaattcactttgcccagattcatcagaggaatcactatctatggcagctacagcatatgtccctccctgcttcctttctttgagacagggtctccattgtagcctttaacttctggactcaagtgaccctcccgcctcagcctcccaagtagctgggactacaggcacatgccaccatgaccagctaattaaaaaaaaatttttttttgtagcaacagggacttgttttgttacccaggttggtcttgagctcctagctttgagtgatccttccaccttggcctcccaaagtactgagattacaagcatgagccaccatgccctgctgtatttcttaaatagtaagaattgaaagttgaaattactccttgatccatgggctgaagaatggatatattatttaagcaggcatgaaaacaatattaatctccttgttcttctccatcagagcttgtggacaactagttacactgtcagtgagtaatattttgaaattaaactttttttctgagcagatctcaaagagcttaaaatatccagtaaatcatgctgtaaacagacgtgctctcatcaggttttgttgttctgtttactgaggacaggcagagtagatttagcgtaattcttaaggctctatggttttagagcagaacatgagcattggcttcaatttaaactcaccagctctattagcccctaactagtcagccagtcctctgaagctttgaggctaggcactgatttctcctctctagctataaaagtcctagatagcatcttcttccagtagaaggctgtttcatctacattaaaaatctattatttagtatagtcaccttcatcaattatctcagctagatcttccagataacttgctgcttcatgttgcatttttatgttgtggagaaggcctctctccttaaagctctgaataaacctctgctagtttcaaaactttcttctacagcttcctctccgctctcagcctttacagaattgaagagagttaaggccttgctctgtattacactttggcttaaggggatgtgtgggtggtatgatcttctatccagaccattcaaactttctccatataagcaataaggctgttttgctttcttatcacttgtgggtttactggagtagcacttctaatttcctttaagaacttttcccttgcattcacaacttggctaactatttggtgcaagaggcctagcttttagcctgtctcagctttcaacatgccttcttcactaagtataatcatttatagcttttggtttcaaatgagagatgtgcagctcttcccttcatctgaacacttaattaaaagtcactgtaaggttattaattagcctaatttccatattgttgtgtctcaaggaatagggaagaccaagcagagggagagagatgggggaatggttggtcacgctgcagacatttatcaattaagttcctgtattatacaggtgcagtttatggcattcaataataattacaatagtaacatcaaagatcactgatcacaataacagataataatgaaaaggtttgactaggcacagtggctcatgcctgtaatcccaacactttgggaggccaaggcggatggatcacttgcagccagtagtttgacaccagcatggtgaaactccgtctccactaaaaatacaaaatttagctgggtgtggtggcgcatgcctgtaatcccagctacttgggaggctgaggcaggagaatcgcttgaacacgggagatggagtttgcagtgagccaagactgcaccactgcactccagcctgggcaacagagtgactgaaaaaaaaaattaaaaaaaaaatacaaaaaaaaagaaaaaaaaaagtttgataacaataacggataataatgaaaaagtttgaaatcctgcaaaaattaccaaaatctaaccccaagacatgaagtgagtacacacttttggaaaaataatgccaacagacttgctgggtacaggtttaccacaaccttcaatttgtcaaacatgcagtaaagtgaagtgcagtaaagtgaggtgggcctgtgtatgagtggctgacaagcacttgccaaggtgctcagaaacattagtaatcaggcaaataaaaatcaaaaccacaataagatactactaagcaatcactagagtgaaagtaaaaagactgacagcagaaagtgttggtgaggatgtggagcaacttaaatctcttatgctgcaaaacaatacagccacttcaaaaaacagtttggcagtttcttataaagttatacatataccaatataggacctagcaatcctactcctaagtatttacccatgagaagtaaaaacagtgcattcaaagtctacacaaatgtttacagtgcttttattcgcaatagctccaaactggaaagaccccaaatgtgagcaactggagaatggatgaactgtggaacatccaaacaatggagtgatacttagctatacaatggattaactactgatatacaaacagtacactgggctaagaagtcagacatacacaaaaaagcatacactctgattccatctatatgaaattctagaatagacaaaactaatcttcagcattgaaaagcagatgcagtagttacctggggccagcagagtgactataaaggggaagaagggactttttaaggtaactgaaatgttctgtaatttatacattatatataattatcaaaacagacacttaaaatgagtttttttgtatgtatatttcaacaaaagttattgatttttttttttttttttttttttttgagacagagtctcgctctgtctcccaggctggagtgcagtggcacgacctctgctcactgcaacctccacctcccgggttcaagcaattctccttgcctcagcctcccgagtagctgggattacaggcacccgccacaacacctggctaatttttgtatattttgtagagatgaggtttcaccacgttggccaggctggtctcgaactcctgacctcaggtgatccgcccaccttggcctcccaaagtgctgggattacaggcgtgagccactgcacccaggctgaaaaatttttaaagtagatgggtggttgagagcttgaaatgtaaaaggggaaaaataaaactagaaaataatttggtgagggtgattttcaaaatcaaagaccctatatagtcatttggaacattctcataagtgtttatcaaaagattaggtgtttcataaatatataacttagcttccagacttcccaaataaacaccattgtgcctattcaaagcctaatagaacttctcaacaaaataaggcttaaaaaacatattaaaccattttcaaaaacagatcattaaatgcccttccttgccttttgataccatctcttgcagttcagatttccgccctccctattctctccctcctgctatattacctgaggggaggccaagccctgagcgtaaggtggcaggctgttgttctgatccatgatgttcactttcttcttggcaaaccagaaacccttgcgctggaactcgtctcactattcaattttttcctagagcatctccagcacactcttctcagcaacttcctcaattccttgggttatcttcacacgccaagaaacagtgatgctgctttggaaaaaagtctaaagtttaatttaaggatccaggtaacctgtacagtcctataagccagttctatggctatacaaaacacaaacatgaaaaccaatgaagctattttggaatacatttgtttttaccttataatcctaaagttttattccttccatgtttccggcgattgcatgtaaaatcgccaacaaaacaaaaatcattttgttacatgtttaaataatcggaaaatgctcaaaatcgagctgtcataaccagcattaaaaacttttgaggaaaaacacctagagaaaaataattcctaagcaaaatgtaatatcagagcagaatattcactaagcactgtatacacagcactgttaggcaaagtttagatctttaaatattccaattttacatcctctacaatgtcttgggcaaaaaattaagtaaatatcaaattcaatccaatatacttcagagtgatcatttatcaagctcctactgtaatgaaactgttaaaaaaaaaaaagccgcacaaagataaagccctgaatttttataaatgtaataaccttacctctttagaacacattaatgcaaactgtgcctgttatctgacttttcttaaatcatcatcgctttactcactacacatctgaaatgagtttataacaacatattctcacatagaacttagaggtctcaaagttacaaattatatgtccaaagatccttcaggcatatgcacttcaagcatgtgctggtacagaacagacactcagatatttgctgaatgtatgaaagactctgacgatcactttgaaagggcaaaggcccccaaagactatctatcctacatactcatcactgaaaaacagaccaaaaaagaaagcaagctctgcttctggaaataaatatatcagagatattttttaaaatatactttttttttgacagttatcctataataacaataacagaagtcctgcagatgaggatataaagataggaggatatagtccttggcatcaaagtgttcaatatgaagggtatgcaaataactactgtaaaacatagtattataacagcaggtatggtctaagctaagttccttgaatgcagaaaccagcctacatgtctttgtgatctctgcatctagcactatgcctggaatacagtatgtgatcatgaatgagcccatatacacccctggaagagaagacaatatagactaacagccaatcactgtgaagagagcgcagtgttttcacaaagcagggaccatctaacttgggtctcacaaggtgagtaggaatttacacatcagggcttcagacaaaagagaaatcaagcagaaagagacagattgaaaaagcatgcagtatgcaggcaacaagcttagtatgactgtatagaaggtcactgcagcagatgagacagcacatattggtgggctcatactatcaggagttttcaatgttattgcataggcaataataacagttatggaatttcggaagtgcagtatgaacagatctaatttggcaagactagatgaatttgagaggagtaaaactggaggacggaagtttcgtttcaggaatctaaggttgaggcaagagataatgacggcaggatttaaagccattataagtatgattagagatttatccaggaccttcggtggcttcaggccactttttgcaagtaagtctacagaagaaaccgcacagtgattactgcactaatttatcctcagaaaagagttgtttgctgggtatcttcatctcctggaaattgaaacatcaaatccgatattttttggaggcaatcaaattaattctgcatagccttctagtgtctgtataactaaatgaagcacagtcttttcacagaaaagtctacctagagatttggaaaaccatgatggcctgaaccgagagacgggagaccctgcaaataaagtggtgtgtattatatcttaagcgctaccgtgcccgctgtctcaggcttctgacaaaatatttaagtctcaatgttggcagcaaaacaggcgggcacagatctgggtgaatctgcttctaacatggagaagaagcggatggcaggacagggcagggtaaacttagggtcttcgatgcaagggactgtcctgtcccgcctgccgccgcccagccagccagtagtaccctgagccccacaatcgtacgatgggaagctgcctgcgaaacacagcagagtagggcaccaggcgggagtggcggccgagtggccgttacaggccggaacggcggcagcacgaaagggaggaacgtcccccgaggggcctgcacgcgcgccaattcctagtctcttccccaccattgcccccaggcctcagtgcagtggtggccttcgcccgaaccgtcagaaaagagtacaatctgttacctgggtcactgcaaagatcactatgggccagcggaagcgaagttaaacagccggcggcccaggcgcccgccacagcgaacctgcccgacctcac

SEQ ID NO: 6578 - DNA, 18495 bp, Homo sapiens
ctaacacttttataaactgcatttattgtacagagtactctgaagaaagaaaaaaatatgtacagccattcattttcattaacacatatattctgtcctgcaatactggagaggtggaatgtgtctggcacagaaataacccctaggagttataaattagaaaaacaacacttttaaaaaagatttttacttttctggtagaaatataaaaactgtggttcatggggaaaaacattaaaattaaaaagtccaatcaattatagaggtggctttaacacttaaagttttctccctcaaaccaacttgtcaacagcagtgtttaaaatctacatataaataaatgggcagcgctgcccagatagcagcacggtatgagcaactcacagtcacgctgcgcggtgttctcagtgcacaaataatgccccttcccggcatcccgcggtgggcacttacagaagggcatcacctggtgccacaccctgcaactcaacatccatcttctcacaacaccaccatttaaaggtaccaaaacaaactgatttgtttaaaaaaaaaaaaagaagggggtgggggaggcaagggtacatgagagccattacgtcgtcttcctgaatccctttagaatagggtagatgttttcaaatgcttcataaatttctgctctgactttagcacctaagaagacaagttggagtagagatgagagactgaaatggcacttcttaacatattaagatggtaaaattcttaccttaaagctgcaagcacaattctcaccatacccagtcagattaaggcacaggcatgaaaacattaatggtggaatcccttgtcacaatcttatttttgtttataaaacaatacttttaaaaaatcatcttagtgactccagcgtctcattctatagctcaagaggcatgtattcacacttctctccttggtcctgaaccaggccataaaccaagcaggacggcaatgataacaactgaatcttcttctctgaattgctgccttcaactagactcatttctgaatcttcctttcttgtctcataatcatattgctgaggaatcctaaagcttcagataactaattccaagtgaaaacgccatcttttgttcaatgcaatgctcacctcctcactgtaaatggaagtctgcttgcagagctgtggtcagacttccctgctctcactgtgcctttagtgggcacgtttctcatcagactttgggtgggaggcctttgtacaagaagctagcccactgtccgaacactgaaatttcttttcagcactgagaaaatgccatactcaaaacacttacaaactttcagatactacttcctgttacaacttacctgttaatacaacttttccagaaacaaaaataaggagaacaattctgggtttgatcattctgtagattaaaccaggaaataactctggctcataactagaaggaaaattgcaaaaagtttagaaatcaagagctttgtgtgcttttagataaaatgaggacctgtacaaggaaaaatactgaataaacaaactagtcaagaggtaaaacacagttcttcaagcagcatcaaaggatagaatagaataattaaagcaagtgaggccgacttgtagtcgtcagttgataaccactggatggaaggctatttgtcctcctatcactttaccctatttctattgaatctggattttctgatttaagaaaaagagccctgtagttatgtctgcagtctctatatcattagatataatgatatctaatgcagataataatcctttacttttacagtcctaataattactattacagtcctaataatcatttacttctaagatccaatactgacagtttaacttttaatcatatcttacctccttaaattgaaatattctctagctgacaattgtggtcaggaaatttaatcaaacttatatactagcctgagaattaacctatacctgattaagctgtctgactgaatggactattggtatatattctttttttttttgagacggagtcttgctgtgtcgcccaggctggagtacagtggcacgatcttggctcactgcaacctccatctcctgggttcgaatgattgtcctgcctcagcctcccatgtaactgggattacaggcatgcaccaccatgtccagctaatttttgtatttttagtaaagacgaggtttcaccatgttggccaggctggtcttgaactcctgaactcaactgatctgcctgcctcggcctcccaaaatgctgggattacaggtgtgagccaccaggccaggcctggtacatattcttctaagcctagtaatctcatttttctcagttcggagagactgaaaacaggatgcctctgtttctgtgtgtctgacctaagacaaaattcaggacaggcttctctgaggaagagtggaatgggtagacatatggaactcaagtgggagcttcctaggtgaaaagggaaatgagcatactaggcataaaagtggcaagtgcaaaggcctagggcaggaggaaccaagtgagccccaggggcacacagaactaatgtgcctgtgaacagacaccagaagaccatgagatgaagcagtgaggtgggcagggctgcctgcctgtgagtcttcacctgcaagtagcagggaagataattagaaagttgttcctatcgctcaacttcacactttgctggtagatctgacacaatgttgactaaaagagaagatccaaactgggaaaaaaaattgatacaagaggttagggtcaattcatgcattccaagtgtattcagcaataaaacgataaaacatacagaagtagaatcaaattcattccagtaaaggggagttatgggtaccgcaaagtgataagggaagcagaggctggtgagggtgataaatatgactgagaacatcaggaagacaatgcaagaatacatacaactataaccatgtcaactgttctcatatactgaatattttgcatgtgttttattctgaacaatgtttagattataaatgaactgttgccaataacaatcataatacatttcagacttacctactaaattgttggtgggtgagcacaaggccttctaaccttataggaaacttcacatcacagctccccaccatgttctgaatcttgaagtccaagaacttagctggaaaacccaacttctgtacaactctagcatattttcttgctgccagtctggactgttcttcactagggaaaggaaaaaagtgagttattcatactcagagccagctaaaatacttatttagactaataacttataaaaagtccaaaacagtaaactaataaagtgtaaactggtcagccttcttgcaataggagaaaagactgacaggcattcacaattccttataaagtattcctggatccttgacagaaaactgtaggcctgccaaaatgacctttcaatccgccaaattattgtagccctagattttatggatgtgaattatcaccatcatcaatcatcactatttctgtattttagcccatgcatttctactgagaggaaaactaacaaacttcattttgatcagaaaatgttgatgagatttattattgaacaatgtattcactaattctatcctcttttataccaagactcatcatgaatagacattcctatgtcatttgttgaataaactacgacttagcagttcagagcttacataagaaaagcagaatgtgggccaggcatggtggctcacgcctctaatcccaagcactttgggaggccaaggcggatagctcacctgaggtcaagagttcgagaccagcttggtcaacatggtgaaaccctatctctactaaaaatacaaaaattagctgggcatggtgccaggcacctgcaatcccagctacttgggaggctgaggcaggagaatcacttgaacctgggaggtggaggttgcagtgagccaagattgtgccactgcactccagcctaggtgactccaccaaaaaaaaaaaaaaaaaaaaaaaaaaagaaaagaaaagaaagaaagaaagaagagaaaaaaagaaaaaataaaagagaaaaaggcaggcaggcaggcaggtcgggcacggtggctcacacctgtaatcccaacactttgggaggctgaggcaggcggatcatgaggtcaggagattgagaccatcctggctaacatagtgaaaccccatctctactaaaaatacaaaaattagccaggcatggtggtgggcacctgtagtctcagctactcgggaggctgaggcaagagaatggcgtgaacccaggaggcggagcttgcagtgagccgagatcatgccactgcactccagcctgggcgcagagcgagactccatctcaaaaacaacaacaacaaaaaagaatgtgaaaatattaccataaagagactatcaggtgcaggggatcaggaagaacaaaaatcaagcatatatatatatgctacgcttttaaatctcaggtaaatgtattggtggtttcttgtcttgatgaaatagtcatccaactagatatacaatattcagttttcagatgctctgggacaaaaaggctaaatgctgcatgaaaagcttgccttgataaaccaaaagtttctgatgttccatgcaggggaaaacaagcaaacaaaaacgctcttaattaaagaggttactactgcatgttgtggccaaggggaagtgaaaggcaagaacacatccttgtcctgcattctgaaaaacctcggagatcaggagccagaatgtccacaccaatggcattcccatcactgaaagacaatttcaaacttcagaataagcaaaaatatccacagcccccttctatgtgttgatacctccaagtacatttaatactctttcatttaaaaagttttagtttatttgttcagttcatttatgaagctaatgtcactaattttccccctagtttttgacttctaccaagtatataagctctgtttagaacagtcagggccgcagagtactaaccttcagacaggatcacttcagatggagaatataggcaatgacattttataacaagggtgcattccttaagatctgcacaactcaaacactattaatgaaagctagttccagtgagaaggcaggtttctgcagccaacacatgtgatgctgtcacgctgccaggcccaataaggtctgcaaagcccttacaccattagcttagaagtgttttaattcttgatcaattttttcttccatttcaagatgtatttgtgttatttacaacatttttcacataaagggaattttattaatagttctgatgttgtattacatcttacctaatttttttcttttttctggagaaagtgtcttgttctgtctcccatgctggagtacagtagcatgatctcagctcactgcaacctccacctcccggatttaagcgattctcgtgcttcagcctcccaagtagctgggactacagacatccactaccacgcctggctaatttttgtatttttagtagagatggagtttcaccatgttggtcaggctggtctcgaactcctggcctcaagtgatttgcccgccttggtgagacaccacgcctgcccatatctaatttttaagaaaatgaaatcactgctatctaacattaatagaatcaaataataaataaataaataaaaataattaatagaatcatattaaaatggtttttataagaaagcaataataacatgttaaagtgctaacctaataacctaaaaacaatgagatatcaccttttcattcataacccatagaccagaagaatgaatttcttacggctacctcttggctcctgtgcacaccattttcccagaactgaaaatcagtgccgtggttcgtggctctcttatcctcatgattaccgcagcaaaccgctacaatggtcagagagaatcattagtgaggtcatgccaaactgctcaatgttgttaggcgaaccacccattgacaaaaaaatcacaactggtaggaaggacatagtacatctagttatcaaaatatttgttctgtatttctgtatatctgtaaaggatttgcatacaccacatgtaacaaatattcctttgcataaggagcagaaaataatcaattgtgactaagttataccaaatctgtatgttctttcacatgagcattccatcaagagaaatgtttgcaaaatttggttatgttctcaataaatacaagtgcttctgtttctactttatatttgctgcttatcatgactatagcttctctaatgatacattttgttttattaatatgaattttgaggcaaataaaccaataaaccttttctaccttaatggaattaataaatcagattacaagcctatcaatacgtaatgaagtaaaatcatgctttcaattggtctttagaaacaatattaatgtattaaacacataaatgcaaattaggaaaaaaacacagttttaacttttattttctgctttttatgcttgaaacatgttaattctttcagaaaattttcttgctaaggtggtaactcaaggggaaaatatttcaactgtgggttgaattaatggcctcagttattaggtacatgataaaaagcaaataattactttgaaacaacttaaatattttaatacatttaattatacaataaaaacctacatgtttctaattaagacgactctttgacaaactagattgctttaacaattttatttttttattttattaatttttttttttagagacaagagtctcactttgttgcccagactggagtgcagtggtgcaatcatggctcactgcagcctcgaattcctgagctcaagagatccttctgtcttggcctcccaagtagctgggattataggtgtgtgccaccaaccccagataattttttaaattttctgatgaaacaaggccttgctatgttgcccaggctcgtcttgaactgttggcctcaagcgatcctcccaccttggcctcccaaagtgctggaattacaggtctgagtcaccatgcctggcttttaacaattttagtttaaaacctgctctatgtcttccctgtgattttatcaacatctaaaaaagctagcagtatatagtagtttatatacgtcccaggaaaagcctagctattttgaatttccagaatttcctctactatttttattggttaaatatcacttaagatcgtaaagtaataaaattatgtattcaactaaatgtgattataatagatgaaagattaattcttagaatgctacatgtcatacagactcattatgagtggttaaaaggtgattttcagacccttagctgtctttcagatctcaggcattatgtttcagggattttaaaatgcaccctaagtccattacttaacatttctctcaacccagctaatgtttatccaaattactttgcctactatagctggctaacatcatccctatacatatacaaaattcttcacatgatcccaatacaatacatatataacttagcttattttatagactgctgtactcccagggattcttatatcacagacactcaataaaagatacaaaacaatgcacattttactttagatcttcattttattggtgtcaaggaataagcataacacaaactctttgatatacagattttttttttgaggcggagtctcgctctgttgccaggctggaatgcaatggcgcaatctccgctcactgcaacctctgcctcccaggatcaagtgattctcctgcctcagcctcccaggcgcatgccaccactcccggcaaatttttgtatttttagtagagacggggtttcactatgttggccaggatggtcttgaactcctgacctcagatgatccgcccacctcggcctcccaaagtgctgggattacacgtgtgagccaccaagcccggccaattttttttttttttttaagagacagggtcttgccatgttgcctgggctggtggtgaactcctaggttcaagaaattctccttcctcagcctcccaaagtgctgggattacaggcattagccactgtgcctggcctgatctacagacatttgttttatagcgtgaaatacattaaaatatagagacacggcagaggagacaaaaaagaaaaaaaaaagaaatacattaaaatagatctaaccttgggattatattcggcgtttcgggcacgaagtgcaatggtctttaggtcaagtttacaaccaagattcactgtggatacaatatttctgtaagagatttaaaaagaaaacacgactatttaaattacttaagtttcattggatgaggcgttagaaattatgcagacatctgattatttcaaccaggctttacttttttttaattgctcacatttattgtttaacaagtatcatgcacatgttgagcattttatatagattattccatttaatacatataacgcactgaggtagaagttaccagtattcccacatttggataaataagctgaggcttaaaggtagagtgcaacttgctcaggacgcaatggctcccaagtggaggagccaggatttgagtctgtctgtctccagagcctgcccttagccttctcacagacaaactcaattctcatctgtgagctctgaaaagctaccaccaccaccctattcctaagtaactatttataatgaaaacaagcaggcatgaactgcccagttctctcaaagtaagtatcttttgaaaaacaagagctaagtgtctttagcaaaaaaaaaaggcaaaaccctgctttctcttctaattaactctcagtaaataaggataaatggagccatctgggtccactgacccttttcatttctcagtgttcttaaatcacttaacgaataacttatacaaggataaagatatactaaaaagcaactctattagaaattttaataaaaatttaaacaacaaacccacattttcattatacatttttctgcttatgaaagtatatatagttgaaatgggcaatgccctttgaatgcaattaactgctcaacaactgtctcgcatggacctggaaatcaccatcccaagaatatcgagtccagatttcaaatacataggttcaaatacaataggtttcagctcattgttgcttctggttctttttcttgtacagtctatgatacacaactgtaaagccaattaggttgatccacacaatgaatgttttcatttccatatcatctatttccttccaatcacccttgtatacacacctgcctttagcatttgtccacttatgaactataccaagtagattttagtatatctatcacaactttagtcacataattgttaaatgtattcttatatattttcattaattaaatatttaccttaatccctcttaagcctacaagatggagagggcactgaactaccacccgggagggttcttagtagatagtggaaattcaggaatgtggatgactggatgctctggggagtatcagaacagcaaaggcactcgcaagaaacaaacacctgactgtactgtttataatttattatttaaatcagaaatgcaaacttaaatattcctgggagtcagacaagcatgctggacacatgggagtggtatagacaagggtgagctaaaaagggctctctctaaaatcactaaaattactttgtttttaaaattgtgtgtggggtcaaacaaaattgtggaggcaagatttaggtctttgggtgaaagtcagcatccacgattacacaccacttagttccaaaaatgatgagagatagcttataaacaacaaccatatatgtaacaaggtgaataaatgcaaataggaaatactagatctaaagggagtatgaaggaggaaggtatctgtacaagaaaactgaggagatgcagagactgcaagtaaccttttaatttggtcataagctttctaaaatgaaaagctatacacttcttattgactggaattatttggaaatatttgctggtttttcaggaagatgaaattatttcctacccctactacactgttacatatagaacccacttcatttaggtagaaaaatccatttatgacaaaaacagtcgtcttcattttgtgggaaggacacagaccttcaaagatttatatgcagcacccatagtaaaaacaaaaaacaagaactaccagaaattatactgatattgtgactaaagacctaaaatagcataagggaaagagactacctaacattgtgatttagcgatatcagatacagggaaatgtctataatataataacaacgacagtgaaagtcagattaaattttattggctcaggtatgtaaacacaaatgaccacatttctaaacctgttaagagccttttactgaggacactgactaagatagctttgcttccctttcccaaatgtgagataaagcaaattttgatacacaattaccgttagtgccactccctcccttaataaaaggatccatctgaaaacagagcaggaacataactcaaagggactcctaagtgggaggaaacataaaacacgaagtactcactgcagctgcggtacaatcccagaactctccgaagctggcgtggcaggagtgatgggggtcatgggagtcatgggggagggatacagtggagtggtgcccggcaagggtgcagttgtgagagtctgtgagtggaagagctgtggtgcctggcctgaggttccctgtgttgcctgctgggacgttgactgctgaacggctgcagctgccactgcctgttgctgctgctgctgctgctgctgctgctgctgctgctgctgctgttgctgctgctgctgctgctgctgctgctgctgctgttgttgttgctgctgctgcctttgttgctcttccaaaatagacagactattggtgttctgaataggctgtggggtcagtccagtgccataaggcatcattggactaaagatagggattccgggagtcatggcaccctgtggaaagcaaggagaaaaacaggttaggctggctgctgctaagtgtttgtggaactttcttggtggaacagcaggtcaggtgtgcaaagacagatgccttcggagaataatggggttattaaacattaattacggaagaaccagctattcttatacacattgctttcttctttaataccacacagtggataaacatgaagaaaaatggataaactgaacttcggaaaaattaaaaacttctgttctttgaaagacaccattgagaaaattaaaaggcaggccagactgggaaaaaaatacctataatacatacatctgagaaaggactggtaaacagaataataaagagctctgacaactccataaaagaagatcaacaaataaaataataaaaaagggcaaaagatgtgaaggacatattacaaatgaagatacaggcatacctcggagatactacaggttaggttccagaccatctcaataaagcaagcggcatgaattttttggtttcccagtgcctacaaaagttatgttagcactaaagtctattaagtgtgcaatagcattatgtctaataatatgtatataacttaatttaaaaatgctttattgctaaaaatgctaacaatcatgtgagcctgcagcaaatcataatctttttgctgacagaggatcttgcctcgatgttgatggctgctgactgatcagggtggtagctgtggcaatttcttaaaataagactgacgaagtttgccacactgactgactcttcctttcactgaagatgtctctgtagcatatgatactatttgacagcattttacccacactagaacttatttcaaaattggagtcaatcctctcaaaccctgctgctgctttatcaactaagtttatgtaatattctaaagtcatcagttcttcaccaggagtcaattctatctcaagaaaccactttctttgcttactcacaagaagcaactcctcatctgttcaggttttatcaaaaaattgcagcaattcagtcacatcttcaggttcacttctaattctagttcatttgctatttccactacacctgcagtaacttccagcactgaagtctagaacctctcaaagtcatccacgagggttggaatcaacctcttccaaactcttattcatgttgatatttcaccctcctcccatgaatcatgaacattcttaatggcatctagaatggtgaatctttttcagaaggttttcaattcactttgcccagattcatcagaggaatcactatctatggcagctacagcatatgtccctccctgcttcctttctttgagacagggtctccattgtagcctttaacttctggactcaagtgaccctcccgcctcagcctcccaagtagctgggactacaggcacatgccaccatgaccagctaattaaaaaaaattttttttttgtagcaacagggacttgttttgttacccaggttggtcttgagctcctagctttgagtgatccttccaccttggcctcccagtgagattacaagcatgagccaccatgccctgctgtatttcttaaatagtaagaattgaaagttgaaattactccttgatccatgggctgaagaatggatatattatttaagcaggcatgaaaacaatattaatctccttgttcttctccatcagagcttgtggacaactagttacactgtcagtgagtaatattttgaaattaaactttttttctgagcagatctcaaagagcttaaaatatccagtaaatcatgctgtaaacagacgtgctctcatcaggttttgttgttctgtttactgaggacaggcagagtagatttagcgtaattcttaaggctctatggttttagagcagaacatgagcattggcttcaatttaaactcaccagctctattagcccctaactagtcagccagtcctctgaagctttgaggctaggcactgatttctcctctctagctataaaagtcctagatagcatcttcttccagtagaaggctgtttcatctacattaaaaatctattatttagtatagtcaccttcatcaattatctcagctagatcttccagataacttgctgcttcatgttgcatttttatgttgtggagaaggcctctctccttaaagctctgaataaacctctgctagtttcaaaactttcttctacagcttcctctccgctctcagcctttacagaattgaagagagttaaggccttgctctgtattacactttggcttaaggggatgtgtgggtggtatgatcttctatccagaccattcaaactttctccatataagcaataaggctgttttgctttcttatcacttgtgggtttactggagtagcacttctaatttcctttaagaacttttcccttgcattcacaacttggctaactatttggtgcaagaggcctagcttttagcctgtctcagctttcaacatgccttcttcactaagtataatcatttatagcttttggtttcaaatgagagatgtgcagctcttcccttcatctgaacacttaattaaaagtcactgtaaggttattaattagcctaatttccatattgttgtgtctcaaggaatagggaagaccaagcagagggagagagatgggggaatggttggtcacgctgcagacatttatcaattaagttcctgtattatacaggtgcagtttatggcattcaataataattacaatagtaacatcaaagatcactgatcacaataacagataataatgaaaaggtttgactaggcacagtggctcatgcctgtaatcccaacactttgggaggccaaggcggatggatcacttgcagccagtagtttgacaccagcatggtgaaactccgtctccactaaaaatacaaaatttagctgggtgtggtggcgcatgcctgtaatcccagctacttgggaggctgaggcaggagaatcgcttgaacacgggagatggaggttgcagtgagccaagactgcaccactgcactccagcctgggcaacagagtgactgaaaaaaaaaattaaaaaaaaaatacaaaaaaaaagaaaaaaaaaagtttgataacaataacggataataatgaaaaagtttgaaatcctgcaaaaattaccaaaatctaaccccaagacatgaagtgagtacacacttttggaaaaataatgccaacagacttgctgggtacaggtttaccacaaccttcaatttgtcaaacatgcagtaaagtgaagtgcagtaaagtgaagtgggcctgtgtatgagtggctgacaagcacttgccaaggtgctcagaaacattagtaatcaggcaaataaaaatcaaaaccacaataagatactactaagcaatcactagagtgaaagtaaaaagactgacagcagaaagtgttggtgaggatgtggagcaacttaaatctcttatgctgcaaaacaatacagccacttcaaaaaacagtttggcagtttcttataaagttatacatataccaatataggacctagcaatcctactcctaagtatttacccatgagaagtaaaaacagtgcattcaaagtctacacatatgtttacagtgcttttattcgcaatagctccaaactggaaagaccccaaatgtgagcaactggagaatggatgaactgtggaacatccaaacaatggagtgatacttagctatacaatggattaactactgatatacaaacagtatactgggctaagaagtcagacatacacaaaaaagcatacactctgattccatctatatgaaattctagaatagacaaaactaatcttcagcattgaaaagcagatgcagtagttacctggggccagcagagtgactataaaggggaagaagggactttttaaggtaactgaaatgttctgtaatttatacattatatataattatcaaaacagacacttaaaatgagtttttttgtatgtatatttcaacaaaagttattgatttttttttttttttttttttttttttgagacagagtctcgctctgtctcccaggctggagtgcagtggcacgacctctgctcactgcaacctccacctcccgggttcaagcaattctccttgcctcagcctcccgagtagctgggattacaggcacccgccacaacacctggctaatttttgtatattttgtagagatgaggtttcaccacgttggccaggctggtctcgaactcctgacctcaggtgatccgcccaccttggcctcccaaagtgctgggattacaggcgtgagccactgcacccaggctgaaaaatttttaaagtagatgggtggttgagagcttgaaatgtaaaaggggaaaaataaaactagaaaataatttggtgagggtgattttcaaaatcaaagaccctatatagtcatttggaacattctcataagtgtttatcaaaagattaggtgtttcataaatatataacttagcttccagacttcccaaataaacaccattgtgcctattcaaagcctaatagaacttctcaacaaaataaggcttaaaaaacatattaaaccattttcaaaaacagatcattaaatgcccttccttgccttttgataccatctcttgcagttcagatttccgccctccctattctctccctcctgctatattacctgaggggaggccaagccctgagcgtaaggtggcaggctgttgttctgatccatgatgttcactttcttcttggcaaaccagaaacccttgcgctggaactcgtctcactattcaattttttcctagagcatctccagcacactcttctcagcaacttcctcaattccttgggttatcttcacacgccaagaaacagtgatgctgctttggaaaaaagtctaaagtttaatttaaggatccaggtaacctgtacagtcctataagccagttctatggctatacaaaacacaaacatgaaaaccaatgaagctattttggaatacatttgtttttaccttataatcctaaagttttattccttccatgtttccggcgattgcatgtaaaatcgccaacaaaacaaaaatcattttgttacatgtttaaataatcggaaaatgctcaaaatcgagctgtcataaccagcattaaaaacttttgaggaaaaacacctagagaaaaataattcctaagcaaaatgtaatatcagagcagaatattcactaagcactgtatacacagcactgttaggcaaagtttagatctttaaatattccaattttacatcctctacaatgtcttgggcaaaaaattaagtaaatatcaaattcaatccaatatacttcagagtgatcatttatcaagctcctactgtaatgaaactgtaaaaaaaaaaagccgcacaaagataaagccctgaatttttataaatgtaataaccttacctctttagaacacattaatgcaaactgtgcctgttatctgacttttcttaaatcatcatcgctttactcactacacatctgaaatgagtttataacaacatattctcacatagaacttagaggtctcaaagttacaaattatatgtccaaagatccttcaggcatatgcacttcaagcatgtgctggtacagaacagacactcagatatttgctgaatgtatgaaagactctgacgatcactttgaaagggcaaatgcccccaaagactatctatcctacatactcatcactgaaaaacagaccaaaaaagaaagcaagctctgcttctggaaataaatatatcagagatattttttaaaatatactttttttttgacagttatcctataataacaataacagaagtcctgcagatgaggatataaagataggaggatatagtccttggcatcaaagtgttcaatatgaagggtatgcaaataactactgtaaaacatagtattataacagcaggtatggtctaagctaagttccttgaatgcagaaaccagcctacatgtctttgtgatctctgcatctagcactatgcctggaatacagtatgtgatcatgaatgagcccatatacacccctggaagagaagacaatatagactaacagccaatcactgtgaagagagcgcagtgttttcacaaagcagggaccatctaacttgggtctcacaaggtgagtaggaatttacacatcagggcttcagacaaaagagaaatcaagcagaaagagacagattgaaaaagcatgcagtatgcaggcgacaagcttagtatgactgtatagaaggtcactgcagcagatgagacagcacatattggtgggctcatactatcaggagttttcaatgttattgcataggcaataataacagttatggaattttggaagtgcagtatgaacagatctaatttggcaagactagatgaatttgagaggagtaaaactggaggacggaagtttcgtttcaggaatctaaggttgaggcaagagataatgacggcaggatttaaagccattataagtatgattagagatttatccaggaccttcggtggcttcaggccactttttgcaagtaagtctacagaagaaaccgcacagtgattactgcactaatttatcctcagaaaagagttgtttgctgggtatcttcatctcctggaaattgaaacatcaaatccgatattttttggaggcaatcaaattaattctgcatagccttctagtgtctgtataactaaatgaagcacagtcttttcacagaaaagtctacctagagatttggaaaaccatgatggcctgaaccgagagacgggagaccctgcaaataaagtggtgtgtattatatcttaagcgctaccgtgcccgctgtctcaggcttctgacaaaatatttaagtctcaatgttggcagcaaaacaggcgggcacagatctgggtgaatctgcttctaacatggagaagaagcggatggcaggacagggcagggtaaacttagggtcttcgatgcaagggactgtcctgtcccgcctgccgccgcccagccagccagtagtaccctgagccccacaatcgtacgatgggaagctgcctgcgaaacacagcagagtagggcaccaggcgggagtggcggccgagtggccgttacaggccggaacggcggcagcacgaaagggaggaacgtcccccgaggggcctgcacgcgcgccaattcctagtctcttccccaccattgcccccaggcctcagtgcagtggtggccttcgcccgaaccgtcagaaaagagtacaatctgttacctgggtcactgcaaagatcactatgggccagcggaagcgaagttaaacagccggcggcccaggcgcccgccacagcgaacctgcccgacctcactgaacccctggcgcgcgttgataatgt

SEQ ID NO: 6579 - DNA, 426 bp, Homo sapiens; identical to SEQ ID NO: 6576

SEQ ID NO: 6580 - DNA, 127 bp, Homo sapiens
tgaggcaggagaatcgcttgaacccgggaggcagaggttgcagtgagccaagatcacgccactgcactccagcctgggcgacagaatgagactccatctcaaaaaaaaaaaaaaaaaaaaaaaaaag

SEQ ID NO: 6581 - DNA, 1026 bp, Homo sapiens
cacagcatgagcatgagctgtccctggttgggcacctgggcagtggtctgtgcttcacctagacaaagaaatgacagtcaaggaacagatgctaggggaggaaacagagctgaccagaggttacctgggcacaagaggaatctggaagagcgcacacctgctgagcaaacctaaggcagtgacatcagggtggaaaaaagaatacatatgcttattgttagtgttcaccaaaaaaggttcacagtgcgttgctctaaagctcagttagcttctctaacacaaggtagatacagtgtgaagtgccaaaactcagtttccataaaactttttacaagcatgtaagttccttattgactttttcaaaagaaattcatgtaggaaatgcatcctaactcattctatgatgccagcattaccctgatactaaagccagccaaagacactaaaagtaaagaaaactgtagagcaatatcccttatgaaggttgatgccaaaatcatcaacaaaatactagcaaatcaaattcagtagcaggctgaaaggattatacaccctgaccaagtacagtttgttcctggaatgcaaggatggttcgacacatgaaaactgatcagtgtaaacagaatgaagggggaaaaacacatgatcatctcaattgatgccaaaaaaaaagcatttgacaaaattcaacatctttcatgatgaaagcactcaatatactagaaatagaaggaaactacctcaacataataaaagttatatgaaaaatctacagcaaatatcatactcaatggcaaaaaaactgaaatcttctcatctaaaatcaggaacaaggcaataatgcccacttctattcaacatattactggaagttctagctagagcaattggacaagaaaaagtggggggtgggggagaagaggcatccaaactggaaaggaagaagtaaaattatctctattcccagatgatgtgatcttatatgcagaaaaccctaacagttccacaaaaaaaaaaaaataaata

SEQ ID NO: 6582 - DNA, 1026 bp, Homo sapiens
cacagcatgagcatgagctgtccctggttgggcacctgggcagtggtctgtgcttcacctagacaaagaaatgacagtcaaggaacagatgctaggggaggaaacagagctgaccagaggttacctgggcacaagaggaatctggaagagcgcacacctgctgagcaaacctaaggcagtgacatcagggtggaaaaaagaatacatatgcttattgttagtgttcaccaaaaaaggttcacagtgcgttgctctaaagctcagttagcttctctaacacaaggtagatacagtgtgaagtgccaaaactcagtttccataaaactttttacaagcatgtaagttccttattgactttttcaaaagaaattcatgtaggaaatgcatcctaactcattctatgatgccagcattaccctgatactaaagccagccaaagacactaaaagtaaagaaaactgtagagcaatatcccttatgaaggttgatgccaaaatcatcaacaaaatactagcaaatcaaattcagtagcaggctgaaaggattatacaccctgaccaagtacagtttgttcctggaatgcaaggatggttcgacacatgaaaactgatcagtgtaaacagaatgaagggggaaaaacacatgatcatctcaattgatgccaaaaaaaaagcatttgacaaaattcaacatctttcatgatgaaagcactcaatatactagaaatagaaggaaactacctcaacataataaaagttatatgaaaaatctacagcaaatatcatactcaatggcaaaaaaactgaaatcttctcatctaaaatcaggaacaaggcaataatgcccacttctattcaacatattactggaagttctagctagagcaattggacaagaaaaagtggggggtgggggagaagaggcatccaaactggaaaggaagaagtaaaattatctctattcccagatgatgtgatcttatatgcagaaaaccctaacagttccacaaaaaaaaaaaaaaaaata

SEQ ID NO: 6583 - DNA, 1026 bp, Homo sapiens; identical to SEQ ID NO: 6582

SEQ ID NO: 6584 - DNA, 263 bp, Homo sapiens
gaggggacggggacagaaccagggtgccctctcccatgccccacctgcactccacgaagctaaacccatttcgcccttgctgtccctgctgaagacggaggcagaggctcctatactcactgaggaatctcaagtttagggacaccaggtggcaggttgtgccaggaaagacatcagtcagggacagcactggcagagctcaccacaccatggagtcctccttccactccccttccatggtcctccctcctctccccctccat

SEQ ID NO: 6585 - DNA, 2651 bp, Homo sapiens
agtaacaactttaatccacataataaccctatgggatagataactgaggaacagagaggttaggtaatttgtctaagatcacagagctagggaatgatggcaccagagtttgaactgcatactgactccagcaacttctggggaaaatcacactcagtgttttgtagtaagatttggatttagggggtaaacagtactaacagagagttacagaactttgtacttctctcatctgctatttagttcattggacttgaactatgggctaggagagtgagaatggatcttggagattatctagttagcagcccttatagttcatggaactaagacccaggctgtgcagtagcctgttcagggatatgcatatgggaaaagctcaagccagaatggagtgcttttttactgaagaattctaaaatgtttctgcttcatataatatcctctctctgtcctttttccccttctttctccttgtcttctctccctttttatttatggtgctatcagtgttagaacaacaataatagaaagtacatggaaaagatcacttaaaatcctaccacaccatgttttaaactattttcatgtattgctgatttctgaatctgttatcttgttagattatgacattgatttaagtttcatagctcaaatatggaacctctataaagaagttccagggagtggaaagggaagggaaaggaattgctgttatttattaagagcctactgtctgtcagtcactctgcctacctgctgtctctgatgtctcaaacttccttcccactttatgggattctgtaggaggaccagcacaataccctgcacaaagtgagcattctgcaaacctaaagaacgaggaaatgaatgaaaggaagtgctttgaattcagcagaagaaagagataacaatcatgtgcgaactactcccagctattgcctattgactgttagctttcagttcatttttgtacaatttaaccattgaggcaaatgtgtatacaggataccatggaatgctgtttacaggtatagattttggttcttgtacttttgaagcagctgaatactgataaggcctgtgtccagaaactatttttttccttcatttaatcaggtttctttacttccttgaccacaaatattatttgctaaggaaatttcttctttggggtggtatttaaccatgcaagtggggaaaattgtgctacgatactgttctgacagcctgtggacttgagggaaaaaactgcaggagcagagtttcctttcagcagtcaactataggctcagtcacttcttgacaaaacataagttaaaatagtgctgatttctttttgaacataatcaattctaatggaaactgttccagctgagtttggaaacacacagaagcagccttcagttaccattgaggctattattgccctagtaataccaaagagactctttcagcctacttatttgtattggatgcttgtagggctatttcatggggacctggtgttgactctcagtgacttccactttgactctgagatttatcttcaaatgctgatgcattctaagatttatagaagtacaaacttatcttattattgctaatttgtcccattactagactatgccccttagagttataattatgactagcccaattacattttattgtcgtgcccttttttggcaaaaaataaaatttctttgttaaactcaaggatttaaaatttagcacaagttcataaacttactttgatacttcttcatttcctttttaaaaatacatcagtagactcaaaatgtaaaagtggcttagggctcacttgacctctgaaaggtggctgactgacttttagttaaaaacaatatttggctatatatctctgtcatctatttgtggctactatgtgtgcaaactttgtggaacagatatctttctcccttcttcttccctcctctctgcccaaaagacacacacacaaacacacacatgtacacacagagacttgaaggcttttgtgtacatttaccaactactacaacaacaagaaatgaagaacaatacagctcaactctgtaaatctagaatggggaatctatttcccaaaggctgtatgcagtatcttttcagcgagtcatggtagcctccaacaactagtagcactctttgtgcatgaggatatttctgactaaaaatccacctttgttgataatgtttgttcactgtaaaggaattgagtggataaaagaggtattacactttcctttctatatcaaggaaggtggaatattcaaacagaacactctatgtgtgcacacgtgcacatggacgtgagtgagagatgatttatagatatagaagagtcctactgtattcttttaagaggtattcagcaactatttgttgaataccttctgtgtgtttatcactatgctgagttcctggtgagaggggaatgagtgtaaagcagggatgttatcactatgctgagttcctggtgagaggggaatgagtgtaaagcagggatgtccaatcttttggcttccctgggccacactggaagaagaaatctcttgtaccatacataaaatacacttaacactaatgatacctgatgagaaaaaaaaaaatcggaaaaaaaaaatctc

SEQ ID NO: 6586 - DNA, 3965 bp, Homo sapiens
tttttttttttttttgataaatacaaagatacatgtaaagttttacttacctgattttaaaaacaggctaccaaaatttatccaaatatattaaaaaatgagactgttttaaaaacctttcgtttccatattgtgactccactaagcgggtaaaaagttcaggacagagatggaaaggaaagaaggaaacaggaagaagtgaaactaggaaggtggtgccagtggcacatggatgaagaaagagagatcatcagccatggagaattttgtaatgtaagtagagagagagattgggtaggaagacaggcttcacagtttgtaaagtgtaagggaactacccatcgtaccctgtcattgactagggctgtgagttatgtagttctgtctcctcttgcaaaagacttaccacttctggcaagtgattaaccacttctggcaactcttcatttcttcttatccttgaatattcatctacatcactctaaacagcacagccccagaagcatggaaaggggagttattagtatggaaaggggagttactcttctggtgtagtggtccgattgagtccatggcttcccagccttaccagaggtgataaaaatgtcaattcctttggggccaatcttgctcctccagtgtgttttagccctaatgaggtcatggttatttctagacttctgagacttactgtggctttgaattgacacaaacactaattttctgtcaaaggctagagtgatggatgttatatgcctgaattttctttgaacattttattttaaaagagatactttgggcttttcatgaaactaaaattctggaaccctagagcagtctattatatctgtcaccacaaggactttccttaaaaagctccctccataagcacttggatgtgtaaacaagatcctttcacagatctttttctcttcctctccatatcccaacttgtcttggagactactttttgaattataaatccctttctgcatttctattattaatttttatttgtaaaattgctaaaatagctaaatttggccatttaacctgcatttaaaatctaggaatgtggggtgatcatctttgtacataaattacctaatgaccctgtccatgctgtgctacgtgtttaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctcaccccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaaacgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaactgtgtggaaaaaatgaattttcttaaaacaattaagagccaggaactccactgagcatacagaccatctctggttaggttccaatccatttctaatgcctgc

SEQ ID NO: 6587 - DNA, 814 bp, Homo sapiens
gggttgccacaatgactaggacaagaatcctgtgtagagttcacctttgaaggtgagggatgtgcaggcatgtctctagtcctctagatgcaaacactatccttttacagttaggaagtgctcagtaaatatttgttgaatggaaccagtaaacatacccttgaatgagaagagaggttattttcacaaagccttgaaatttatttagagagttgaagctagtactgccacactagaatctgagtgtcaccagccagtacacctcagctcctaatttattctgcgtgggaatagcattcgcttccaatgccagaaatccctggtcttcagagcactctttcctttcaggccaggggttagtgtatagttttccaaccatagagaaagtacatgaacaccatgactgttacattttcatttatcaaagttatctgtcacaaagtaagttactttgctagaagagtcactgcattactggcattgtagaactgtgatgagccaggtactatgcaaggtgacaagtggggttaccacaatgattagaagagacatcagaaattctctaatctaactcactcttcttttatagatgaagctgagacccaagagtgggctgtgatacagaactcttagtcctgcgctgttgttctacgtcctacaacactgattatgcccagtatggatagaatatacatattagcttattcatatgcactatctcctattagctaaggcctcttctctgctgagttttaggcagaggcctaagtgctacaacagaaagtcctgcaacatatagtcaacttcagctata

SEQ ID NO: 6588 - DNA, 743 bp, Homo sapiens
ccaggtttctaaagcaaaaaattgaagagcattttcctcctgtgtttataatcccaactaaaacactatgtaatacatgttggaaatattactgtgctttgtatatgtattaattttttttgccctaaattggcctctaggaatgtgaaagtagatgtacccacctgataagaaaaagtgagctaagtaactaacttgataactaggcattcaacaagtctttttctctatttcatagaatcagtgtcaccttaaattataataggtttgcacagaattcgtgaattcttgagatagagtcttgctctgttgcccaggctggagtgcagtggcgtgatctcgttcactgcaacctctgcctcccaggttcaggcaattctcctgcctcagccacctgagtagctgggattacaggtgtgttccaccacgcccagctaatttttgtatttttagtagagaggggtttcgccatgttggtcattctggtcttgaactcctggcctcaagtggtgcacccaccttggcctcccaaagtgataggattacaggcatcactgtatctggctgaaattagtgtattctttaaagttcatatttttcattaattcacagaagaattgtaaaaaaggtaacacgcagttgacattccatttttccagaaagacagataattacatactgtagaggatgactcaaaagtctgtttcaagccactgacttcctaaactaatgaaggcctattc

SEQ ID NO: 6589 - DNA, 2395 bp, Homo sapiens
ctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactga

SEQ ID NO: 6590 - DNA, 2395 bp, Homo sapiens; identical to SEQ ID NO: 6589

SEQ ID NO: 6591 - DNA, 125 bp, Homo sapiens
agcccttccttcagatgtcccgcagtccgtccaccccgcacgtctcctatcagcctatgcacggcgggctccggtcaggtggaggatcagcaggtgggctttcaaaggttggatccgttgcccac

SEQ ID NO: 6592 - DNA, 125 bp, Homo sapiens; identical to SEQ ID NO: 6591

SEQ ID NO: 6593 - DNA, 622 bp, Homo sapiens
gtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttattttt

SEQ ID NO: 6594 - DNA, 4515 bp, Homo sapiens
ctctttttcaaatgcgatttattgtacataaaataaattaattacagtttaagccaaagcatgagtggctttttaaagtgcatctgtggaggggatgtggcaggtagcccctgttcacttgctgtaagataagtgttttagtatttcagccacccttaggcacaactcagccaggcctaggaagcaacccaacgtcattgccatgaaccatttacacaagtcacaccaaaatcaactgacacatttttttcctgatggaacagttaaaaaaacaaaaaactatacagtcaaagtctggggttgaagagcgtgaagttcacagctcctccacacacgcccaactgagcatgctcatcctgtgagggggaaccagagccttcctgtaaaccatgagagcttaccaatgtctggtatacaaaatattctggcccataaactcaacctgtttttgaggggtaggggattttccatcttgtacataaagaaagaaatctgggtatccttcaggttagaaaggcattctgtaagaatagtgttccagagttacaaatcatactggtaagagaaaagcaattcttcctcttggggaaaaagaggaaaagaaagaagaaaagagaaaaaagaaaaaagggggaaaaaagaaagcctatcaatgcttaatctgttctttcattcccactgtaaatcacatcaatacatttggtgaaactgcaacggaccaccatttacaaggtagttgaatgcagaaaccgaaacgattatgccccctccccactctaaaggaaaagacacagagtacatttcacatattcagagagtggctcagtgggctctttcaagcctcatcaatcctgtccccctgctcagaacaacacttccttttctgtagcagttccacaggccctcttggcccttctgctccagccctttctggaaccaggaatcattgccaatattcaacgttcctgcactaggagaacctcaggccctcttcctgggaagaccaaacccccttgagtgctcctcctgcttcagacggaggtgacagtcctcactttggcagagagggcttgcttaaacctcctcttcaggtcctgcatgttgggtgacttgggcctgggaatgagggaggttcttcgcttctcgggtgtactgctaggctgctgtttgtgactgacctctttacagaggacgtggaaggcgctgtagacatcattataattttcactgacagacacttcatagaatgagcagcctagcatgctggctagctgcagtccaagctgagggtcaacctgtttgatgtgcaacaggtcagctttgttggccacgaccaccacaggcagccgggtgcccaggtgtagctgctgcacgtgctggtggagctggctgatgagttcatagctcttgtagtcagtgatggagaaaacgatcaccacagcatctgcccagcgaatgcacctattcagctgttcactgcagctcaggctgttctcatggacctgaaagagaggagtgatggcaaggtgaatgctggccagttgtacaaagagcctgggcttgggtagatttcaaattcaaaagagcccttcatagtagtgccaggttgagggccataaacaacttatatcccacacacttcagctttcttgacaatatgttgatccagctgcacagagtgggaataaataacagtgcagcttaccacactcaagtggaaaattgacctgcagagaactccatgcagagcgactttgtagttgcacaaaatgggaaattaactggctagacagtaagtctggggaagtaaagataggagctggaagcatttaaacctggataactgcccagttcaggaggcggggggaaaaaccctagcatggcgcttttgtctatagagcaactttccagtacaaaagcgattccaagtatttgcagactatacccagaagcttggtttttcatgccaaagacacacatattaaaactggacttttaaaccacagcaaggaaaacaccaattccaactgcattcggtttgggctttccggctgtgttgaatccttctaaaggaagatttctgccccctagccaaatctcccaaactaaaccatgctaagatcgaccaacagccagatacaattgaattgtcagacatgtaaaagtctagatgtgactccccaaatttctctgatcctgcagcatgaggaactttgagaagaagtgagtgattccacagccaagtaggttcccctttcacccagagtctcagagcttctcacctgaatacctggagtgtcttgaacctgaagagccagggtttcaccttctatctgaacttgtctagtatagagattacctatgaaggcaaataaaagagattatgttcttccttcttgtacaacttttaaaacattgtgagttttaagctagaaaaaaaatgcacaatgcataaatgcacacaaaacagcgatagtttatttctatttggtgggcttacttcagattttttttaaaaaacaacagcaattttaaccctatgttagatttattaaaaccagggcaaagtttgcaagtttttgaaaacttatttatctagttttaaacaaagtttccatttttagagtactcccttgatgcaaattatcttgctcagcctatgtgaggtttctgttttcttgagtacttgattcattctttgactgtaactttgtattttggccgttagatataatggcttgctagacaaatactgttagtaaacacacagccaatgttatcagttggaataaaaatgtgatataattataatcaactctacatcaaatcagaaggctgccatgtcttatcttgggatagcttatacagctcatttcaaataatcccctataggtactcatatggtctacagagttaagcaatttgctaacagagcataggcagaaagctcttaagcctccccagtggctattcttaatcataaggattgaaaaatgtgtcctctcatttattcgggaattctcctcctaaaattctaccatccagttgtttgtctttgttaagaaggaggaactttaggtttacaactgctctcctttggcctttgctttaaaaggtcacctctgaaaggcagccagcagagaaggagaggggtgggggaaggagctagggactccttttttttttttttacgacttttgcaggagtgttttgaagggagaggttcttgactacaaagggtgcttccaactggggtcactatagttaaaacataccaaggggaatactttcaggcacttgataaaatgatgaatgggcttggaatggaatgaggccagatggtagttatgggaggggggcgccatggagggctggggactggggaaagttttaagtggcgggatcctcaggctcggactgtcactgaaagaacctccctgggaagcgctggaaaatgggaaccgcagtcctcctgcaatgggacagaatttttctcaaatgcattgtctcacctgcatttctttcatagtcaccgatgaatcgtttggtgaggaaccggaccaccagtgctgcacgtcagaaaaaagaacgtcaaagtgttaaccttggaagttagattgttctccaccccaccccctgcctggaaaacagttctcccaaagaaagccatagatggccaccaagtgaaattcctaccctgtagctccttgacccttctttccagacaaaaaggagggggctagaaggcatcgtgaattatggctctgtgcagctggaaggctcactgggcccaccccctcctctgagcccggctgagccacacctaagccttccagtagacccatgtcttcctaaccttcaagacctcccaggggggctagcttcactaactcccctttctgtgccaggcattgccagaggctcaaacaccccaaagttctgatggcggcggtgccggtggtccccagaaagctgcctggccattcttgatccttgtttcccccgtctgtggaagcaggcgggtggcgtagacaacggctaagcccactcccaaggggcagcggctccctgcgcggggacggagagcggtcgggctgcagctcccaccgctccccacgccttgttcagcctcaactcccgtcaggggtcgtccaagaccagacccagggctaagcgcgacgactcaccggtcttgcccacgccgctggccccaccacggcgatcttgaccaggcggcggcggcggcgcccacacagcagtcggaggccgcggcgttgccggcgcggggtactcggcgatggtgcacatgttctgaatgaggcgcatcgcctcggctgcggcgcaccgcgggaagggactgagggactggagaatgctagcgctgcgcgggagcgggcgggaggacccgactgcggggctccgcggtaagaaataacaacaataaataagtgcaggtacgggcggggtggggccgagcgccgaggttccgcagggctcaggctccagacccagact

SEQ ID NO: 6595 - DNA, 8968 bp, Homo sapiens
ttgaaacaattagaaatattcctcatttagctgcaaatctaaagaaaatggtgagtattaatatagcaatcttcagttattttttactagaaacttagaggtgtgctctcccagtttagctttttaatagctaatattacgagctagttaatttttaaatcaagaagtattttcttggcctggcatggtagttcacacctgtaatccctgcactttgggaggccacaacgggtggatcacttgaggtcaggagttggagaccagcctggccaacatggtgaaactccatctctactgaaaatacaaaaattagctgggcatggtggtgcgtgcctgtaattccagctacccgggaggctgaggcaggagaactgcttgaacctgggaggcagaagttgcagtgagctgagatcgtgccagtgcactccatcctgggcgacagcaagactccatctcccattaaaaaaaaaaaaaaaaaagaagaagaagtgtttatttatttagaccttggatttaacattttcttttttatataatttttatttagaagccattttaaattattttattccaacatttaataaacatgtgttggcttcattgtgccgtggctatgctacatgtattgtgaaagatagatatgaccaatccctgccttcaaattctcaacgtttggtgagacagctgtaaaatatacattttctacttataggattatatttgcataataaatgcagcaaagaattacaaagagatgccatctattgagcatagaaaagggaggaattacttccagtttaggaggattctgagtaggatagggataggaagacttcaataaagtttttgttttgttttttaaatagagacgagttctcactatgttacctaggctggtttcgaactcctaagctcaagtgaggcacccgcctcggcctcttaaagtgctgagatcacaggcatgagccaccatgtccagctttgcaataaagatttatttaggtgttagcagtaagctgaatctttatttatttatttattttctgatatggagtttcactcttgttgcccaggctggagtgcaatggcacaatctcggctcagtgcaacctccgcctcttgggttcaagcgattctcctgcctcagcctcccaagtagctgggattacaggtgcccaccaccacacctggctaatagtttgtatttttagtagagacggggttttgccatgttggccaggctggtctccaactcctgacctcaggtgatccacctgcctcagcctcccaaagtgttgggattaaaggcctgagccaccgcacttgccaaagtaagctgaatcttaaggaataagtgaaattcggacatgcatcagaaagaatagtttggccaaaaggagcaatgtgaggaaagacataaaagtcaaagaacccagagagtatgggggaaaagtgatactccactttggctgatgcgtaaaggtattgaggagattagctcagggttagtttatgcagtgccttaaaaaccagactaataaccttagactttactgtctgagtattggggagccattgaatgtgtgtgtgtgtgtgtgtgtgtgtgtgtgtgtgtgtgtgtgtgttttctttttttagtgaagggtgcagaggagtgacttgattagaactgccttaatcatggagaaaatattggatagagcagactgagccttgctactcttgagtatgggcagagagtatcaacatcacttggaagcttgttataaatacaaaactacagacatcatgcaccctagaacttcagaatcagaatctacgttttaacaagttcctcaggtgattcctgtgcacattaaagtttgatcagctctggattagaagactaggcagagaaaccaaaggcagaaaaacctggagactaattaccgtcattcagataaaagatttaaagcataggaatacagaagataatttttatagattatggaggtcacatttttagaacttggctatgaattggacaagggacacatcaaaaataatgaagtttctagtctgggtgacttgaaggtgagtagtatcaagtgtgggttaaagaagttagtaagtgggctgggcgcaatggctcacacctgtaatcccagcactttgggaggctgaggtgggtggatcacgaggtgaggagatcacgaccatcctggctaacatggtgaaaccccgtctctactaaaaatacaaaaaattagctgggcgtggtggcacgtgcctgtagtcccacctacctgggaggatgaggcagaagaatcgcttgaacccaggagacggaggttgcagtgagctgagattgctccattgcactccagtctggcaacagagtgagacaccatctcaaaaaaaaaaaaaagaggttagtaagtatattttttgacacatcttgcacatgtagtaaatggtcaatcatttttgaactgtagttagactgagtttgagatattgaaggtacatccagatagagattaccagtagtcttaaatgtgggcctgaattttaggaaggaagttaggtttagcaatataaattgagggtcatctgcattgagtgattattgaagacaaaagagttgaactcacaaagagtaggtttgtactgtaagaagtgggaaagcacagttttaaggagcttttgaagtaaggggctggaaaaagatcatgtgttaacctttggtatcagttactgatgatataatgaattaataagagacataatttctcctgtttcccttttcaaatgttacagaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcaagtgatcctcccacctcagcctcccaagtagctgggactataggcacgcgccaccacgcctggctaatttttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaattttttagtcctagtctgaatttaaagtgatagaaaggactgatgcactgtttaacttatacagtataggcatataggctctcagaatcaaaagagcttgaggtaagttaagcctgaggtctacttcaaagagaaagctaatttaatactcttccagagtcaatcagtgctgattaatttttctttaattattcaacttttagatgtgtggatattaaaaaaaaattagctctgcatgcctttttttgttgttgttgttgttcttgttttttagatggtcttgctctcacccaggctggagtgcagtggcacaatcatagcccactgcactctgaacctcctgggctcaatggatccttccacctcagcctcccaagtagctgggactacaactgtgccccaccacacccagctaacttttaaatttttttgttgagatgaggtctcgtcgtgttgcccaggctggtcttgaactcctgggttcaagcaatcttggcctcccaaagtgctgggattacaggtgttagccccttgcacctagcctgaatgtctgtgtttcctacttacactagaagaggtgtgtgagatttgcaaatttattgccagcataacagtgatgccagtttgtgaagaccattctggaggaattgagatgctgcctggttttcctagcatttttcttattttctttctttctctatgtgactctaccagtctgacccctgatttatcctctgaaaccctcaatgaagtcaggaacagtctgaggaatagcagaacctaaaagatttcttgacatgcaaaatctataatagagttgagattttaataagactgtaattagtgtattgtgggatttcttcacatatctgtaaaacacatgaatttacataaaagatttatctcacaatttggggaatccactaattgagtttactaaaaaaattatgcattagacccttgaacaatataagcttgaagtgcatatgcaattttttttttttttttgagacagggtctcactgtcaccaggctggagtgcagtagtgtcatctcagctcactgcaacctccgcctcctgggtttgagcaattctcctgcctcggcctcccaagtagctgggattacaggtgcacaccaccatgcccggctaatttttgtatttttagtagagacagggtttcaccatgttggccaggatggtctcgatcttttgacctcgtgatccacccacctcggcctcccaaaatgctgggattacaggagtgagccacagtgcccagccacaatttttttttcaataaatatattggaaatttggagctttgtgacaacttgaaaaattcacaggtcaggcacagtggctcacgcctgtaatccagcactttggaggcggaggcgggtggatcacctgaggctgggagttcaagaccagcctgagcaacatggagaaaccccgtctctactaaaattacaaaattaaccaggaatggtggcacatgcctgtaatcccagctgcttgggaggctgaggcaggagaattgtttgaacgcgggaggcggaggttgcagtgagctgagatggtgccattgcactccagcctgggcaacaaaagcaaaactctgtctcaaaaaaaaaaaaagaaaaagaaaaattcacagatgaactgtgtggcctacagatatcttgaatgcaaaaaatatatatagatacaagtctatcatttactaccacaaaacacacaaatcaattaaaagttaaattttatgaaaacacagactgtacgtgtaagcaaatttaaaatgcagtattaaatcataactctatagccgccactgtccggccacagccccacactcttcactgtcgctcgtcatctcgcacagggtggctccagttgtggtgtttggcgccagaattaaaccaccaccatgtcgagcaaaaaggcaaagacgaagaccaccaagaaatgccctcagtgcacaatatccaatgtgtttgccatgtttgaccagtcacagattcaggagttcaaagaggccttcaacatgattgattagaacagagatggtttcatcaacaaggaagatttgcatgatatgcttgcttctctagggaagaatcccactgatgcataccttgatgccacgatgaatgaggcaccagggcccattaatttcactatgtttggtgagaagttaaatggcacagatcctgaagatgtcatcagaaatgcttctgcttgctttgatgaagaagcaacaggcaccattcaggaagattacctgagagagctgatgacaaccatgggggatcagtttacagatgaggaagtggatgagctgcacagagaagcacctattgacaaaaagggaaatttcaattacatcgagttcacaagcatcctgaaacatggagtaaaagacaaagatgactgaaaagaactttagctaaaaccttccaattacattgtcttactctgttttatttctcacacacttcccccaccctcatagaacctgttgcatgcaacttagtttcacagctttgcctttttttaaaaatgtatttattccagacctttctgccacttagcacttgtataatcagactggaaatggtgatgacgccataaattgtattgaaaaagagatcgccaataaaaatcaacaaatgtgaaagcccccccaaaaacataactctataaactagtacgtactgtactactgtaattttgtaactgcctcctgttttagtgagtcaagtgttgccagcatctgc

SEQ ID NO: 6596 - DNA, 23071 bp, Homo sapiens
agtaaggaagtgcttttgaatgaggtactgagggccaaggtgttggaagttcctaattctttcctcggttaactgtgaaactctgcgtattgggaaggcctggcctcagtcatcaggccaggagaggtactggacgccgcgcacgcactcgtctgccagcgaggcccaaaggggaagcctagcggagctcagtgtggcagctgctggcctctgggccggtaagaattgatggtcccctcccttattccccaggcccaaagctttgacccagttagtgcctgctagtttcgtgtgcctggcttgtgcctttggcgcggaacgtttgggagactcggccttgcggtcttctgacctcacccaccacgtacctagcttggcactgggtccttcatgcctctcactcgcttcctctgaggcacctgggtactctcttgtctcttacccgcttaatctgagtccatgtccaagttcatcattctgtgtctgaccgtgtcccagccaccggaagagaagaaactccgggtgtgacattaatcccactgggggctcgggagaactgccttctaaaatcagagactgtatccatttgtctggagagaaatgaaaaaaataaggacaatgtagggaggtattttaaaggtaaatttatttaaatgaagtgatagtgtcattacttttcctgtttgattttaaatagtctttagctgaacgatgacctgtagtaggaaggtggtggcgaagtgattgctttttttaaaattatttttttaacacttttatgtcagtagtcagtactttatttgtccataaaatccaaaaataactacctttggattttacagtagtctttgactgaacctcagagagatgagattccttacccaaaatgatgaatctgaaattattacccagttctcttgactctggaataagtgcttttttctactataccacttctgcttttattcttggggctgagagtacaggctgtggagcacgacggggttggcattttggcttccacctttttctgcttgtggtgacctgtctgagccagaatttctttatgtgtagagcgataataatagtacttaaattacaataatagcacttaaatagcacttgatacatgtaagactctaagtttacagtgttaaactctacttgtaagatgtgtttatttacctcctcaatataatcagcttcagtattcagtatttagatatatcagttgataaataggtttcttctcttcatttttttcttacctgatttatcttacctggacaattttttaaacgttattttttctccaccttgggccagagacattttttgaaatattttatttttaaaattacttgtattcattattattgcctttttttaaaaaaaaataaatgaaattttggttgatatttataaataagtttttgtatttgaggaacagtaagtacattgaaaacttcttcatcaaaataatccagcgttaaagaccaagtaattgtctcaaatcattttatgaaacacattttttcttcaaatctttgaaacctaatgttatgttcttttctagctacttgtcaataccatgctttcctgtaatatttgtggtgaaacagtaacctcagaaccagacatgaaagctcacctaattgttcacatggaaagtgaaattatatgtccattttgcaagttgtcaggtgtgaattatgatgaaatgtgttttcatatcgaaacagctcattttgagcagaatacacttgaaagaaactttgagaggataaatacagtacaatatggaacttcagataacaagaaagacaacaccctacagtgtggaatggaagttaattcaagtattctttcaggttgtgcatctaatcatccaaaaaattcagctcaaaacctgactaaagatagtactttaaaacatgaaggcttctattcagagaacttaactgaatctagaaaattcctgaaaagtagggaaaaacagtccagcctgaccgaaataaaaggatctgtttatgaaacaacatacagtcctcctgaatgtccattctgtggaaaaatagaggagcacagtgaagatatggaaactcatgtgaaaacaaagcatgccaatcttttagacattccattggaaggtaaagttttcatttcattataaattataagtttacagcctcaatttaatatgtggtattttaaaagttggtttgtaagtcagcttactacagatgtgttttgaaatccattttatgtctataacatttttcatttgctgttactgaaatataaaagtacattatggaaaagaattttaatgcagatataaaatgtttcagctacattgagagtagttttggaactttctgtctagtttccagagggtattctttttattgtcactaacccagtagcatctggactgtcctggactctctgactttgcattgagttctattttgactccattattctgttatgattggagaacaaactctctgtgatatcagttcttttaaatttgttgaggcctgttttatggctcaagacacgagctatcttggtcatgttctgtggatacttgggaaaaaaaagtgtattctgctttgttgggtggaatgttatatgtatgtcactagatcctgttgtttatgttcagattatttatatccttgcttgttttctatagtagtactgtctagtagttctatcaatttttgagaaggggttgttgaaatccctgattataattgtaaatttatctatttttcctttcagctctgtcaggttttgtttcatgtattttgagactctattgttggtgtgtacacatttaggatcttatgtctttttcttattgttgaactttaagaatttgtggagccaggtgttgtggctcatgcctgtaatcccagcaagttgagagtccgaggtgggcagatcccttgagtccaggagttcgagacgatcctgggcaatgtggcaaaagctcgtctcttcaaaaaaaaaaaaaaaaaccaaaaaactagccaggcctagtggcttgcgtctgtagccccagctatttgggaggctgaaataggaggatcacctgagcctgggaagtggacgctgcagtgagccatgatcacactactgcactccgcactccactctgggtgactgaataagaccctgtctccaaaaaaaaaaaaaaaaaaaagaaaaatttttctgtattttggatacaagttcttttttggatgtgtattttgcagatattttctcttagtctgtggcttgtctttttattcttttaacagtgtctttcatgaagtagaagtttttaattttaatgaagtgcaacttgacaatttcttctttcatggatcatgcttttggtgtgtctaaaaactctttgccaacttctagaagtttgatagttttgtattttacatttagatctgtgatacatttgaattactctatgtaaaaggtatgaagtcagtgtctacattcttttttaatgcatttctctgattatgaaatcaatctttttttgtatagttattttaatttcctctattatgaactgcatattacattttttgtacacttgagttacatgcatttttcaactgtatattgtcaaatattttttgagtttttttcagttgcttttaaaatatattttcaatactaatccttcagctgtattccataagatgttgcttatccttgaattttgtgcagtatttgaattttatttttgttttctatgtattgtctaaaaaagtattctttactctgaattcaaaaagctattctcatatattctaaaaactttaatgttttatattttcactttttaaaattttttctggattgtgtgtgtgtgtgtgtgtgtgtgtgtctgtacttgtgtacatgtgtatattttgtgaacttgggatctaatttttagtttttccctgtacagaaaccagatatatctctgatttataatatggtttctgttttttattacattttcatatctgtgtgggccagtttctggtctcttacttctgctgtatttatctatgtgacttttgttcccttattacaccaccactttaatagctattttgtaaaatgtcatcaacatcagataggacagtttttccctcgttcttcattttcatcatcaacttagaccttctcattctttcttttctttgagttttaaagccatattatcaagtttcataaaaactctgttgtcattttgttttaaattagatcaaagtacatctccccattaattcaggtcatcttttgtatcctttaatacaattttgtgtgtgtgtgttttttttttttttgatggacttttgccctgtcacccaggctggagtgtaatggcacgatctctgctcactgcaacctctgcctcccaggttcaagcaattctcctgtctcagcctcccaagtagctgggattaccactgcccaccaccaggcccagttaatttttgtacttttagtagagacagggtttcgccatgttggccaggctggtctggaactcctaacctcagatgatccacctacctcagccccccaaaatgctgggattacaggcgtaagccaccgcgcccaggcttgtgttgttttttcattgcacatttgtgttagctttatttctgtatagtttatattttctgttgcttttgtaaattagatttttttccctctcatctaagaaacttttgcagttttatagaaacactatcaatttttatagatagttgaggtatctagtcttattcaactattactaatattattttattttatattttttgagacaaggtcttactatgtcacccaggctggagttcagtggcatgatcatggctcactgcagccttgatctcctgggctcaagtggttctcctgcctcagcctcccaaggggctgggactacaggcctgcaccaccacgcccagctaattttttttttttaatatttaatagaaatgaggtcctgctatgttactcaggctggtcttgaactcctgtgctcaagcagtcttccttcctcagcctcccaaagcattaggattgcaggtgggagccactgcgtctggcctgttaacgaattttaataattctacattaattcccttgagtattctaagtagatcattttattatctgctaataatgaaaatttatggactgctgcaaggaaaaaaaacaagtgtattgaaaaatgcctgacaatcctttgctgacacaacatttcctgtaagtttctcaggaccagtaaactggtgaattttggtagtcttaggagtctgaatgtttagttgcggttaaaaaagacctgttgtcattagaagtacagaagtgaaataggtaaatagctagatttaaccaatgttcagttatagtaaatggaacaggtggatttgcaggtgtttttaagggaatgattatcatatagagaagatatgtggaatctgggctggaaagtaaagaaaaacatgaggggggtaatgaatgacagaaaaatagggtttgtatattctatataggaggttttagttaggtcaaacactttttagagtggtagaattaaaagaagtgaggtagaaggataggtgtttgggagtgatatttgaaattgagatttcagagattcacttagtgataaattaagggtataatttttgtcattcggttggtaaattagggtaaaggaaaagattgttggaaatgaaggcatagaactatttctatggatattgaagttgctaagaatgatcatagtataggggctaggaaaagaaggttttgatccaggtgttaacatttttagtaaatgaaaggagtgtctaagacttcagaaaatattaggcactaagaaaggtagatgatgccatattatggtgacatgagttattacaaaaatggggcttaaaacaggtttgacagtggtgaaagggagcaaaggggatgcctcttctacttctagggccctgaattgtgaaagaaaagttgcctgtgtgttagggggctgtagagaaaatggggtgtcatgaaccaaccagattttagttaagtcaagaaggtgaagtgaatatccagagaaagattttgtgtatagagaagctgactgatgaccgatggtatttctgagggcattgtggtaggtattgggagaataggaggggtaatagcttgggtcagattagcagatgtccttcaggtatttaaagattgttaagacactgccactgaacaattagattggattcattgacacaacagtgttggtggttacatcagccctagatgactccattggatgatgatggctaacctctgaggcttagtttagattctggtggtaaaaaatgtatactgggatatgaggtgtagtgtggtctaatgttgaggaaggttggttatcacttaaaactagaaggggtggagggattggcttgcagtagtgtgatgatcaaagcgataagcaaaggcctccttggcattggctctggctctaaggcattttatggtagagaactggctgaaagacttctcttacatccgccagcattacttatggaagctgtataccattatttcttactgctgcttttggaaatattttctgagtacttaatacttcattttctcttgagctttgccattgaattttttattccaatgattacatcttaatattttcattttcttcatctttctattttttcttagtaactttctgtcctggtttcaaagattcagttccctcctttatttcagtgagcattttgaacatacttattttacagtttattatggattactgtagctccatttcttcacaggtaactttttcagtttgtagatttcttagctgtttttcttggcattgcagcccccagtgagtttagcaattcaaattttagtgttcatctgttatgggagttttatatgatcccttccctgtgaagcagtttcatggttccttcacactggctgttcacagtctctgctttcagaccaggccttacatatacagattgctctatgctttcactctgtgtatatgcacaattctgggtccctcttctatgtcccttatctgctaggtcttggtcttatagaggaacaatttctgtttttggcaagctagacctgtctgcctgcagtgctatgtgatggatgcagctctttaatctcctgctcctgtgtagacagtattaccccaattcccagctttatgctggatgtttaagttcagcaccttaccactctgttgggtgctgagaatttagtcctaaaaacccatatccagactgggccctacttaccactttggttttcctttctgcttctcttgttttgactacagatctgaatatttattattaatatttcctttttttttggagtggtatgagaggtttgtgctatgctcagccttctatctcgaccctagaagtagaaaaatagcttttaaatccactacaaagagcttttacttatataaggttaataggtggtagacagtctttgacatggggtgaaaaaatctaaaagttataaaaataaaaccaacttggctgggcatggtggctcatgcctgtaatcccagcactttgggatgctgaggcagaaggatcacttgagtccaggagtttgagaccagcctggacgacatagtgagatctcatctctaaaaaaaaaaaaattagctgggcgtggtggcgcatgcctttagccccatctacttgggaggctgagatgggaggattgctgcagtgagccgtgatggtgccactgcacgccagcctgggcaacagagtgagaccctgtctcaaaaaaaaaaaaagcaaagaaaaaaattaaaataaaaaaataaaaacaacttaattatatctctgatacagactgtgatcaaccactctatgattgtcctatgtgtgggctcatatgtacaaattaccatattcttcaggaacatgttgacttgcatttggaagaaaacagctttcagcaaggtatgtttatatgtttgaagataaaaatatcatttaatttctactttctaggacacatatctaatttttagatttgtgatatggaaaaaatattttaaaatacatcttttcctttaaaagtgttttatttacaagttgaggccatttctttagcagctagaagtatctgaatattgtatttggtcagcgaaaattgttgaactagaaaactgccatatggcacataaaattttacaaatgaatgtgaactatataaccaaaacatctttcagtgcatcttgagctgcttgaatagcttctaaatgacttactggttttattgtgattctataaaagttttcctttctcccctatgttttttaatagtggcattgtttaaataatcattatggtggcttagaagtggaaaaatcctatatgaatgttagaagcccactgaacgaaaataaaaagtagatcccaagagaaaccaattgtgttttaccctatttcagttttttaaggtacgtagatagcttctgttaaggcagaggtctttagtgtccagtatcaatgatcctagtaccagtatcggtgttcatggacaatgttactgctcactcaccctaagccaaatatgagattattggggcaaagatggaaaagttccctgctctggtggtttctgaatgtctgctaattcttactcttatttatgataggctttgtatgagcacgtatattacagtgtaaacctatagtgggtaataagaaaaagatatggtctaagtaaatcactgtagataacctcaggggacactaaacattgagtgtgacttgtatatccccaagaatggaagggtgaccaaataggaagatgtagcagcagctgagaactttgaaaggaaaggaagaatagtcagtgatataattaaaccatcaggtcatggggttaaggagacaagatagtggccagaagccactgacaaatggatctgggggacaccgagtagagaagatgcaggatgagatgttgcaaagttttaccatttttgggggccaaactgtaattaaattattatctaacacctgcactttgtaaatgtgtatttttatgctctttatttttttttttttctcccctagtatttctttgaaaaatcaatctgccttagttatgttaaggagtatcaatgcaggatgttacttaacgttttaaaattctggtttcctcagtaaataataataactacttcataagattgttacaaagatcaaatgatataattaatgaaaagtgcttgtcacagctttaaacacttagtgaggctgggcatggtagctcacgcctgtaatctcagcactttgggaggccgaggctggtggatcacctgaggttaggagtttgagaccagcctgaccaacatggcgaaactccatctctactaaaaatacaaaaattagctgggcatggtggcaggcacctgtaatcccagctactcaggaggctgcagcaggagaatcacttgaacctggcaggcagaggttgcagtgagctgagatcgcaccattgtactccagcctgggcaataagagcgaaactccgtctcaaaaaacaaaaaacagtgactgttagttgtcatttagatggaggttattccttaccaaagcagttctaagttttgctaaatttgtactcagttccatatcatcacagtcatgaataaatggcaaataacagcatttactctattttaaaaacatatattaaataataaataatctttgattgcaacagttattttattctgaacattaacaatacctaacaggcatggatagagtccagtgttctggtgatctacaattggctcaccagcttcagcaagaagaagacagaaagaggagatctgaagaatcaagacaagaaatagaagaatttcagaagctgcaggtacaaagattaataacaattataatattttgatttggtaaagttatttttcaaatatgctttccagtgtattatttttgtccttgttattattcaaaaaaaatttatacatgtttgtaacagacaccatttataaatattcattctagtgaggcacaggggtaatcacttcacatacaatatctcaaaatctttgcaacatattcatgaagaagttactttaggccctcccacgcccccttttttttcagatgaagaaatggagacagagaatggttaagtaatttgctcagtgtcaggcagctaattagtgataaagcttgcattcaaacctgtgtaagttgatgggacaaattaggaaaccaagactcagaatttaagtgtttgtatagatgcttggaagcgaaatttatacttagaattaatgtctcctgagtcttaaattattttacagattgcaatttcaaacatttacaactattttatgggaaaatgctttttttaaatgatatttgaggcttcatttatcttaggtgggtggttttacctgttggactaaactggtagcatctgttatatttttaatgcatttaaaattttaatgtctgtttttccttttttcagtcctaatttgtagactgtagtgttatctgtgctaataatgctcatagattcatagattttgttgttgttgtttgtttgtttgtttgagacggagtttcactcttgtcgcccaggctggaatgcaatggtgcaatcttggttcactgcaacctccgccttctagggtcaagtgattctcctgcctcagcctcccaagtagctgggattacaggtgtgcaccaccatgcctggctcatttttttgtattattagtagagacagggtttcaccgtgttggccaaactggtcttgaactcctaaactcaggtgatccacctgccttggcctcccaaagtgctgggattataggcatgagccaccgtgcctggcctattgcttatagtttttaaatgttctttttttagtgatgataggatagtgcatacataaaaagggtttacagttgaataggtttgaaagtgttcagttaaacaggtttgtatactttgggacttctcaaagcctttaatatactaatgtgcatgtacatatcacaatttccccagacttgtttgacctctctttttttctcagacatctcacatgagtattgttgcttagaatgtgctttggaagacctaatgtaggatttttttctcactggtgactcacaatacttgcaaaataggaaagaaaattggcttttcttaagacttttatgccttatgtaatttaaaacatgatcaatacaaaaagtttccaatatttaaggaggttatgtaattttgcaagttagttgtttagatctcagaaaatttttctgtagaaaagtttccgtgaaaacttttccatagacaatttttccatagttttatacatactatttgagatttctgtccagtgtacaaaacatagttcatttactgtgtaacatgactgactaaatgaattatggattaagtaggcctttatggactagactgggaaccaaataacaaggactgacaagtttccttgaaaaaatcagcaatgcattcagaactcttctgcatctcccaatacctgaggtagaaagacaggatcctctgctttccctactacaggaaaagcaagtctcttgccctggagattgattataaagaagtggttgcttattaagtcaataatttttttttgtgtgtgtgtgtgtgtgtgttattagtttttgtaaaaatctttaagttaacttgtataaagtctataaaccagaatgtttcaacatgtttccaaataaaattttaataagtttccatcctcatagagttacagggatgtaaaaattaagtcatttatttttatgttcaatagagacaatatggtttagataattctggaggatacaaacaacaacaactacgaaatatggagatagaagtaaataggggaagaatgcctccatctgaatttcataggagaaaagctgatatgatggaatcattagctcttggttttgacgatggaaaaacaaaaacttccggtgagtatttaaacatcagagtcattgttttaatattgcttataccactgaagtaataatcagaatcattttaattttgcttaattttcataatctgtgcacaaatatttttttaaaaatgtattgttttaaaacttctgaattatttttatgataaataattcacttaaaaatttacttttatattatgttacttgacatttaaaaagctatgctctagagagtgctaagagaaatataatgtgagccacatatataattttaaatttcctggctccacattaacaaaagtgaaaaggaggctgggcgcggtggctcatgcctgtaatcccagcactttgggaggctgagacaggcggatcacctgaggtcgggagttcgagactagcctaaccaacatggagaaatcccatctctactaaaaaaaaattacaaaattagctgggcgtggtggcacatgcctgtaatcccagctactagggaggctgaggcaggagaatcgcttgaacccgggaggcggaggttgcggtgagccgagattgcgccattgcactccagcctgggcaacaagagcgaaactccatctcaaaaaaaacaaaaaaaaaacaaaaaaaagtgaaaaggaacaggggaagttaatttaaatagtttaaaccagtgtatccatgatattattatttcaacatgtaatcaacattaaaactattactgagacattttacattgtttatacattcttcaaaatccattgtgtattttctacttcacagcacaactcaattgggcagccacatttcaaattctcgatagccacaaatggctattggctattttattgtttgtacatttttagacactaacaactctatatacattgtatcatttaactcaaaacatcctctcctgtactgttatatattccaaatgaggtcactgttgcttagagaagttacagtgactttgccaaagcaaggttacacagctggttattcctaatcaaatcttccttgccccataatatggcttttttctgatgagtattaaaatttttttctttgtatatattagtatattaacagactttttatggaaacaactttgttactgtcacccagattttttgaatcttaatgttttgccatatttacttaaaagtttttaaagcttcaacacctttgataggtattcaaagccctttatgtacactttttctaattctaatttgccctccccacaagggaactattatcccaagtttgatatttatcagtctcatacatgctttagtactcttaccatgtatgtacatttccataaaatattttgcaggtgtttatatataaatgggatacaacatgtatgctataaattgttttgctcaaatatattggttcttacagttctacttcattcattttagctgctgtgtagtatttccttgtatgaattgtagctaacttatcttgttttcatattgataaacatttagattgtttccagttttctactcttataatttatgaacatgtctacttcaggagtttctctagtattacatccagaactggatgtagctaattatagctaacttatcttgttttcatattgataaacatttagattgcttccagttttctactcttataatttatgaacatgtctacttcaggcgtttctctagtattacatccagaactggaatgctaagttaaagggcgtgcaaatcttcaacgttgttaaggttattatagaattgttttccaaagtgcttgtaatctacattcacaccagtgtatttcacacatagtatggtgacacttttaaatttttgctatttaacaggttatgagatgatacatgttttaatttgcattttctggattactcctgagttagtttcctcttgaacgaattacctgttctcttcctttctctattctctattgagttgtttgttcttactgatttataggagactgttaagtattcagaacactattctttcattagttatatgaaatccaaatatctttttcaggcctgtggtttgtgtttaaatgttatatatagtgcctttaattagacagaagttttgaatttgaatgtaatcaaagttctcaatctttctatttattatttgtgtcttaagtaactcccccatctttaagatcacaaatatatacctttatgttttcttcaaatatttatattttgcatttcatattttgattttaaatccacccagaatttatttgcatgtgtatgttggagggaggagggagaagataggaatctgattattttctccttgtttataacagtccttatagcaagtacatattatgcttatttatttcactaccatttattgaatctgcattttctccacctatttgtgatactatatattatagattttcatatatccatgattctgtttctaaaggctgcctttatatttcttcaggggtctccatgtaaaaaagttctcactatagcatagagcatcctccagatgtgtgatatgattcattaggatacaggaagaaaatattaaatatgtctgtaaaaaagcacactgtcctgtaatatagaagtgatttagtggcagagatttttatttttcgttaattatgcaagtgttaatttaagcagctatcatttaaagagtcttcacttatatactgcaatcttgttataattttaacaacagaatataatttaactgaagataaatttactgtggaaaatatctaaagacatttaggtgctaaggaataaaaagtataaggaaatttccccctaaagcagttgcatgatgttgctaagacagtgttgctctccatctgatatgtaacatatatactaaaatgtactagaatgtttattactttcctttctattttttctgtcccctactccacctcattcttaaagggctgcctcaaatcttgatctcttcatcaaagtctatgatattaaaatctacatttagctttctttctctgaattcctagggtacccattcattccatgctacaacatttagtactcagttatatactattttaattgttgtttttcttgaattcaagtctttctaagttctttggaagtggttacagtgatcagtatttcaccttttcatggtgcaaggcacagctacaactattggttcatttaactgtttttatttattgatcttttattgtctttattaaagacaaaaacccattttcttctaggaaacccttcattcaagcaaaaagaatttagttattgtctttggtgccacatgctatgagaaagttatggggcatataataagatctccctacccataggcttcacagagtctgtagagtatgtaaatatacacaaagaattatagtattctgtgactgaatgttgctggtaccttggggacacaaaaatagggtagaatcagaaaaagggtctatgaagacagtagcatgtgaaggatctataattttgaaacataaggagaatatactaaaagcaggaaaggggccgagtcagatgtcccttgtcctaacaccttgtttttccatattatagcacttgttatagttggggtcgatgacattttaaaggatattatcatatttatctttttgtacttagcatttagatagtgccaggtgtattaaaaagtacttagcaaatactgaatttgaaaatttaataaaactctatgggccaaattatgtttaatgtgttcagttaggccacagccaaaattacagcaagaagagtagtgtgaaataaagataagacagtggatagctttctgtagacttcatataacatagattagaactattctaattaggtttataaggctattaataagattcctaaacctattgttctgccttaagaaaagttgtcttctgttgtctcaaacaaattaattaatctccccaaatagcaaaatggaatatgttactaaagggttgaaatttagcgtattggagtatgagatatgtttattattcatgaagtcaagagtttttaaatgaaaacatttgtgtattctcatgcttcgaaaattgcaaaatctgcaaaataaaatcttaaattacaaaaaaattaaaactattggtaatagggagctattaatattttttgattgggagcaaattgattaagactgagtgatctccagtagtctatacaataaaatggagacacaagaagaacattcattcaacagttgtactttatgtgctgggccctgcagatgcagaaaatttcaatgaactgtaataaataatatgctagtgttaggaaacttggactgtagtaacaagcaaggacacaaactaaggttatagcaagaagaaggtgaagaagatggaattaacaggatttaggtatggtgcgtgaaggagaggttgatattaaaaatgtatgagatagcaatataaaggtgataatgactgcttctgaatctcttttctactttaggaattattgaagcacttcataggtattatcagaatgctgccacagatgtgagacgggtgtggctttcttcagtggtggatcactttcattcatctttaggcgacaaaggttggggttgtggttacagaaatttccaaatgctactttcatcattattacaaaatgatgcttacaacgattgcttaaaaggtatgtgaaatctagtactctgaacttgtcatctgataaaatacatatgatatagaatgatatagcatacacaattaatagctttaacagttagtggatatttatataagaaacctgaattctggttagaggaagagaaaatgatagaagatgtcaggaataactgtcttaaaaaccgtaaagttccccgagtacataatacactgctaaatattattcagtactttattaacagtcatgtaacatgtttgcttgtgtaattttaggtatgttgattccttgcattccaaaaattcaatctatgattgaagatgcatggaaggaaggttttgatcctcagggggcctctcaacttaataacaggttacagggaacaaaggcctggattggagcatgtgaagtatatatactcctgacctccctaagggtaaagtatgtaccttaaaacctaaataaatgttatttccttatcggggagctttgttttgtaaaattttattttttagcaaagagatagtttaaaaataaaattaagtagcactaaattaagtagcaatgaaaatcagcagcctattcactatcttgtgctcttctctaccctcaagttctgtctctcagaggcaactgtcacttccattgtttttaaatggtatgctttcatagctgtttcttggtttatgagtttcagatagtctgttttaatatcttatacctgtttaccttcaatccttctgatatgattaaatcttggtttttattaaaatcagagtttacatcattttataaagtcagattttattatacaattgtgtaaatattgcttgttgctgattttttctaaaatcatttataatttttcttgagttaataattgtgtttccttttctcttttactataatatgtgacgacatcatggcctcaagtttttgcactctacctgtcatgtaatctgaggctctccttattctcggacacatccttcttgagcattctgtcctctttgctccaatctggactttttgccttctagatctacagctattgtcatgtagcattttttcactgttttgtgtgtgtgtgtgtgtgtgtagtctcatttttaaaatgtataacctatttattttctgtggaagttattccaaccttctcttagcccatcataatttcacgatattatgaaatttcaccatggggtgtggggctttgattcattgtgttgggcatttgtttttctctttgaatctggaattgtgagttgtctaagatcttagttccatctaggatagtaggtaagagcttgaactttggagcgagactgcctaaccttgattcatagctttcctacttaatagctgaatgaatgaacttgtctgtacttaggtctactattgataaaagaaggtattaatagtagttagacaattaaatgggataataaagtacttagaactgtgactggcatacagcatgacttcagaggttaactattgttgtttgataattataatgtctctgttttctttgtggaactattgatagttggccactgaactaatctttttttttttttttttttttttgagacggagtttttgctgtgttgcccaggctggagtgcagtggcgtgatcttggctcactgcaagctccgcctcctgggttcaagcgattcccctgcctcagcctccctagtagctgggattacaggcttccgctaccacgcctggctaatttttgtatttttagtggagacgaggtttcaccatgttggccaggctggtctcaactcttgaccacaggtgatccacccgcctcggcttcccgaagtgctaggattacaggcttgagccacggcgcccggcctgcttctttaccttctaagtttatcatgtctcttttttaaaaatctttgctttttctctattttctagatttactcaactttatcccccaattactgtattgaaatttttattttacccattatgttaaggggtaatttcatagcatcattttctttatggttgcaaaatttcttccaatgttttctttctattgcctgcattttgtttgttcgatattagtattttttcatatctgtttgttttagtcttttctattttgaaggctttcttttaattttggaaatccttagttgtccattcagagagtgaagaatgaaacattaaaaagctgattagagtgctgtaggactgcacagagcttgcagattagcagacttatttaaaagtcttaggtggaaggcggaaggttactatttggttggggaactctcaaatatcgttatatagagagatcttttcccagaagttatccagagaagagtttttcactctcttacctagagttcctacattagtggaggggagagttaaggtgtgatttgccttctaagcaaacttttaattaatctcatatttttagcctcactgttctcaaaccttatgcttctaagctttcagcctctctctgattttgaaacatacggtctccattttcttttatttacttttatatgttctctgtggtgctttccattttctgaagatgtgagctcttttcctgtctattcccattctctttgtccttgggtgtttaaatcattttttccttcagtattatgtcattgggtttttaagaggaaatagagatagatgtctgtgatcgtgtttaatggaatgtttgcgttaagctttatggctttatattttcttttatgtttgtttctaagttatttaaccagtgtatcacattctttttaccacattgattgattagattcagaaataaaaatatttctttcattaacatagaaaaactaatgttgtgtgtatgtataataactttcttgaattatttaaagaactattttaatgccctctaaatttattcctgcttttctcctttttctttttgccaatgtgttcacactttgagattatttatactctatcatgttttgagttttaaagtaatttttttctttttctttttctttttttttttttgagacagagtctgtctccagtctgtcacccagaccagagtgcagtggcgcgatcttggctcactgcaacccctgcctcccaggcttaagtgattcttgtgcctttgcctcctgagtagctgggattacaggcatgtgccaccatgcctggctaatttttttttttctgcatttttagtagagatggggtttcgccatgttgtccaggctggtcttgaactcctaggctcaagcgatccacccgccttggcctctcaaagtactgggatcacaggcgtgagccactgcacccagccgtaatttttgtccagcttctttcttggtaccttaaataatttagaaagcttttttattaatatatcctgagtgtgtttagtagttatttacatgtctttctgttgctctctctatgagttatatcctgtagggtactgtttaattagtattctaaatgtaaatatgcaaactgctaaccccaaaacattctttttaaacggtttatccagaagtttatttgagcacttaaaacccagtaaccaactgtaagttaccagcattaaatttgctgaggctgaggttagcaattcggatgttttagagattttattgccaagagaaacaagaacaggatatctgtgctgtagtttaaagtgatgataaagctatcaaatgcttttagttatacccgaccttttaaaaacagttgttgagtagtataaacagtgtttctggttaaaaaaatgtttattcaagggtgacttcctcttgaaggaagaataccacggtggtccggtggcaaataggagatagatgtatagattgagtacacacacatttttctatgatttacaagtattttctgttatagagatttgagagaccgacaggaaaagtatttaggatctattttatatataccaatggctactgaggaattaaaatcagaaatcagcttctgatcatcagggttagaaactagaataaaagctgtgaaaaaattatgtgtagatgactttttaaaaatcaagtatggtcattatttactattcatggagattttatatatcagagaatgtttgtaacctttaggttagtcagcagacttattatgaagttatttaaatagttagctagttagaggaatagttaaatagttaaatagggagaattgttaaatagttatcccccacaaaaaggagttttttagataagtaataaaaatttatatttacttttcttcttttataggaaagtaatggctagaaacagttagttctaaactaagaatttgttgtatttgataactccatcgatgaaaatattttaaaatgccctttaaatgtgcattttgtcaatttttaataggtgtcatattgttgattttcacaaatcaactggtcctttgggtacacaccctcgcttatttgaatggatattgaactattattcttcagagggagaagggagtccaaaggtagtgtgtacatctaaacctcctatctatcttcagcatcaaggttagtattaatataactcatatttgacaatgttgtttataagataacaaattgttgctttcagacaggttaaggttttttgtttgtttgtttgtttttttagacagaatctcactctgttgctcaggctggagtgcagtggtgcaatcttggctcgctgcaacctccaccttccaggttcaagtgattctcctgcctcagcctcctgagtagctgggattacaggcgcctgccaccatacctggctaatttttgtatttttagtagaaacggggtttcaccatgttggccaggctggtctgataatagcagggagtattatgacattaatctgtttaatttttcagagctcctttgacagtacaatactttcttaggtaattaagattgatatttctacaatacttcattgggtaattaagactgatattcctgacatcttcaggaccttttgcacttcttgttttctgtgtttagttcacttgtccttcattgttcatcccttaccttcttgggtctttacccacatgtcacttgagtgaggccttccctgaccttaccttaccttaaaagtagaactcaaggccaggcatggtaactcatgcctgtaatcctagcactttcagaggccaaagcaggaggattgcttgagcccagcagtttgagaccagcctgagtgacatagtgagaccctgtctctacaaaaacataagaaaattagccaggtgtggtggcacatgcctgtagtcctagctactcaggaggctgaggtgggagggtcacttgagccttggagttgggggctatagtgagccatgattctgccactgcactccagcctgggcggcggagtgaggctgtgtcaaaaacacgtacaactcatcccagcatcccaccgctggcattttcttcacttatttacctcatttatagagtatctcttcctattagaatataagttccaagaacacaggcacgtttgtctgttttgtttgctgttatataccttcgtgcttggagtagtacccggcacatagatacttggtaaattatgaatgatggtttggattgacaggaataaacagaagtaaatgttaggaatttcattgtttaggaatataaactataagagattaagctccctccactgatattctagcatttatgggtttacttttgtttaccttttggaatcatgagagttttgttctagaacagtttttgttctttcatttgagataatttgaataagaaggatcaaaggattgggaaaggaaaagtaaaatatttggcagaataaaaatgttttttttggtaatgaagcctttagaaaactaaagttaaatgaaaaaactgaagtagaactaaactcttacgtcttaggagaacttagatacatatgtgtcagagtctgactgtatttatattctaaacacacatatgatcacacaacatacatacagagactatttgtataactgtaaatagatgtgacgtatgtataacttaaaaatcttttgataggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctttctctagaggagaaacttg

SEQ ID NO: 6597 - DNA, 6181 bp, Homo sapiens
ttctttttttattatttattattattattattatcatactttaagttttagggtacatgtgcacaatgtgcaggttagttacatatgtatacatgtgccatgatggtgtgctacacccattaaatcgtcatttagcattaggtatatttcctaatgctatccctccccactccccccaccccacaacagtccccagagtgtgatgttccccttcctgtgtccatgtgttctcattgttcaattcccatctatgagtgagaacatgcggtgtttggtgttttgttcttgcgatagtttactgagaatgatgatttccaatttcatccatgtccctacaaaggacatgaactcatcattttttatggctgcatagtattccatggtatatatgtgccacattttcttaatccagtctatcactgttggacatttgggttggttccaagtctttgctattgtgaatagtgcagcaataaacatacgtgtgcatgtgtctttatagcagcatgatttatagtcctttgggtatatacccagtaataggatggctgggtcaaatggtatttctagttctagatccctgaggaatcaccacactgacttccacaatggttgaactagtttatagtcccaccaatagtgtaaaagtgttcctatttctccacatcctctccagcacctgttgtttcctgactttttaatgattgacattctaactggtgtgagatggtatctcattgtggttttgatttgcatttctctgatggccagtgatgatgagcattttttcatgagtcttttggctgcataaatgtcttcttttgagaagtgtctgttcatatcgtttgcccactttttcatggggttgtttgtttttttcttgtaaatttgtttgagttcattgtagattctggatattagccctttgtcagatgagtaggttgtgaaaattttctcctattttgtaggttgcctgttcactctgatggtagtttctcttgctgtgcagaagctctgtagtttaattagatcccatttgtcaattttggcttttgttgccaatgcttttggtgttttagacatgaagtccttgcccatgcctatgtgctgaatggtaatgcctaggttttcttctagggtttttatggttttatgtctaacatgtaagtctttaatccatcatgaattaatttttgtataaggtgtaaggaagggatcgagtttcagctttctacatatggccagccagttttcccagcaccatttattaaataggaaatcctttccccattgcttgtttttctcaggtttgtcaaagatcagatagttgtagatatgcggcattatttctgagggctctgatctgttccattgatctatatctctgttttggtatcagtaccatgctgttttggttactgtaaccttgtagtatagtttgaagtcaggtagcgtgatgcctccagatttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatagaatgttcttccatttgtttgtatcctcttttatttcattgagcggtggtttgtagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgtacgttgattttgtatcctgagactttgctgaagttgcttatcaacttaaggagattttgggctgagacagtggggttttctagatgtacaatcatgtcatctgcaaacagggacaatttgacttcctcttttcctaattgaataccctttatttccttctcctgcctaattgccctggccagaacttccaacattatgttgaataggagtggtgagagagggcatccctgtcttgtgccagttttcaaagggaatgcttccagtttttgcccattcagtatgatattggctgtgggtttgtcatagatagctcttattattttgagatacgtcccatgaatacctaatttattgagagtttttagcatgaagtgttgttgaattttggcaaaggccttttctgcatctattgagataatcatgtggtttttgtctttggttctgtttatattctggattacatttattgatttgcgtatattgaaccagccttgcatcccagggatgaagctcacttgatcatggtggataaggtttttgatgtgctgctggattcagtttgccagtattttattgaggatttttgcatcaatgttcatcaaggatattggtctaaaattctcttttttggttgtgtctctgcaaggctttggtatcaggatgatgctggcctcataaaatgagttagggaggattccctctttttctattgatcggaatagtttcagaaggaatgttaccagttcctccttgtacctctggtagaattcggctgtgaatccatctggtcctggactctttttggttggtaagctattgattattgccacaatttcagatcctgttattggtctattcagagattcaacttcttcctgatttagtcttgggagaatgtatgtttcgaggaatttatccatttcttctagattttctagtttatttgcgtagaggtgtttgtagtattctctgatggtagtttgtatttctgtgggatcggtggtgatatcccctttatcattttttattgcgtctgtttgattcttctttttttctttattagtcttgctagcggtctatcaattttgttgatcctttcaaaaaaccggctcctgaattcattaattttttgaagggttttttgtgtctctatttccttcagttctgctctgattttagttatttcttgcctcctgctagcttttgaatgtgtttgctcttgcttttctagttcttttaattgtgatgttagggtgtcaattttggatcttttctgctttctcttgtgggcatttagtgctataaatttccctctacacactgctttgaatgtgtcccagagattgtgttatgttgtgtctttgttctcgttggtttcaaagagcatctttatttctgccttcatttcgttatgtacccagtagtcattcaggagcaggttgttcagtttccatgtagttgagtggttttgagtgagtttcttaatcctgagttctagtttgcttgcactgtggtctgagagacagtttgttataatttctgttcttttacatttgctgaggagagctttacttccaagtatgtggtcaattttggaataggtgtggtgtggtgctgaaaaaaaagtatattctgctgatttggggtggagagttctgtagatgtctattaggtccgcttggtgcagagcttagttcaattcctgggtattcttgttaacttcctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggcctcctttgtctcttttgatctttgttgatttaaagtctgttttatcagagactaggattgcaacccctgcctttttttcttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttgtgtgtgaatttgatcctgtcattatgatgttagctggttattttgcttgttagttgatgcagtttcttcctagtctcgatggtctttacattttggcatgattttgcagtggctggtaccggttgtgcctttccatgtttagtgcttccttcaggatctcttttagggcaggcctggtggtgacaaaatctctcagcatttgcttgtctgtaaagtattttatttctccttcacttgtgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacccgacctttctttctggctgcccttaacattttttccttcatttcagctttggtaaatctgacaattatgtgtcttggagttgctcttctcgaggagtatctttgtggcattctctgtatttcctgaatctgactgttggcctcccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttctattcttttttctctaaacttcccttctcgcttcatttcattcatttcatcttccatcgctgataccctttcttccagctgatcacattggctcctgaggcttctgcattcttcacgtagttctcgagccttggctttcagctccatcagctcctttaagcacttctctgtattggttattctagttatacattcgtctaaatttttttcaaagtttttaacttctttgcctgtggtttgaatttcatcctgtagctcggagtagtttgatcgtctgaagccttcttctctcaacttgtcaaagtcattctccgtccagctttgttccgttgctggtgaggaactgcgttcctttggaggaggagaggcactctgctttttagagtttccagtttttctgctctgttttttccccatctttgtggttttatctcctgttggtctttgatgatggtgatgtacagatgggtttttggtgtggatgtcctttctgtttgttagttttccttctaacagacaggaccctcagctgcaggtctgttggagtttgctagaggtccactccagaccgtttgcctgggtatcagtagcagtggctgcagaacagcggattttcgtgaaccgcgaatgctgctgtctgatcgttcctctggaagttttgtctcagaggagtacccggccgtgtgaggtgtcagtctgcccctactgggggatgcctccccgttaggctgctcaggggtcaggggtcagggacccacttgaggaggcagtctgcccattctcagatctccagctgtgtgctgggggaaccactgctctcctcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcgagcctgggcaatggcgggcacccctcccgcagccttgctgccgccttgcagtttgatctcagactgctgtgctagcaatcagggagactccgtgggcgtaggaccctccgagccaggtgcaggatataatctcctggtgcgccgtttcctaagcctgtcggaaaagcgcagtattcgggtgggagtggcccgatgttccaggtgccgcctgtcacccctttccttgaccaggaaaggggactccctgaccccttgcgcttcccgagtgaggcaatgcctcgccctgcttcatctggcgcatggtgcgctgcacccactgtcctgcgcccactgtctggcactccctagtgagatgaacccggtacctcagatggaaatgcagaaatcacccgtcttctgcgtcactcatgctgggagctgtagaccggagctgttcctattcggccatcttggctcctcctcctccaaa

SEQ ID NO: 6598 - DNA, 861 bp, Homo sapiens
ggccgggcacggtggctcacgcttgtaatcccagcactttgggaggccgaggggggcggatcacgaggtcaggagatcgagaccatccgggataacacggtgaaaccccatctctactaaaaatacaaaaaattagtcagacgtggtggcgggcgcctgtagtcccagctacttgggaggctgaggcaggagaatggcgtgaacccgggaggcggagcttgcagtgagcagagatggcaccactgcactccagcctgggcgacagagcaagactccgtctcaaaaaatatatatatatacatacatacatacatacaaaccaagatatttgttatcttgtaaccttgaggaaagaacctggtatcctttaccttcggtgcatagctgggagcttgatacctagcagcattataaaccctttattgatactaaaatagagtgctactcagcaggccctagtgtagactgctatttgccccaggacctgccctgtgaactcattcagattaagtatgaatgacctcagagcccggttttctctcctagcaattgagtggcaggaaactcgatgggagaaggaaaaactcggaaatgggaggaatgcaaaaatgactacatctctcaggagatcgagaccatcctggctaacacggtgaaaccccgtctctactaaaaatacaaaaaattagccaggcatggtggcgggcgcctgtagtcccagctactcgggaggctgaggcaggagaatggcgtgaacccgggaggcggagcttgcagtgagccgagatcgcgcactgccctccagcctgggcagcagagcgagactccgtctcaaaaaaaaaaaaaaaaaaaaaagactac

SEQ ID NO: 6599 - DNA, 955 bp, Homo sapiens
gcatggtgtctgatagtggctcaatttcagtttttttttaaattgtttccgaggcgtgtttcaaatatttgactttttcccactggtctgaatagtgcttctcagatacggcaagtctctaggtttgcatgagtcagcctctgtgccctctgttcttttccccgatgttctttttgcttcttcttatgctattaccacactgtcttaattactatattttattaacaaatctcactttctggtagaccatttccttcacctacttcttcactttccttcaggaatgtcttggatatttgtaactcttttccttatgatttagcatcagcttgacaagtttaataaaccttgttaggactgagataaaattagaaagattggacatctttaaggtactgagttctcctagccaggaatgtggcacgtttccctatttctttagggaattgtaaaatgtctttttataacgttttataattttccccatagagatctttaaaatattttgttagatttattcctagcaccttatatattttgttactcttgtaaaaagtatccttttttttttttttttttttagaaacggagtctcgctctgtcgcccaggctggagtgcagtggcacgatcttggctcactgcaagctccgcctcccgggttcacgccattctcctgcctcagcctcccgagtagctgggactgcaggcacctgccaccacgcccggctaatttttgtatttttagtagtagagacggggtttcaccgcgttagccaggatgttctcgatctcctgacctcgtgatccgcccgcctcggcctcccaaagtgctgggattacaggtgtgagccaccgcgcccggccagtatccatttttaaaaactacattttctctttgttgcttgggtagagaaataaaatcaatttttaatttatcttatatctgatcatttt

SEQ ID NO: 6600 - DNA, 479 bp, Homo sapiens
aaagaaagtggaagatagtaacagagaaagtggaaaaaaggacgagaagggatagacatgcaaaactccagcattccaaagttaagggaaagagaataaccatgttgtgcctataaccctagaagattacaaaaattatttctagcaaattgacaacccttctttctgaaggtagctttgggcaaaaaggtgctgttttgagcttttaccctgaatcacctggggtgcacttgaaaagaagccattttgccaatgcattaaaagtgtctgagtgaaagctgccacttgattgtcctaagaggcttttaaccccagccacataattatttcataacaaacaatcaggaacatttctcttcctcatcagtttcccagactacctcatagcacatgcatgatacaatgtgtgattttgcagccttccatgtaacatcggagtcctaaagagatggacttgaagaggctcatggtgattttaa

SEQ ID NO: 6601 - DNA, 13191 bp, Homo sapiens; identical to SEQ ID NO: 6379

SEQ ID NO: 6602 - DNA, 1316 bp, Homo sapiens; identical to SEQ ID NO: 6380

SEQ ID NO: 6603 - DNA, 309 bp, Homo sapiens; identical to SEQ ID NO: 6381

SEQ ID NO: 6604 - DNA, 1048 bp, Homo sapiens
gtggatatatcacattttgtttatctgttcatcagttgatgaacttttgggttgtttctgctttttctggctattgtaaatagtgctgttatgaacactgatgtacaattttttggggtgaacatttgtttttattcttttaggtatatagctcggtgtggaattgctggatcatatatggtaattctgtctttaacttaatgaggaactgccaatctgttttcctcagtgactgtaccattttatattcctattagcaataaacaagtgtcccaatttctccacatttttgccaacactgttttccattaaaaactttttattatagtcattctagtgggtgtaaagtggtatctttttgttttgatttgcatttccccagtaactaatgacattgagccttttttcatgtgcttgttggccatttgtatatattctttggagaaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgacagaattggtgtcatttgtgtttatttaccaggttatttggaaggattatattttaggtgctctcctctcccccagtaaatggtattacgacacaagggttataaaggactgataagaaattacttaagacagaaagggaagttggcctgcttccaaaatgtggtcccagcagaagtgaagttagttacaccaataactacagtcaaaaagctatttttaaccatgataatgtacttgttgttattaatattaaagattatatttttccaggtgcagtggctcacatctataatcccagcactttgggaggctcaggcggatggatcacttgagctcaggagtttgagaccagccagggcaacatggtgaaaccccatctctacaaaaaatgaaaaa

SEQ ID NO: 6605 - DNA, 1048 bp, Homo sapiens
gtggatatatcacattttgtttatctgttcatcagttgatgaacttttgggttgtttctgctttttctggctattgtaaatagtgctgttatgaacactgatgtacaattttttggggtgaacatttgtttttattcttttgggtatatacctcggtgtggaattgcgggatcatatatggtaattctgtctttaacttaatgaggaactgccaatctgttttcctcagtgactgtaccattttatattcctattagcaatacacaagtgtcccaatttctccacatttttgccgacactgttttccattaaaaaatttttattgtagtcattctagtgggtgtaaagtggtatctttttgttttgatttgcatttccccagtaactaatgacattgagccttttttcatgtgcttgttggccatttgtatatcttctttggaggaatgtctgtttaagtcctttgcccactttaaattgtgttgtctttgtgttgtagagttgtaagagttctttatacattctgggtactagacatgattttcaaatttagatacatgattttcaaatcttttgcctctagatgttttttacttttttatttttgatccttgaactcatctatattctatggttgtgatgtaatgatgtcagaattggtgtcatttgtgtttatttaccaggttatttggaaggattatattttaggtgctctcctctcccccagtaaatggtattatgacacaagggttataaaggactgataagaaattacttaagacagaaagggaagttggcctgcttccaaaatatggtcccagcagaagtgaagttagttacacaaataactacagtcaaaaagctatttttatccatgataatgtatttgttgttattaatattaaagattatattttgccaggtgcagtggctcacatctataatcccagcactttgggaggcttaggtggatggatcacttgagctcaggagtttgagaccagccagggcaacatggtgaaaccccatctctacaaaaaatgaaaaa

SEQ ID NO: 6606 - DNA, 238 bp, Homo sapiens
cttcttgattctgttgccatctctttgattccttattgtttctgataaattttcctaagtttaatttccgagagctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaac

SEQ ID NO: 6607 - DNA, 135 bp, Homo sapiens
aaagtactttttcttttataatatgcaacaataactttctgtttagttaattagttttaaaacaagcttaaacttataatttataaagaatcatatttgctccctatcattgttttatagctggggctatactga

SEQ ID NO: 6608 - DNA, 238 bp, Homo sapiens
cttctttattctgttgccatctctttgattccttattctttctgataaattttcctaagtttaatttccaagggctctttggaaaagtatcgattttttttcatggatggagtatctactcttttgacacagggtcttgctctgtcgtggctcactacagctttgattgctcaggctcaagcgatcctcctgccctagccctcccagtagctggtactacaggcctgcaccgccaaac

SEQ ID NO: 6609 - DNA, 136 bp, Homo sapiens
aaaagtactttttcttttataatatgcaacaataactttctgtttagttaattagttttaaagcaagcttaaacttataatttataaagaatcatatttgctccctatcattgttttatagctggggctatactga

SEQ ID NO: 6610 - DNA, 7710 bp, Homo sapiens
ttgtatcttaaatacaatcaaaacttcatgtttaatagggattcatctgtttcccatactttttacatgttcagttcagacagaactcatggaagaaaagacttttctgtgagatagaacagaccatctgcttgaccggatggctctgagggacagccaaactcccaatggccaaagggctgtgaggaagggcaacacatatcagaagaattttcagcaagggctgaaacacagtaaggttagccacaaaatggaatgagagaagccctaacccaatgggagtttgcctaattttaatgaacccaaactctaacattgtactggaaaagcagcattaaaatccagcctgattatcacaatttacagaatttctcaccagaggcccacaggtgaaaaagctgcttactctaaagcccttagaaccgtattgtgaactgcgcatgcgagggatctaggttgcgtgctccttatgagactctaatgcctgatgatctgaggtggaagtttcatcctccaccaccaccccgtccatggaaaaactgtgttccacaaaactggtccctggtgccaaaaaggttagggactgctgctttagaatataagaaacaactcaagcagccaacgggtctggagttaacacttccagccctcccctttgtacacactcaacacttcttgctgaactggccgttaataaccacttgtgaaatccctccccacacctgcacttaggcgtttgtctcttcctaccttcctttactgagtagtggcaaaataataggagagtggaagatggtgatgggcaatgaagagggacctatttctgaagaggagatgttttaaagatattttatttttcaataccagtaatgactgaaaattaaagaattaaagcaggaagcaaaacaaaaacaaacaagaaacccaaaacttgcaacctaaactctccgggaaaaaaaaaattgctataaatgttaaaagacttaaagagaacattgacaatgcagccctgatgtacctaatcatacttcaaactgctggatgttttaagctgagaatctccccagtgcctttctagtgctctaaaatcatctcccaaacagatgagaaatgaaacaaacaggtctcccttcttgagtacataatttttataaattgcgtcggacccacagtgaatgtattttagagagtttcaccaaaactatcaaagatcaaatggcagcaaaagatcagggaaagaaggtagaaaaactatgcagtcacagagctaacccgcaagctgcccttagtcctatacacctgaaatcaaatccatagccaatggtgaggaagaccacatcagaggttagctgcatgacagcacagctgggtcctatctccctgccaggggtctcaactgtaactcgcgctccaactgctctgcagtcagggtgccctggatggcttcacagcctggattgaacacagagtaggcgctcttctctccctctttcttctcttcagggcctcgtgtcccgacgtacatccaatagaacaaggacaggacaaaatatgccaggccaaattccagttccacaaacagtcccagcaggaccaaccagagaagaaccttcaagaaggtgatattggtcaggaaagactggtcccagcacgacggcagaggaatggctgtgttccatggtgtctctgatgtgctgccctggggctgagccgcttcctaggatacacaaacaaacaaaagaaagaataaagggtaatggagctgagatgatcaaaactaatctgaaaaggcagttttcattgctctgagaaggctgctggctcattgatttctattctttcatgcaactctctaaaacaatcatctccaaagaacctatgtgctctactccaactgaatcaaaactgatcagcacttagtgagatgtgacctaataaaagccctacgtattcagacagattcttattcgtgggagtcatttcttcagattagtctgctgctaagaagagctaatttgtgccccatacagaaactcctgaataactgataatgcaacagtcatgacaaatgcttcaaatacagagtcaatatacctttgttgattggattagatgacctaaaatattacaagtgacatgattctaaaatagagacaggaaacaaaaatcctttttacgtttaaaaaaaaaaatcagccaggtgcacacctgtaatcccagcactttgggaggctgaggcagacagatcacttgagctcaggagtttgagaccagcctggccaacatggtggaacctcatctctactaaaaatacgaaaattagccagcatggtggcacacgactgtaatcccagctactcaggaggccaaggcatgagaatcgctcaaacctgggaggcggaggctgcagtgagctgagattgcaccaccacactctagcttgggcaacagaccaagacactgtctcaaaaacaaacaaaaaccactgttacagccattactgggcccccttaccttcccatcccgtgattaacctacacaggtcattgtcactcacccaaggcccagccaatgtctcctaactagactccctgcctcctatctcttccctccccaagccatcctatgtacaactgctaaatgaattttcttaaagacctattaccctcctgttcacaaaccttcaaaaactttcactgtctacaggataaaatccaaactccttgggctggaacccaagaccctcaatttgttcaacagattgaaatgccagtagacaggcccctgtgccagatgctaatggcagacacaggtatttagacagctctgtgtccagtccactgttttcggaactcttttgaacatgacctacaataaggaatacattttagactgtaatccagaatacatatatgcaacaaagtttcacaagtcaacacttaccctccctgagacattctcttgtatttcctattctactttaaaaacatttttaatagggaacaagatcttctatattaatttcaccatccactaatgggtcacagtggtctaggaaattccatgacaacacgatccacaatcttttgttccataaatgacccttcttctccagcttaactggtcttattacccaaagatattctcagtcctcatctcaagcctagaattccgtccacttcctctttcttccttaactctttgccttccttccaggcaagcaccgttcatgaactgtcagccctgacctccctgggcatcagggagggtgccccctctgcctcccccagaactagctctcccgttcattaagcaccaaactattcagcactacagtgtctctcttttactataggtcatgtcatgtatgatgccagattgtttaagtaccaggaagccacgtgtctccagatccaaacatggcatcccatacttaggttctcaattcatagcagaactttcagttcatctcttcagttacatcccctattcttcttcacgtgcatatttaaaaggggatcacaaatactggtcatctgatttatgatgtttcagaagttctattttgtcagaaccttcttttttagcatcaacattgtaattattatcttttcagttagattagaaagtctgattggagaggcccttatattatcagccacatccctgacccctgatactcattaaagaaagaaatgtctgtttcagatttgacatgcatgcacagtatgcgttctggcccaagaagaatgcatctgggcagtgttctgggcaaaggggagagtagcatgagatgacggggctaaggagggagggcatgagggtgggagccagataaagtagggccaggcaggttgcagtgaagattctggaaatgggaaacagctgaaggtctaagcagggaactaaccaaaagcatgaaatccctggtgctaaaaaggttggggaggaggcctagcaagagagagccagacattgaccagggtggtgacagcagtcagatggaaatagtggactgatggacacaaaatacattctgaatatacatgctgagattcacaataaactaaatttatcatttagggagtataaaaagaagaatgttcctatgtcaccatttactgagagccttccaatgtatgaactctggtaatccaggaagcaggcattattattcccaacttactgataagaaaacactgagaggttaagtaatttccctaaagccataaaactagtgataggcagagatgaggtcagtctcggatcctaggatggtctcctccaaaatatattttatttaattaggggcctttatggggggtggcaggagaaaggttagggagctagaggtagatgggtgtgggggtgggggggtaaacaaactgacgaagggaacaaacaagaggagagatacggacattcttctgcctcatttggaacttgtcggagtaccagttcccttctgctgtaaaacctgggtgaagaagtgtttgtgactgttacatcacacacaggcatggcccaaggaaggcactgccattcctcaaatatcaagctgcttcttaccttagggcctctgcacttgtggttccctctgagaggaatgctcccttcccctcatatcacttggttgacccctcctactacaaacggcaaaaatgtcaccgtatgtgcccttggcttagtccccgtttttgccagggtggttccttcttgttaaatgtctcctccttagtgagttctccctgctcagctgatttaaaatagtactctgctcccctcacccctaattcactatcacagtctactggttttatcttttttctttcatagcatttatctggttttgtttattgtcctcctttccctgctgccccaagctcaaatgcaagttgtacaagagtaggacttgtgtgtcttaattacactgtctcccaggatttagaacaaaagctggaacacagcgggcacatgacaagatttttgttgaatgaatgaatgatagtgagggaaaggaagaaattcaagatgactactagattttgcgggggtgaggcacagctgtgcttagccaggcgactccaaaggagagcctttgagcagaaggccagcctgagccaaggcctggaggtcaggagtggtggatgggtatgggaaatgggttctggggcagggtggtgtgctgggggcttgcctgggatatggctggagagggaagcaggaggtttctgtaggaatttttaaaagttaccagcatttttgtcctaatgtggaagaagctcgtcacagaattatttcaggaaactgcttttctccaagcaaaatctggtagtgggaaggaggatgtagatacttcctcatcaatgactgctgaaaagatgcagcggcattgtcagtcacagcgaggcccgggtcggggcagaggcatcattgcagtcagagcttggcccaaatggaggccgcagtggctttgttgctccaaatgacatggtttagttattttgatggccaaagagtattctttgtgcatatacattacagtttcttgatcccttcatctgtagatggacaggagataaagtttttggaatctccatgcctgagattaaaaggtgtgggacttcctctaccaggctcatttccttggacctaatatcctctgggtttcttgggtttctccacatggctgtggatgacaggatttcccaaagctttatggctgaagcatattccatagtgtatctgtatggtggtttctttatcccttcagctgtgggtggacaggacaggtcatttaccatgatgtcctctaggttcaacagtgtggctgcaaatgatgtaatttcattacatttttctggatgaagagtattccatttgtgtatatatactacagtttctttatcccttcatctgcggatgaacaggtttctccacatggctgcaaatgacaggatttcatccacttctgtcgtggaagggtattccattctggatatatatttcagttttgtcatcccttcatcaagggatgaacaggttcaactgtgtggctccaggtgatatgatttcagtatatgtgcacagctgaagggtattccattgtgaatgaatactacagtttctgtatcccttcatctgtggatgaacaggtctctctccacgttgctggaagtggggtgatgtcctaaagtttgatggctgaagagtattccattgtgcaaatatcctggagtttctgtattccttcatctgtggatgaacacgactgctttacatttggcctgtgccaatggccatgtggaagtggtcactctccaggtgaactgaaagtgccagactgacattggtgacaaatgaaacaggatgcctttgatgaaggctgtacattgccaagaagagatttgtgtcatcattctgctagaatgtggcaccaacccagatcttatggatgtctatagcaacaatgcactacactatgctgtgtataatgagaatacactactggcagaaaaactgccctcacaccatgtgaatactgaagtgctgaacaaggatactgaagtgctgaacaaggatgcaaacacaccacttttacttgctatagtttgcaaaacacagcaaaaggtggaattttagtgaagaaacaagcaaatgtacatgctgttgataggttgaaaagaacagctctcatgcctgttgtacattatggcttgtcaggtatagttagcattcttcttcaacaaaatattgtctttactcaagagtatgtatgaacagactgcagattatgctatttctggtggtctgacaagcactcacaacaaattttgcaacattaaaaaaaaaagatacttgaaaatggtcttcaaaatgacaacccagaagaagcatccaagaagaatgcaagtttgaaaacaggaggagcaagtgcaaaagattctgggagttctgaagcatctgcattcagtatttaaaaaaaaactgtgtgttgactcatggcctaaaccagatgatgaagacttgacttttactaccaagcagtgtatccctgagagtgtttcaaagtctttacttggaccttcatataaaaaaggaaaaaatatatagtaaatggaaagggagaagggcctcctgaaaaacatccttccctaaagcctaccatggaaatgaaagattctgttgtgaagaaagcaatagaaaggaagaacgaacaaacatccaaagcagaacaagaagtacaagtgacatcagaggaagaacaggaaaagcttgaaagtgaaaataaacagccacaggttgaagaagctagaaagaagcacgaaagttaaaaaaaaaaagtatcaaaaaaacgtatatgatagtacatctgctgacgatgatgataaattaattcaacaaagaaagagtggaaaaacttaccatcagcgatttcctaggaaggagaacaaagagtatgctaggcctgcaaagaaaatgtcaaatgaaaagaaaaaggtcaaaaagcaaactcatttagagatgaacctgatgacttaactcggccctctgaaacagcttcagaggatcatgagaaaccttaccctcattgtaagaagtttatgatgctcattaagcaatatggaatggattgtaatgattctcgtatcctaatggaagtccagaatgcatttctttcatgtgaaaagtcactggaccttaaaaaaa

SEQ ID NO: 6611 - DNA, 2149 bp, Homo sapiens
ttgtatcttaaatacaatcaaaacttcatgtttaatagggattcatctgtttcccatactttttacatgttcagttcagacagaactcatggaagaaaagacttttctgtgagatagaacagaccatctgcttgaccggatggctctgagggacagccaaactcccaatggccaaagggctgtgaggaagggcaacacgtatcagaagaattttcagcaagggctgaaacacagtaaggttagccacaaaatggaatgagagaagccctaacccaatgggagtttgcctaattttaatgaacccaaactctaacattgtactggaaaagcagcattaaaatccagcctgattatcacaatttacagaatttctcaccagaggcccacaggtgaaaaagctgcttactctaaagcccttagaaccgtattgtgaactgcgcatgcgagggatctaggttgcgtgctccttatgagactctaatgcctgatgatctgaggtggaagtttcatcctccaccaccaccccgtccatggaaaaactgtgttccacaaaactggtccctggtgccaaaaaggttagggactgctgctttagaatataagaaacaactcaagcagccaacgggtctggagttaacacttccagccctcccctttgtacacactcaacacttcttgctgaactggccgttaataaccacttgtgaaatccctccccacacctgcacttaggcgtttgtctcttcctaccttcctttactgagtagtggcaaaataataggagagtggaagatggtgatgggcaatgaagagggacctatttctgaagaggagatgttttaaagatattttatttttcaataccagtaatgactgaaaattaaagaattaaagcaggaagcaaaacaaaaacaaacaagaaacccaaaacttgcaacctaaactctccgggaaacaaaaaaattgctataaatgttaaaagacttaaagagaacattgacaatgcagccctgatgtacctaatcatacttcaaactgctggatgttttaagctgagaatctccccagtgcctttctagtgctctaaaatcatctcccaaacagatgagaaatgaaacaaacaggtctcccttcttgagtacataatttttataaattgcgtcggacccacagtgaatgtattttagagagtttcaccaaaactatcaaagatcaaacggcagcaaaagatcagggaaagaaggtagaaaaactatgcagtcacagagctaacccgcaagctgcccttagtcctatacacctgaaatcaaatccatagccaatggtgaggaagaccacatcagaggttagctgcatgacagcacagctgggtcctatctccctgccaggggtctcaactgtaactcgcgctccaactgctctgcagtcagggtgccctggatggcttcacagcctggattgaacacagagtaggcgctcttctctccctctttcttctcttcagggcctcgtgtcccgacgtacatccaatagaacaaggacaggacaaaatatgccaggccaaattccagttccacaaacagtcccagcaggaccaaccagagaagaaccttcaagaaggtgatattggtcaggaaagactggtcccagcacgacggcagaggaatggctgtgttccatggtgtctctgatgtgctgccctggggctgagccgcttcctaggatacacaaacaaacaaaagaaagaataaagggtaatggagctgagatgatcaaaactaatctgaaaaggcagttttcattgctctgagaaggctgctggctcattgatttctattctttcatgcaactctctaaaacaatcatctccaaagaacctatgtgctctactccaactgaatcaaaactgatcagcacttagtgagatgtgacctaataaaagccctacgtattcagacagattcttattcgtgggagtcatttcttcagattagtctgctgctaagaagagctaatttgtgccccatacagaaactcctgaataactgataatgcaacagtcatgacaaatgcttcaaatacagagtcaatatacctttgttgattggattagatgacctaaaatattacaagtgacatgattctaaaa

SEQ ID NO: 6612 - DNA, 732 bp, Homo sapiens
gatctgatgcatgaaaattgcttgttgaagagagatattgcctttattgtgtatgtaagtatacacaataaaaaataggaacctcgaaagggaaaaaggacattgaaattgttaaagaaatgaatgatgaccttcaagagactataaaactgaatggaaaaacattaacaaaaacagtatcccagtatggtcaacagcttaacgacctcaaaactgagaatacaatgctcaagtctaaactggagaaggaaaatcaaaacaaggaaagactggaagctgaagttgagtcattccatgctagactggctgctgctataagtgagtgtgatcaaagtgtgaaaacaaaaagagacctagaacttgctttacagagagcacaagacgtttctttacaagaaagaaaatgagttctgatatttctgaactaaaagataataatgagtttttaactgagcaactttccgaagctcgaattcaataccctaaaaagtaaactccatgacacaagaaattctctcagagaaaaggttttggttttataaagtgtacaaaaggacctaagccaagtaaatcctttggaaagtgggactacgtagaggagagaatatctcaactacaacatgaaaatctgttgcttcaacaactagatggtgctcataagaaaggggataatgaacaaaaggtaattaatatccaaggatgctgtcttgagagtgaaaaggaaggtcttct

SEQ ID NO: 6613 - DNA, 566 bp, Homo sapiens
ttttcttcctattttaacatttattgtttacgtcagcggctcttaatctttattgtgccagagatcacacctgggaggctgttaaaatgcagattctcaggattctaccctcagacattctgagtcagtgggggccctggaatctgcattttaacattactacaggagattcctatgcaggtgcgtggtctatagaccatacttttcaaaacgttcatccatgacttgttaaggaaagagtatttttcacatagaagtgaaaatcctatatagtatagaatttaggactgcaagtgatctctcccttgaacacacacacacacaccttacacctttataaacattcacattatgtcctgtactttataatacagtttgtgtgcactcatcttgtcttctctctcagatttttgagaatgggatccaagtctttatgtagcctagtgctccaaagttgtgaaataaaattatgtgtgatagaaaccaaagcatatggttcaaaagttactttctttggcttagggagttggttttctctgccaactatgtaaattcttagtcattcc

SEQ ID NO: 6614 - DNA, 565 bp, Homo sapiens
gtgaggaataaatagggaaaggggaaaaactggaagggggaatcattaggacccagctgcacagacatttgcagctaaaggagtggagatccagacgatctccgtgggactgggagcagctgtgtttaggattgacactgggggaacaggcagagggaagcatggtcttggcattggcagttttcacattgttggcttctgtctgttgccagcttcattctcattctttctatccttgtatgtcctgtttttactcttcattgtcattttagtgggtttccaggaggcagcagtgataaactgcatgcgtttagtatgccatgttttcctggagatcccactgactttactttcagtaacagtggttttcatttgccaactctggtgtttccccaccatgcaggtaagatagttaggctctaaacctattgaaatctggggttttcattttcatagggcacttatttatccttattcatatatgggaagtttatctctctgtgccaataggcagagtttttggctcatttttatggagtttttagctataagagagaacttgctt

SEQ ID NO: 6615 - DNA, 902 bp, Homo sapiens
gtgaggaataaatagggaaaggggaaaaactggaagggggaatcattaggacccagctgcacagacatttgcagctaaaggagtggagatccagacgatctccgtgggactgggagcagctgtgtttaggattgacactgggggaacaggcagagggaagcatggtcttggcattggcagttttcacattgttggcttctgtctgttgccagcttcattctcattctttctatccttgtatgtcctgtttttactcttcattgtcattttagtgggtttccaggaggcagcagtgataaactgcatgcgtttagtatgccatgttttcctggagatcccactgactttactttcagtaacagtggttttcatttgccaactctggtgtttccccaccatgcaggtaagatagataggctctaaacctattgaaatctggggttttcattttcatagggcacttatttatccttattcatatatgggaagtttatctctctgtgccaataggcagagtttttggtctcatttttatggagtttttagctctgtgagagaacttgctttatacaggggtttcacttcaaaatttctgcctcggccgggcgtggtggctcacgcctgtaatcccagcactttgggaggcccaggcggacggattatgaggtcaggagatcgagaccatcctggctaacacggtgaaaccctgtctctactaaaaaatatgaaaaaattagccgggcttggaggtgggcgcctgtaatcccagctactgagaaggcggaggcaggagaatggcgtgaacccgggaggcggagcttgcagtgagccaagactgcgccactgcactccagcctggacgacagagcaagactccgtctcaaaaaaaaaaaaaaaaaaaa

SEQ ID NO: 6616 - DNA, 2017 bp, Homo sapiens
gattttactgtttaatagtacaaaatttttgcaaaattagcagataatactcatcatttctaacttctgaaatcttttgtttaggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagca

SEQ ID NO: 6617 - DNA, 2017 bp, Homo sapiens
gattttactgtttaatagtacaaaatttttgcaaaattagcagataatactcatcatttctaacttctgaaatcttttgtttaggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataattgtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagca

SEQ ID NO: 6618 - DNA, 2017 bp, Homo sapiens; identical to SEQ ID NO: 6616

SEQ ID NO: 6619 - DNA, 1584 bp, Homo sapiens
caagagaaaattttataattatgataggactcctagctcttataagaagtggcctttataatgccacctttagtacttttcagcattctacaggtggacaattcaagaactatatttgtaaaataatgttttaaagagagccaacggtaaaggcaggaaatcactcaaaacattttgtatgttccagagactactcaaatattaatcctgttttcaggagtaacttcgtaggcgtggaaaagatttttgtttatttagaccaattcattatttattaacttcattcaataaatagttacattgtacctactacatgccaggcactatgttagtgagtttgttcactcagtcagccagctctgtaacatggaaagaaatgggaacaatttcacctatctcatagccacctgaaatagctcagcatagatagttttctgttcatttgcttctcaggctgttccctcactcactcattcactcattcatttgcttattcatcaagtacccattgagggcattctgggtgctgaaccctgtgctgggtaggcactgtgcgggtgtgagttgtgttctgaagggtgaaggctgaggatcttgagagcccagaggagggatccagcccgacccgagggaccaggaagagtggtctggaaccagcaccctttggacctaggctagaggccgagcaggaaccattgaggagagaggcaggaggtcagtggcccaggcgggaaccctcacacccaagccccaacatttttattttgttttgggaaatgtataggattaaagtaataactggaaaggaaataaatggaaacacggaatggaaacatttcctattttccctattgttatctgaagacaaacttaatttttatgttgctactttctctcttaaatatcctcttactaaatagtctgtcgtattaattagactgggtagtcctaactcaagaaagcatttggcaattaaaagatggaggactcagggtctgaccgttttccttggccttcatttggctttctctctcttttctcccctccttcttcccaggcctggctggctggtgcctggacaccatttggggctctgagagggttgtggctgccagcccccagtcgccaatgcctggtcaggcactcgtatcccctgtcctgttcaccatttctcctttctcattgttctcataatttgtcctgcttaaaactcctaggttctaagggacacccctgcattgcttgcctttcctttgctagacaccagagagaggctaaaaagtgaaatgtggcctggtgcagtggctcatgcctgtaatcccaacactttgggaggccaaggcaggcagatcacttgaggtcaggagttcaaggccagcttggacaacacgacggaatcctgtctctactaaaaatacagaaattagccaggcatgatgacccatgcctgtagtcccaactacttgggaggtaggaggatggcttgagcccgggaggtcaaggctgcagtgagctgagattgtaccactgtactccagtctgggtgacaaagcaagaccctgtctcaaaaaaaaaaaaaaaaaa

SEQ ID NO: 6620 - DNA, 1876 bp, Homo sapiens
caagagaaaattttataattatgataggactcctagctcttataagaagtggcctttataatgccacctttagtacttttcagcattctacaggtggacaattcaagaactatatttgtaaaataatgttttaaagagagccaacggtaaaggcaggaaatcactcaaaacattttgtatgttccagagactactcaaatattaatcctgttttcaggagtaacttcgtaggcgtggaaaagatttttgtttatttagaccaattcattatttattaacttcattcaataaatagttacattgtacctactacatgccaggcactatgttagtgagtttgttcactcagtcagccagctctgtaacatggaaagaaatgggaacaatttcacctatctcatagccacctgaaatagctcagcatagatagttttctgttcatttgcttctcaggctgttccctcactcactcattcactcattcatttgcttattcatcaagtacccattgagggcattctgggtgctgaaccctgtgctgggtaggcactgtgcgggtgtgagttgtgttctgaagggtgaaggctgaggatcttgagagcccagaggagggatccagcccgacccgagggaccaggaagagtggtctggaaccagcaccctttggacctaggctagaggccgagcaggaaccattgaggagagaggcaggaggtcagtggcccaggcgggaaccctcacacccaagccccaacatttttattttgttttgggaaatgtataggattaaagtaataactggaaaggaaataaatggaaacacggaatggaaacatttcctattttccctattgttatctgaagacaaacttaatttttatgttgctactttctctcttaaatatcctcttactaaatagtctgtcgtattaattagactgggtagtcctaactcaagaaagcatttggcaattaaaagatggaggactcagggtctgaccgttttccttggccttcatttggctttctctctcttttctcccctccttcttcccaggcctggctggctggtgcctggacaccatttggggctctgagagggttgtggctgccagcccccagtcgccaatgcctggtcaggcactcgtatcccctgtcctgttcaccatttctcctttctcattgttctcataatttgtcctgcttaaaactcctaggttctaagggacacccctgcattgcttgcctttcctttgctagacaccagagagaggctaaaaagtgaaatgtggcctggtgcagtggctcatgcctgtaatcccaacactttgggaggccaaggcaggcagatcacttgaggtcaggagttcaaggccagcttggacaacacgacggaatcctgtctctactaaaaatacagaaattagccaggcatgatgacccatgcctgtagtcccaactacttgggaggtaggaggatggcttgagcccgggaggtcaaggctgcagtgagctgagattgtaccactgtactccagtctgggtgacaaagcaagaccctgtctcaaaaaaaaaaaaaaaaaaaaaaagtgggccaggcacagtggctcatgcctgtaatcccagccctttgggaggctgaggagggtggatcacctgaggtcaggagttcgagaccagcctgacctacatagtgaaatcctgtctctactgaaaatacacagttagctgggtgtggtggcgggtgccttgtaatcccagctattcaggaggttgaggcaggagaattgcttgaacccgggatgcgaaagttgcagtgagctgagatcatgccattgcactctagcctgggcaacaagagcaaaactccatctca

SEQ ID NO: 6621 - DNA, 1876 bp, Homo sapiens
caagagaaaattttataattatgataggactcctagctcttataagaagtggcctttataatgccacctttagtacttttcagcattctacaggtggacaattcaagaactatatttgtaaaataatgttttaaagagagccaacggtaaaggcaggaaatcactcaaaacattttgtatgttccagagactactcaaatattaatcctgttttcaggagtaacttcgtaggcgtggaaaagatttttgtttatttagaccaattcattatttattaacttcattcaataaatagttacattgtacctactacatgccaggcactatgttagtgagtttgttcactcagtcagccagctctgtaacatggaaagaaatgggaacaatttcacctatctcatagccacctgaaatagctcagcatagatagttttctgttcatttgcttctcaggctgttccctcactcactcattcactcattcatttgcttattcatcaagtacccattgagggcattctgggtgctgaaccctgtgctgggtaggcactgtgcgggtgtgagttgtgttctgaagggtgaaggctgaggatcttgagagcccagaggagggatccagcccgacccgagggaccaggaagagtggtctggaaccagcaccctttggacctaggctagaggccgagcaggaaccattgaggagagaggcaggaggtcagtggcccaggcgggaaccctcacacccaagccccaacatttttattttgttttgggaaatgtataggattaaagtaataactggaaaggaaataaatggaaacacggaatggaaacatttcctattttccctattgttatctgaagacaaacttaatttttatgttgctactttctctcttaaatatcctcttactaaatagtctgtcgtattaattagactgggtagtcctaactcaagaaagcatttggcaattaaaagatggaggactcagggtctgaccgttttccttggccttcatttggctttctctctcttttctcccctccttcttcccaggcctggctggctggtgcctggacaccatttggggctctgagagggttgtggctgccagcccccagtcgccaatgcctggtcaggcactcgtatcccctgtcctgttcaccatttctcctttctcattgttctcataatttgtcctgcttaaaactcctaggttctaagggacacccctgcattgcttgcctttcctttgctagacaccagagagaggctaaaaagtgaaatgtggcctggtgcagtggctcatgcctgtaatcccaacactttgggaggccaaggcaggcagatcacttgaggtcaggagttcaaggccagcttggacaacacgacggaatcctgtctctactaaaaatacagaaattagccaggcatgatgacccatgcctgtagtcccaactacttgggaggtaggaggatggcttgagcccgggaggtcaaggctgcagtgagctgagattgtaccactgtactccagtctgggtgacaaagcaagaccctgtctcaaaaaaaaaaaaaaaaaaaaaaagtgggccaggcacaggggctcatgcctgtaatcccagccctttgggaggctgaggagggtggatcacctgaggtcaggagttcgagaccagcctgacctacatagtgaaatcctgtctctactgaaaatacacagttagctgggtgtgggggcgggtgccttgtaatcccagctattcaggaggttgaggcaggaaaattgcttgaacccgggatgcgaaagttgcagggagctgagatcatgccattgcactctagcctgggcaacaagagcaaaactccatctca

SEQ ID NO: 6622 - DNA, 2595 bp, Homo sapiens
caattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggaggtacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaaaaaaaaaaaaaagtcttccctctgctttattctcactttcttaaaaacacttattctgggtggtactttttaggtaagaaactactgagtttcaggaaaaatgctagctactctgcagttaccgtgctttggacttgcagttatcatagttttgggagagtcagtattgtttaacaaatgcaagtgagaactagaagggttaataaagttgctccttagagtggtgtcaaaccagaaccgagacacttaaaaagtacttcattttttgaatggaaaatattggagaaaagtatgggagatgcaggtagcatgtgagtaaatactacggtctagccttcgagcatcccaaattccgggggtaacttgacagtgctgtgctctcctttgtcatttatatctggcttaggaatggaatagtaataacaagatgccagtgatttggaatagtttgttatagaacattcagtgcaaaatagtgaaaatgtttggtcttcagaagtgctgtagttgttggtcattgccttaaagcagtctgcttgacgctaggagcactgaa

SEQ ID NO: 6623 - DNA, 3998 bp, Homo sapiens
gaagggagaagaacccttgttcaggaagccttagaaagggatccttaaaatagtactctacgcagacaagtgaaaattcttttaaactggatattactcaacatgttttcagatgtttccactacattgaggcaaactttttaaaagtggaatgcaaatagcattttactttagtatttctgcttttttctttctgtttctttggtaattgaaagtttgttgatgaatatttgtgtaaaacgcattcaagtctataacctttccaattacctgtggcccttagtcccacaggagtccctgttggaagggggtaaacactggatattaatgttgctgagtgagtctttctagccaggacaagctgattggaatttttgaatggtagagaagaaacagcacaaaggcacttgccattttaagtgtttggagaaagagaaccttttaagtttggattgggtgagctttcttctaaaaggagcttctgaagtaattgcaaaggaatagaatcgactatttttatagtatatttaatatatttgtatataactataataggaaccctctacatgcctcccacttttctaatttacttccccttttgccatagcactagtatagcctcatccgcatgggtaatgtgcctattgtcagcctaccaaaagatagtgctgctgctttatgagacaggtgagaagacccaactctcatgcctggggatcctttacggaaggaatagcacacacttttaaaacaacataccacagtctaaaagcatcattttgaaatgtaacaagcactttattgcaattactcattttgataaagtttattcttaggcgttaaccatttctaaaggatccccaaatcatcacttacttaggtgaaattatataaaatgacacatttctgagaaatgtttaggtccagtgaaccgtagttggtttatgggagtgatttcaagatagccaaatgaactttgatttttgttttgaatgtggtggagtcaagagattgtagatgcctagtttgatttaaacactattgtaaacctatcttgcctattgtgtggacaccaaaagagaccaatgagcctgtttatttttcagaggtctaggaaaattgcatccgtgtgagtagatgtacagaactaatctaaaagtgattgctagtaacattttagaatataataatttcaagaattattctgagtgttttaaatgtgccctgaaatgttggcatgtcatttcagcatttccatttgaattgctcttgtaatatttttgcacaaaaaggactgagaaaaagaatactttggttaaaggaaaaaaatagtataatttggtctttaattttaatgtctcctgtggaaacactggggatgaattttgttggcacagttattcaggatatttaaaacagtgttgaacagttcacaagaaattaagcaaacttggattttaaaaattaaaatactttctttccatgtgactgttttgcatagttttttccccctatgtcataacactacattccttgtttttcttaaataaaatactctgcaggttttgttgtgagtgtttataacagtattttgtaagctgcctgggtttcctcagggaaacattatttagtggaataggatatagtttatggagagacaactaagtgaaattccatcaccaccaccagcaaacactgaggtgctgcattaagtgacaatcaaactagtaagtatttatgaaagaatttagaaaggggttcaaagaagcaattgcttttaaagcagttctctggggttcttgaataaaaatggctaaatgtatttatttatattttaaaatacctgtgtgttctgttttctcatcaaagtgatttcggtgtcatgtatttaatgtgtggtttgttttgttttgcaccatattcttcttagggaactggctctgatttggggtgcagtcaccaactctcatgataatctttacggacagtctgaatctactttacttcaggacggcagtggaggggccaactccagatgcccctgcacttccctcctcaagtcatctaagaaagaattttagaaataactcctttcaaatctgattcatacagttccaacctttttctagtttcacttgctgccttctttgttttatgggcactttttgtgtgattacttccccaacacagtcaaaggccagtatgacagaaccaatggcacatgatgcctctattttgcccatttggggaaatgttagtaaaagaaatagcatcttttaatggctgtcattatcatatccatattaaaatccatttaaagttcttaaatttggcggaataatgtatacaggctgtaaacttctacaaaaaatgtttgctgtctttaatatggtgtcaagttacttggtcctttgaaaacaaaacaaaacttccatacacagcactgcccagtaaagcagtgttggaatattggaaacctagacatttgaggatccttcttgctcacaagcattggaacagaatcctccactttaggactcagagaagctatggagtcccacaggctaggtatagcacacaacttagagaacggtagttaaagcacgtcaaccacaattgaatttaatgatctaaaaaatatttcttaactctgagggttaaactgaagatacgttttcaaataaaagcttttaaatttcttaggaaacaaactgtgacatcgcttttaaaaatgacattcaaatgtttataatgtgtgtttttgagttggcttggactagtgcaagttcactgctggcaatggttatgccagtagttaagttaaaataagttgttaccttcagattgatgtcttgtataaccagacaatcatcttcaagcaaaaaaattggccaggaaatgtctttttaaaaaaaaaaaaaaaaaaaaagatgtgtcagccagaacagttaccattcagaccatactggaatgattttgaaatctttactatggtttaagttggggaaggcctcagtatggcattttcatattcactctatgtaaagattgaagcccaaagatgagttaaattcagtgctgtattgaaccagtcagtgcaaaaaaaaaaaaaaagtttacctttgtaatttttcatggtaacatcagttggtagtgtttaaaacatgcaccaaatcctttataatgttctgtgtggtcctcaatgtgatattcttgacattgctgtccttactgcttggttcttggttttaaattaaaaagtagatgtagctcatcatttttacttccaaaacggtggagctaaaaacggctaattgatcttgagataagaataccctttactaaggcaaagatttaattgaaatccaaaatgatttatagaaacgaaaggcattttccatttgttgtcttctgccgaaattctgaattgcatacacacatgaaggataatgaatggtttcaacggtgctatattaggttctctgattttcatgacctatgtatgtttggaaatacaatattgtataaaatgtggatcgttttgttaccgatttaatattgccattttaatttggtgtaacaattggttacacttgtttttcaaagctatcctttgaggagaaagtcaaaatgtgttgttagcctacctccactcaggcctcttgctgtgtaatcattattccaggttatgatgtgcatagcttttaaaactgcgtgtactattattctgctctttcccatactcttgtcatgtattcagaacctaaacttatagcaaaagagccaagcagtagcagtttttgtaaatgtaaaaataattagatccagactttgtttccttcaattttaaaaataaaaaatacctcagtgctatgtttttcagttatcacctgcatttctcaaaaaataacacctgcttcatgtggcacataacttgtaagaatcacattttggattttaaagaaagactattaaatattttaagatcactatcaatg

SEQ ID NO: 6624 - DNA, 777 bp, Homo sapiens
tttttagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaa

SEQ ID NO: 6625 - DNA, 3412 bp, Homo sapiens
tcttctagttccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaaggtaagaatgtgtatttgcgtaacttcatttgcagtttggaactagaaactgctccagacacacgctgacttttcctttggctcactttaaccttagtaagacactaccctttatggcctgacttgtgctctcctccctttgaaaagtgatggatatccctgtgtgggtcaggtccccttctctctgatgtcattttcttcccttactccctcatcactatcactcctaagacgctctttgcttttgcttttaccagataagctctgtctccagagcttttgtagctttctgctcccaagttatttgcatggcttgctctgtgcctccctcaggtctttgctcagatggcagctctatccaaaaattgtagggcggggggaggttgactttttggttcattgctgtgtatccccgatgccaagaactatgcccaatacaggtaggatctcaaatatttgttgaatcagtcatttttaatcaaaatatggaaaaatgtgtcaggcgtatgtgcacacgcacaccctcctcccacacatttatggtttgaaaagcatcttaatgacattcacctggggctttatcagcttatgttggtaagttcagtatggtccaggtagtaattttttttttttcccttcaaagtttcagagtacttcaaaggacatttagtctagctcttggtcatgatgttcccttcttgaactggatatcatggagtatcttatattaaaaatccataaaagtggtttgaggagagattggtagatgaggaaataaagacaataaatacagacagctctttcaagaaattaggatatgaaggagaaggagaaaaccatagtaaaaagtttgaaagaggtggaacaagcaatttttttctgtctttatgcatttatggatatataaatagttttattttgttttgtttgtttagaagtaatagatgctcagatcaacaacaaatttcgaaaaacagaaactattgaaaaatagaaaagtaaagactgacccataatcctactgccagatagaaataattttggtacatgtttatttattcagtaagttttggcttattctgctttgtaaatgcagagctgtgtcatcatgctgatggctgactagaatcacattatttgatgtatatggttattgtagaccatacatttatccttgactatgtgtctccaaactaaactcttggaaaggtcactgctagacaatgtgagatggtctatttccccaaacttaagcaaatgctaggtattattctttttaattgttttaaatttaaattttttattttatctattctttttagagacagggtcttgctcttttgcccaggctggagtgcagtgttatggttgtagcttgttgtaacctcaaactcctgggctcaagtgatcctcctgccttgctaggactacagtgcatatcaccactcccagataatttgaaaaaaaaattgtagagacaaggtcttgctatgttgcccaagctggtcttgaattcctggcctcaagttttcctcctgcctcggcctcccaaagtgttgggattatagatgtgagccactgcactcagccaaagattctttttaaatgttttgcgaatatgataggcaaatcttcaattactaataaggttttgaaaatgtcttcatattcatttgctgtttgtattcaacagagtaaccatttatgtttttaggtcatttttctagccaggatcctatatttttcttattttaaaatatgttttatacattaagggtattggcccctttatttatgttgcaaattttcttgtgcaaatacaacatgcatgacactttgccatgaactggggctctgggagataagcatgcagtgaagacccgtaagtgtgaaccacaaggtacacttgagatggtgccagtggcttctcattactgcagtggaagaacatagatgggagagtaggtcaaagtgagtgatgtgactcataggattattaacaatctctctctctgtttttcttgtctctttttagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaata

SEQ ID NO: 6626 - DNA, 3412 bp, Homo sapiens; identical to SEQ ID NO: 6625

SEQ ID NO: 6627 - DNA, 2632 bp, Homo sapiens
gaattgtactgtataaactcgaattattcttcagctattttcttctcatttgtattatgttgtactatatttgggctttggtacttaaggtctgatctcagcaatctgaaacagcctttgcaccgcaagagtcttccccaaacattcctttttttttttttttttttttttaaatattgctcccattatgcccaagaatcaaagattcttttgtttgggtggaggactctctgtccacttagctccctcccaactcagctacagattaggtttgtttcaataacataaggactgttctccaaaagctctggcaactgtggacaaaaagggcttcttcgagctattacacaacatgtgactttgctaaatcaaacctttatttataagatatggaagaatcagttatttgtgtgataagacatgcgaattctaggatagtaggacctaggcagatgtccacatgaacttgagggactttaaaaatcttaggattttaactataacccactttactccaacaaaatagaccaaatagctaatacttacagaatacttaccctgtaccaggcactaagtactttatatgtgcgaaattaatcctctcagctctaactttacaaacgaggagacggagacacaaagcagataaggaacttgcccaggatcacaggtgaagtggcagaggctcgccctagctgccaacagacaccgcccccatgccaggctgctgcccatcgtgagcagcagtcccatgctaccaggctccgggtagtcaagaggccagcagtgttacaggtaggctgcatcatacagtcggcaggcttttgtgagctagcctgagaatctttcacaacactaaaatttgactgcgtcttcccacaggaagaaacactggacttccaatactgataataacagcagtagctaacattctaagagcattacctacgttaattctttgaatcctcagaataccatgaggtaggtgttattattacccctattttacagatgaagaaactgaggcacagagagtctttgtaagtaaccaacagtttagtaagtgggagatttgagattccaacccaggcagcctggcttcagagtcttggctaccggagtttttaaccctcacattatgctgccctcagaatgcttatttaacctttctccacatgtatggaggctaaccggacaaccacgttagcaattatgaacacaacagtccgtagacaagatgcgtaaccccactcaccgttgggaagtcctccagcacctggcgatccttctccttgctctccatgaaccgccagtctggttggtaaaggaaagagtgaaagttgtgtaacagcgggaccttcttttccacactgatggtcatgtcatcttccagtgtgtccagagctcggagaaccagataaaatatgcacactgcgttgctgtaaaaaagggaaaactattaatatattggaacaaacagccaaagattttttattttaaaataacttgtgcctggccactttctaaacccatctcacccttaactctaaagaactataaggatatccaacgcttttcatacttaacgaaagttacattagttttccttccttacatgagagtaatgaacttctgtagtttattaaaaagcctactagttgaatgtcaccactactcccagaagtgagttgcatttaaccaatgtagaactatggagaccagaagaccaaacgtttagaccgaactaatatgtagcaaatagaaaagaaagtcaaaaaacacagtaacttctcagtataaatacgatcatacataaaggcaactggtctaagttcatgggtgtaatgtgcacagaggcagcttcaaaagaatcaacccaatatgctagaaatagaaatgcaaagttggataagggaagccgagaaatacacgacctgctcacaggcaggttcagctgccaagactaaaaaaagttaataaacatcaccccctccgccctcttctctgaaaggctgggcccgcagggactctactagatggcaaagagcctggaagggctttctaaagtaaacacgtagggccgggctatgttctggataagccacagcaacgaggctgcaacgctgagcgctatatcaaaaggtagcttccaacacactcaaaggtcccggacaagctttcctccaagccagaggcgctgcctccatcactcaccgcatttccccatccagcgcctggataacagctgcgaaactgcgactggtctgattgagatacttgtagcaagttttcaggctgctgctgagcgagtcctgcgggcagacaacacacacggcggtgggagacgtcgaggagcaggagtgggagtgggagtgggagtgggagtgggactggggcaggcggctccacagcctgccgccctctccccgaggccagtccttgcagggccaggcggcaggaggcaagcagcagccccgcggggcggtgcctgcgcccgggcccctgggcgccgcggcgggactcagcaccaaggtgcgcttgaagagggccatggccttggtgccgcaggcggctgcggccatgggaatcgcggaccccgcggagtttttcctccatagactcaagcagatct

SEQ ID NO: 6628 - DNA, 8852 bp, Homo sapiens
gaattgtactgtataaactcgaattattcttcagctattttcttctcatttgtattatgttgtactatatttgggctttggtacttaaggtctgatctcagcaatctgaaacagcctttgcaccgcaagagtcttccccaaacattcctttttttttttttttttttttttttttaaatattgctcccattatgcccaagaatcaaagattcttttgtttgggtggaggactctctgtccacttagctccctcccaactcagctacagattaggtttgtttcaataacataaggactgttctccaaaagctctggcaactgtggacaaaaagggcttcttcgagctattacacaacatgtgactttgctaaatcaaacctttatttataagatatggaagaatcagttatttgtgtgataagacatgcgaattctaggatagtaggacctaggcagatgtccacgtgaacttgagggactttaaaaatcttaggattttaactataacccactttactccaacaaaatagaccaaatagctaatacttacagaatacttaccctgtaccaggcactaagtactttatatgtgcgaaattaatcctctcagctctaactttacaaacgaggagacggagacacaaagcagataaggaacttgcccaggatcacaggtgaagtggcagaggctcgccctagctgccaacagacaccgcccccatgccaggctgctgcccatcgtgagcagcagtcccatgctaccaggctccgggtagtcaagaggccagcagtgttacaggtaggctgcatcatacagtcggcaggcttttgtgagctagcctgagaatctttcacaacactaaaatttgactgcgtcttcccacaggaagaaacactggacttccaatactgataataacagcagtagctaacattctaagagcattacctacgttaattctttgaatcctcagaataccatgaggtaggtgttattattacccctattttacagatgaagaaactgaggcacagagagtctttgtaagtaaccaacagtttagtaagtgggagatttgagattccaacccaggcagcctggcttcagagtcttggctaccagagtttttaaccctcacattatgctgccctcagaatgcttatttaacctttctccacatgtatggaggctaccggacaaccacgttagcaattatgaacacaacagtccgtagacaagatgcgtaaccccactcaccgttgggaagtcctccagcacctggcgatccttctccttgctctccatgaaccgccagtctggttggtaaaggaaagagtgaaagttgtgtaacagcgggaccttcttttccacactgatggtcatgtcatcttccagtgtgtccagagctcggagaaccagataaaatatgcacactgcattgctgtaaaaaagggaaaactattaatatattggaacaaacagccaaagattttttattttaaaataacttgtgcctggccactttctaaacccatctcacccttaactctaaagaactataaggatatccaacgcttttcatacttaacgaaagttacattagttttccttccttacatgagagtaatgaacttctgtagtttattaaaaagcctactagttgaatgtcaccactactcccagaagtgagttgcatttaaccaatgtagaactatggagaccagaagaccaaacgtttagaccgaactaatatgtagcaaatagaaaagaaagtcaaaaaacacagtaacttctcagtataaatacgatcatacataaaggcaactggtctaagttcatgggtgtaatctgcacagaggcagcttcaaaagaatcaacccaatatgctagaaatagaaatgcaaagttggataagggaagccgagaaatacacgacctgctcacaggcaggttcagctgccaagactaaaaaaagttaataaacatcaccccctccccccccttctctgaaaggctgggcccgcagggactctactagatggcaaagagcctggaagggctttctaaagtaaacacgtagggccgggctatgttctggataagccacagcaacgaggctgcaacgctgagcgctatatcaaaaggtagcttccaacacactcaaaagtcccggacaagctttcctccaagccagaggcgctgcctccatcactcaccgcatttccccatccagcgcctggataacagctgcgaaactgcgactggtctgattgagatacttgtagcaagttttcaggctgctgctgagcgagtcctgcgggcagacaacacacacggcggtgggagacgtcgaggagcaggagtgggagtgggagtgggagtgggagtgggactggggcaggcggctccacagcctgccgccctctccccgaggccagtccttgcagggccaggcggcaggaggcaagcagcagccccgcggggcggtgcctgcgcccgggcccctgggcgccgcggcgggactcagcaccaaggtgcgcttgaagagggccatggccttggtgccgcaggcggctgcggccatgggaatcgcggaccccgcggagtttttcctccatagactcaagcagatctgggaagcgcccgacgagaggcgggacgggctcgccctctactcgaatacgcgctgggccgacccacaacgggcccgccccgcagccccgcagccccgcccccggcctcccgctccgcaccggcgcctcctcccgctgttgcccttctcaccagaacccactggccgctaagagaacccagcgcacttccgagcggctcgctcgtcctcccagtgacagagtctccctagaccaaactctactcgggctccgctgaaatcctcttcccaataaggcctggactttgtactcaacgcatctgtctttgcatcgcccaattttaccaagaatcctgctaaattgatttgaccagaatcccccaacttcagtatctgatcaccctagacagccgattaggttccacatccccctccatccctcaggtgatgtctgataactctggcctgccttcagcaagaacgcacacccctgtgtttcctcgtaataattttccatccactgacatccggctcccccgccatcaattcctacttttctttgtattcgcagtggagcagttctgtaccgaggtctctctcctcttactgcagtagtttttctgaataaaatctgttttgccgttttactaccactgtccaaccctggtttttctatgacacctattaagcctctactattctctagaaagccagccattcctttcaagatgtcttctcatctttcccttcgaaattaatgcaatgcagcgcactgacctttattcttccctaaagcaaacaaggactgtgtttttccaaaagggagaaaaagcctgattttaaatgcaagcatatcagaaagagttgctgtttgtactatgtattttttcatggactatttttagagcagttttaggcccacagggagtggaaaatacggcgggttcctatttgtcccttccctcccctcaccccacagtctcacaacagttctttttgggagagactggaatcatttatccaacagggccgggtgcagtggcgcacgcctataatccctgcacttcggaaggccaaggtgggagaatcacttgagcccaggagtttgagggcagcctgggcaacatagtgagacctcgtgttcataaaaaattttttaaaaagccagctgtggtggcgcccacctatagtctagctactgaagactagctactcaggaggctgaggtgggaggatcgcttgagcccaagagatacacgttacagtgaactatgatattgtacactgcagagtgggaccccatctcaaaaaaataaaaaacaaatatccaataggagtggttaaaaaaatatggcatatccacttctaggaaattccagtcacttcagaatggtaacagtgaaccctgggctctggtgggaggtttaagtgaactatgttgtatatatttcctatcatgaatacgtattttgccaaaagggtcaatcttttaaatcacataatcctgaaaaagtcattttattgccataaaaaatattagtaaaaacaagtatttactgggcaccataatattagtaaacttcagcgtctggcacataaatatattcagaagtggtgtcatgaataaatgaagacattcatcgaggattttaaaacaattcaccaactccttccttctcaaaatatcgagaggcaggatttcagagtgaaagaaacagaatacccgctctggactgagctccagagcagctcttcacatagcctgaccattaccaggctacagcaggaagtgtttttaactgcactgccaaatgtcatgttcagtccaactaacagtttcggggtgatgttaagccaggagtttcaatcaatgccaagacacggtccccctagatttaaaccccaacactcttcaagaacactacccctcctttccatacagccctccattctgaaagagagcaagccaagccacttactcctccagctcgtacccctgctgctctttttcctgtcacctatttgtttcagtcccttaccttgtaaacaggtttcttcaaatcaccaagaacaaaacaggaagacacaactagtaagcatactatggaaaacaacactcactaaaaatttctactgcttgattcccatgagccaggggagaaagcaagctcaggctactggtgcctgtccctcttgggtttatctattgcagtctgagattcagcacactcccaaaagctcgcaagcgggagaaaaacagggatggagggaatttagaggaagggtgtgggggtggtcaggaagacgacaagaccagactcccaggaaggggctccagcctcaggctgaaagttccacaagtgaacagctaccagctaccagccctccacggagccttcctcactttaaaatagaatagatttctccaggaggggaaaaaaaccacaaacttgagaactgaatttacataaatttacataatcagattgataaccaccatttatcaagcacttaactccatgccaagcacaatgcggacatcacctgtgatccttactcaatcaaccctttaaggtctcaaaggcccatagtccactgaaacatctgtggcaagacctggggcagaatttagcatttttagtgttttagaaaataggcaataaaatgcatatacaaccctagtcagtgtgaagtagcacctcataattatttctttagcaaaacatttgaatatactaagtgggatgaatgaagcctcaacttcaagtcaggttttgctgccaagtgattctgagccaaactcagaaaaaattcttttcagaccatcttagagttgggaagttgtggttaaaaaatcgttaccatacatacatccctattttacagatgaagtaactgtggttcagaggttaagttaccaaggttgttcacctaacttaatagcgtcagaaatcggacttaataacagacttaagatattagtctaaataacaggatttagattggacaggagccagatctgcctgattactaacagcctgctctttccattactctcggcttttgggtgatgccacacaacttgcaggcggcatatgcccgtagatttactgatatgcacctaaaaattcagtgtaaatcaagtttactaaaccctgaaattctatagccaaatgcttctgtgatagaaataatcagccctcaatatctgctaagcgtaaattttttccctagtttgcagagagaaactggttgggtgcagtggctcacacctgtaatcccagcactttgaaggctgaggtgggaaaatcgcttgagctcaggagttcaagaccagcctgggcaatgcagcgagacattgtgtctacaaaaaaaatttaaaaattagccatgcattggtgacacgtgcctggagtcccagctactcaggatcaggaagccgaggtgggaggatggcttcagccaaggaagtcaaaactggagtgagtcatgttcaggccacagcattctagcctggacgatggagtgagaccccccccctcaaaaaaaaaaaaaaaaaggccgggtgcagtggctcacgcctgtaatcctagcactttgggagaccaaggcgagcagatcacttgaggtcaagagttcaaaaccagcctcgccaacatggtgaaaccccgtctctactaaaaataccaaaaaatcagccgggcgtagtggcaggtgcctgtaatcccagctactcagcaggctgaggcaggagaattgcttgaacccaggaggcggaggctgcatctagctgaggtcccgccaccactgcactccagcctgggtaacagagcaagactccatctctataaaaaaaaaaaaaaaaaaaagagaaactaagataatgttaagtgaagggaaatgtatttttccaatttatttcccctaattaaaggttcaggtatttttttaacggctcatggggatgtaaaaactgcccagaaagactacaactaacataacaaatactgcaccatattatcagagctagaatagctcaagtctcgcttttaaaaaaattcaaaatgtacaaaaacagtatactgtgaagtctttctctacccacttaccatgaccacccactttccctcccaacaggaaaccaatgctaccattttctctaacagtctttctgtagaaaggaaagagacatagaggaatgaagtctggacccaaatgaggtctgactgcactcagatcccttgccctgctagtatcttcctctgcagtgcttttctccacgtgaaaaactgtacattcgcttttttaaattgtctctcttccactaaaaagtaagttttataaaatcaaggtcttcacctagcttgttcactgttgtacctccagcacctagaacactatctgatatacaactggtcgtcaaatatttgttaaataaatgaatgctatatctaaatataaaaagtgacatctgccatatcaaataatagaagttattctgtagcaaaataattcaaataatgtagcaccggcaaagaaaagatgaagaaaactgaatgttctacaaatagactgaaggatgtacctgtattaaagatagcacgtgaaaaataacaccaaatgagggtgtagtctactggggacaaaaaccagaaatttattttctagtgtgtttactgaagcacatggacactgaaagaaagactccgatgttcaggcacctatcaagcctcggcctgagtcacatttgctactgtcctgttggcccaaaaaagttacagaaatcagccaggctggtccagaccagaagaacttggctgaatttgtctattcattcaataatcgcgtacgaataattttcttgttggaataaaaacacctcctatgcattcattaaacaaatagtacaggcatgaggcagataaaaatctaagtaaaaccaagttctgaccttccaccaaccacctagctaatccatagacgttagataactcattggaacttggaagcgtagataggcgattttaaaactcaggaagcaccgaggatgaagcgatggaagacagcaaggcggggagagctccggaagaggtggtgaaactggaggagtcagacttcattccagaaacggccttcatgtgatgttatctgcatagttcattccgcttaccaaaaaactcactcgtcctctcccgcgtaacccacccacattgcctcagatgtgtaaccctcgggttaaaataccggtaagcgccgatgctcacggaggggacgaaacggggagcgcaaccaccgggaaccacgcaaaagtcgctcatgcccagggcggcttgcgggggcagggacaggtcagccaggacggccacgtccacccgggccctacagggggaaggctcgaggaaagggggacgggaacacccaggcgtcggccctgctcgccgcgccccttgccccagatccgggcccggccgctcaggccctgaggccggcccagcgagctccttccccgccccgggcaagcagggaggctcggcccacctggtccatcttgggcatcaccttccgcttgcccccgatccggaagcgcaccaggttgtagaactcttcggggtggccaaggcatttcacgaactccatcctggcgcaggcggcggactcccgggcgcgactctcacctctgcggtccccaggcgctcaccggccggctggacctgtggagtaggtgcttcgaggggctggccggacagggggcaggcctagtacggcgacgccccgcccgccgctccgcccacttcaaccggcctcggccgccagcggggctagctgcggcctcgtggggtgggctgacgggcgctgattggccagggccgctcacactaggaagaccccggccaatcagtcgcggaaggagactggcgtgataacaccctagaagctcattggaggccgagaaagaggccgacgagcgggattggtgccctgatggagccgggcctttgttttcttccgcttaccccggctgggagcgcgaacgctgtggggactggaggtgaggcggtggggcttaggatgcgcatgagcccaacggtggtccgcagtcgggagagcagtgcggggctgcttcctccccacttggtcaataagtcgcccacgtgtccggcctcggtggctcctgccagccgggtgagctctgcagccgctctctgtagagcctaaaaccgtgaaaaggccgggccagcg

SEQ ID NO: 6629 - DNA, 8877 bp, Homo sapiens
gaattgtactgtataaactcgaattattcttcagctattttcttctcatttgtattatgttgtactatatttgggctttggtacttaaggtctgatctcagcaatctgaaacagcctttgcaccgcaagagtcttccccaaacattcctttttttttttttttttttttttttaaatattgctcccattatgcccaaaaatcaaagattcttttgtttgggtggaggactctctgtccacttagctccctcccaactcagctacagattaggtttgtttcaataacataaggactgttctccaaaagctctggcaactgtggacaaaaagggcttcttcgagctattacacaacatgtgactttgctaaatcaaacctttatttataagatatggaaaaatcagttatttgtgtgataagacatgcgaattctaggatagtaggacctaggcagatgtccacatgaacttgagggactttaaaaatcttaggattttaactataacccactttactccaacaaaatagaccaaatagctaatacttacagaatacttaccctgtaccaggcactaagtactttatatgtgcgaaattaatcctctcagctctaactttacaaacgaggagacggagacacaaagcagataaggaacttgcccaggatcacaggtgaagtggcagaggctcgccctagctgccaacagacaccgcccccatgccaggctgctgcccatcgtgagcagcagtcccatgctaccaggctccgggtagtcaagaggccagcagtgttacaggtaggctgcatcatacagtcggcaggcttttgtgagctagcctgagaatctttcacaacactaaaatttgactgcgtcttcccacaggaagaaacactggacttccaatactgataataacagcagtagctaacattctaagagcattacctacgttaattctttgaatcctcagaataccatgaggtaggtgttattattacccctattttacagatgaagaaactgaggcacagagagtctttgtaagtaaccaacagtttagtaagtgggagatttgagattccaacccaggcagcctggcttcagagtcttggctaccggagtttttaaccctcacattatgctgccctcagaatgcttatttaacctttctccacatgtatggaggctaccggacaaccacgttagcaattatgaacacaacagtccgtagacaagatgcgtaaccccactcaccgttgggaagtcctccagcacctggcgaaccttctccttgctctccatgaaccgccagtctggttggtaaaggaaagagtgaaagttgtgtaacagcgggacctttttttccacactgatggtcatgtcatcttccagtgtgtccagagctcggagaaccagataaaatatgcccactgcgttgctgtaaaaaagggaaaactattaatatattggaacaaacagccaaagattttttattttaaaataacttgtgcctggccactttctaaacccatctcacccttaactctaaagaactataaggatatccaacgcttttcatacttaacgaaagttacattagttttccttccttacatgagagtaatgaacttctgtagtttattaaaaagcctactagttgaatgtcaccactactcccagaagtgagttgcatttaaccaatgtagaactatggagaccagaagaccaaacgtttagaccgaactaatatgtagcaaatagaaaagaaagtcaaaaaacacagtaacttctcagtataaatacgatcatacataaaggcaactggtctaagttcatgggtgtaatgtgcacagaggcagcttcaaaagaatcaacccaatatgctagaaatagaaatgcaaagttggataagggaagccgagaaatacacgacctgctcacaggcaggttcagctgccaagactaaaaaaagttaataaacatcaccccctcccccctcttctctgaaaggctgggcccgcagggactctactagatggcaaagagcctggaagggctttctaaagtaaacacgtagggccgggctatgttctggataagccacagcaacgaggctgcaacgctgagcgctatatcaaaaggtagcttccaacacactcaaaggtcccggacaagctttcctccaagccagaggcgctgcctccatcactcaccgcatttccccatccagcgcctggataacagctgcgaaactgcgactggtctgattgagatacttgtagcaagttttcaggctgctgctgagcgagtcctgcgggcagacaacacacacggcggtgggagacgtcgaggagcaggagtgggagtgggagtgggagtgggagtgggagtgggactggggcaggcggctccacagcctgccgccctctccccgaggccagtccttgcagggccaggcggcaggaggcaagcagcagccccgcggggcggtgcctgcgcccgggcccctgggcgccgcggcgggactcagcaccaaggtgcgcttgaagagggccatggccttggtgccgcaggcggctgcggccatgggaatcgcggaccccgcggagtttttcctccatagactcaagcagatctgggaagcgcccgacgaggggcgggacgggctcgccctctactcgaatacgcgctgggccgacccacaacgggcccgccccgcagccccgcagccccgcccccggcctcccgctccgcaccggcgcctcctcccgctgttgcccttctcaccagaacccactggccgctaagggaacccagcgcacttccgagcggctcgctcgtcctcccagtgacagagtctccctagaccaaactctactcgggctccgctgaaatcctcttcccaataaggcctggactttgtactcaacgcatctgtctttgcatcgcccagttttaccaagaatcctgctaaattgatttgaccagaatcccccaacttcagtatctgatcaccctagacagccgattaggttccacatccccctccatccctcaggtgatgtctgataactctggcctgccttcagcaagaatgcacacccctgtgtttcctcgtaataattttccatccactgacatccggctcccccgccatcaattcctacttttctttgtattcgcagtggagcagttctgtaccgaggtctctctcctcttactgcagtagtttttctgaataaaatctgttttgccgttttactaccactgtccaaccctggtttttctatgacacctattaagcctctactattctctagaaagccagccattcctttcaagatgtcttctcatctttcccttcgaaattaatgcaatgcagcgcactgacctttactcttccctaaagcaaacaaggactgtgtttttccaaaagggagaaaaagcctgattttaaatgcaagcatatcagaaagagttgctgtttgtactatgtattttttcatggactattttttagagcagttttaggcccacagggagtggaaaatacggcgggttcctatttgtcccttccctcccctcaccccacagtcttacaacagttctttttgggagagactggaatcatttatccaacagggccgggtgcagtggcgcacgcctataatccctgcacttcggaaggccaaggtgggagaatcacttgagcccaggaatttgagggcagcctgggcaacatagtgagacctcgtgttcataaaaaagtttttaaaaaattttttaaaaagccaggtgtggtggcgcccacctatagtctagctactgaagactagctactcaggaggctgaggtgggaggatcgcttgagcccaggagatacacgttacagtgaactatgatattgtacactgcagagtgggaccccatctcaaaaaaataaaaaacaaatatccaataggagtggttaaaaaaatatggcatatccacttctaggaaattccatagtcacttcagaatggtaacagtgaaccctgggctctggtgggaggtttaagtgaactatgttgtttttatttgtatatatttcctatcatgaatacgtattttgccaaaagggtcaatcttttaaatcacataatcctgaaaaagtcattttattgccataaaaaatattagtaaaaacaagtatttactgggcaccataatattagtaaacttcagcgtctggcacataaatatattcagaagtggtgtcatgaataaatgaagacattcatcgaggattttaaaacaattcaccaactccttccttctcaaaatatcgagaggcaggatttcagagtgaaagaaacagaatacccgctctggactgagctccagagcagctcttcacatagcctgaccattaccaggctacagcaggaagtgtttttaactgcactgccaaatgtcatgttcagtccaactaacagtttcggggtgatgttaagccaggagtttcaatcaatgccaagacacggtccccctagatttaaaccccaacactcttcaagaacactacccctcctttccatacagccctccattctgaaagagagcaagccaagccacttactcctccagctcgtacccctgctgctctttttcctgtcacctatttgtttcagtcccttaccttgtaaacaggtttcttcaaatcaccaagaacaaaacaggaagacacaactagtaagcatactatggaaaacaacactcactaaaaatttctactgcttgattcccatgagccaggggagaaagcaagctcaggctactggtgcctgtccctcttgggtttatctattgcagtctgagattcagcacactcccaaaagctcgcaagcgggagaaaaacagggatggagggaatttagaggaagggtgtgggggtggtcaggaagacgacaagaccagactcccaggaaggggctccagcctcaggctgaaagttccacaagtgaacagctaccagctaccagccctccacggagccttcctcactttaaaatagaatagatttctccaggaggggaaaaaaaccacaaacttgagaactgaatttacataaatttacataatcagattgataaccaccatttatcaagcacttaactccatgccaagcacaatgcggacatcacctgtgatccttactcaatcaaccctttaaggtctcacaggcccatagtccactgaaacatctgtggcaagacctggggcagaatttagcatttttagtgttttagaaaataggcaataaaatgcatatacaaccctagtcagtgtgaagtagcacctcataattatttctttagcaaaacatttgaatatactaagtgggatgaatgaagcctcaacttcaagtcaggttttgctgccaagtgattctgagccaaacactcaaaaaattcttttcagaccatcttagagttgggaagttgtggttaaaaaatcgttaccatacatacatccctattttacagatgaagtaactgtggttcagaggttaagttaccaaggttgttcacctaacttaatagcgtcagaaatcggacttaataacagacttaagatattagtctaaataacaggatttagattggacaggagccagatctgcctgattactaacagcctgctctttccattactctcggcttttgggtgatgccacacaacttgcaggcggcatatgcccgtagatttactgatatgcacctaaaaattcagtgtaaatcaagtttactaaaccctgaaattctatagccaaatgcttctgtgatagaaataatcagccctcagtatctgctaagcgtaaattttttccctagtttgcagagagaaactggttgggtgcagtggctcacacctgtaatcccagcactttgaaggctgaggtgggaaaatcgcttgagctcaggagttcaagaccagcctgggcaatgcagcgagacattgtgtctacaaaaaaatttaaaaattagccatgcattggtgacacgtgcctggagtcccagctactcgggatcaggaagccgaggtgggaggatggcttcagccaaggaagtcaaaactggagtgagtcatgttcaggccacagcattctagcctggacgatggagtgagacccccccctcaaaaaaaaaaaaaaaaaggccgggtgcagtggctcacgcctgtaatcctagcactttgggagaccaaggcgagcagatcacttgaggtcaagagttcaaaaccagcctcaccaacatggtgaaaccccgtctctactaaaaataccaaaaaatcagccgggcgtagtggcaggtgcctgtaatcccagctactcagcaggctgaggcaggagaattgcttgaacccaggaggcggaggctgcatctagctgaggtcccgccaccactgcactccagcctgggtaacagagcaagactccatctcaaaaaaaaaaaaaaaaaaaaagagaaactaagataatgttaagtgaagggaaatgtatttttccaatttatttcccctaattaaaggttcaggtatttttttaacggctcatggggatgtaaaaactgcccagaaagactacaactaacataacaaatactgcaccatattatcagagctagaatagctcaagtctcgcttttaaaaaaactcaaaatgtacaaaaacagtatactgtgaagtctttctctacccacttaccatgaccacccactttccctcccaacaggaaaccaatgctaccattttctctaacagtctttctgtagaaaggaaagagacatagaggaatgaagtctggacccaaatgaggtctgactgcactcagatcccttgccctgctagtatcttcctctgcagtgcttttctccacgtgaaaaactgtacattcgctttcttaaattgtctctcttccactaaaaagtaagttttataaaatcaaggtcttcacctagcttgttcactgttgtacctccagcacctagaacactatctgatatacaactggtcgtcaaatatttgttaaataaatgaatgctatatctaaatataaaaagtgacatctgccatatcaaataatagaagttattctgtagcaaaataattcaaataatgtagcaccggcaaagaaaagatgaagaaaactgaatgttctacaaatagactgaaggatgtacctgtattaaagatagcacgtgaaaaataacaccaaatgagggtgtagtctactggggacaaaaaccagaaatttattttctagtgtgtttactgaagcacatggacactgaaagaaagactccgatgttcaggcacctatcaagcctcggcctgagtcacatttgctactgtcctgttggcccaaaaaagttacagaaatcagccaggctggtccagaccagaagaacttggctgaatttgtctattcattcaataatcgcgtacgaataattttcttgttggaataaaaacacctcctatgcattcattaaacaaatagtacaggcatgaggcagataaaaatctaagtaaaaccaagttctgaccttccaccaaccacctagctaatccatagacgttagataactcattggaacttggaagcgtagataggcgattttaaaactcaggaagcaccgaggatgaagcgatggaaggcagcaaggcggggagagctccggaagaggtggtgaaactggaggagtcagacttcattccagaaacggccttcatgtgatgttatctgcatagttcattccgcttaccaaaaaactcactcgtcctctcccgcgtaacccacccacattgcctcagatgtgtaaccctcgggttaaaataccggtaagcgccgatgctcacggaggggacgaaacggggagcgcaaccaccgggaaccacgcaaaagtcgctcatgcccagggcggcttgcgggggcagggacaggtcagccaggacggccgcgtccacccgggccctacagggggaaggctcgaggaaagggggacgggaacacccaggcgtcggccctgctcgccgcgccccttgccccagatccgggcccggccgctcaggccctgaggccggcccagcgagctccttccccgccccgggcaagcagggaggctcggcccacctggtccatcttgggcatcaccttccgcttgcccccgatccggaagcgcaccaggttgtagaactcttcggggtggccaaggcatttcacgaactccatcctggcgcaggcggcggactcccgggcgcgactctcacctctgcggtccccaggcgctcaccggccggctggacctgtggagtaggtgcttcgaggggctggccggacagggggcaggcctagtacggcgacgccccgcccgccgctccgcccacttcaaccggcctcggccgccagcggggctagctgcggcctcgtggggtgggctgacgggcgctgattggccagggccgctcacactaggaagaccccggccaatcagtcgcggaaggagactggcgtgataacactctagaagctcattggaggccgagaaagaggccgacgagcgggattggtgccctgatggagccgggcctttgttttcttccgcttaccccggctgggagcgcgaacgctgtggggactggaggtgaggcggtggggcttaggatgcgcaggagcccaacggtggtccgcagtcgggagagcagtgcggggctgcttcctccccacttggtcaataagtcgcccacgtgtccggcctcggtggctcctgccagccgggtgagctctgcagccgctctctgtagagcctaaaaccgtgaaaaggccgggccagcg

SEQ ID NO: 6630 - DNA, 483 bp, Homo sapiens
agcaggaagtgtttttaactgcactgccaaatgtcatgttcagtccaactaacagtttcggggtgatgttaagccaggagtttcaatcaatgccaagacacggtccccctagatttaaaccccaacactcttcaagaacactacccctcctttccatacagccctccattctgaaagagagcaagccaagccacttactcctccagctcgtacccctgctgctctttttcctgtcacctatttgtttcagtcccttaccttgtaaacaggtttcttcaaatcaccaagaacaaaacaggaagacacaactagtaagcatactatggaaaacaacactcactaaaaatttctactgcttgattcccatgagccaggggagaaagcaagctcaggctactggtgcctgtccctcttgggtttatctattgcagtctgagattcagcacactcccaaaagctcgcaagcgggagaaaaacagggat

SEQ ID NO: 6631 - DNA, 1637 bp, Homo sapiens
ggctgtattattacttaagctatgtttacaggtagacttctaagccttctagctttccactagtaccaggtgagaaagatacgtgctcatgtactgtataatgatgtttcagtcaacggagactggaaatacaatggtgggcccttaagactgtaacaccctgtttttactataccttttctatgtttaaatacacaaatacttaccactgtgctccaattgcctacagtattcagtacagtaccatcctgtagagatgtgcagccttggagcaatggcctgtaccacagagcctacgtctgtagtagctatgccatcttggtatgtgtaagtacactctatgatgttcacagaatgatgaaatcatctatcaatgcgtttctcagaatgtatcctgtggccattcattaagtgatgcatgactgtactctaatcgaacccctaacatacaatgagatttctagaaagcctgacttgaactggtatcaactaatgatcactaaagtataaaggatcaggttcaatctactgtacatcgaggcggaagtcactgggttagaacactgtattgaggcttattcctaaattctgcaaggcctgggataagaggacaaatggaggcccacatactatatgtagctaaaaatttaaaaatgatcaatcgagctagtaacttaagtaaaatatattgtatcctcctgcactgacaaacttatctttgtaacaacctggttgattcaggtttgaatttagaattcttagtccctcagagttttattccagaatgcagcagggcacagacagctgatccccatatcccaggctcttcccttccactgcttcctgaatcccgctctctccagcactgggaggcacctcacattcatttgagaggatatcccagccctcggtgccaggatccatccacaacactccccaacacagcccttggccatcactcaggcccaagggcacagtcaatggtggcacgttcccacctggaggagatggactgaccttaggaaatagactgtgcggacgcagacgtgggctcagggatttggggcaaggaactccagatgtccagaacgtggtacagaaggagagcccacgagagctgaacaagcacattcccatggccccagtgatccctcacccctttgggagtgagggggcctagaatggggcactctgaagtgaggagtttcacttgccccagtctaagagcagtactgtgtgtgaggccaaggtatcagtcctctttcacactacttgttccatcctgggacctcttagccaaaagctgattgcaggcctagccccagacaactggtttcaaagacatactgagctatatcagcacatacacaaatcactccttaagaagacaaggcactgttaattcccatacagtcccatctcaaactgaatcacagactggagggacctacaactcaagtagcttaaaattatatatgcacgcaaaacacacaacttagtacatcttcatattcgtaaggatacaaaaggtgaacaacagtgaaaacagccgtgcctggcttacgccttctgctcccttttactcttcccggggcaactgtgctttcaagaggatggaatctctaactctactaccc

SEQ ID NO: 6632 - DNA, 522 bp, Homo sapiens
gggcgtctttactgtaacacacccgagcacagcccagctcgcctgcccgccaccgccatccagccccagggagccccacacactcctggagcttcagctgccccctctctagtgtttacttgagatccagcttagtcctagaaaaaggagctgaagccttagagagcctgtaacaggaatgtggaaacttctctcatcctagatctctccagccctagaaactactggctacccgtccaggcgtggtggctcacgcctgtaatcgcaacactttgggaggccaaggcgggtggatcacgaggtcaagagatcgagaccatcctggccaacatggtgaaacccgtctctactaaaaatacaaaaaagccgagtgtggtggtgggcgcctgtagtcccaactactccggaggctgaggcaggagaatcacttgaacccgggaagcggagtttgcagtgagccaagatgacaccgctgcactccagccaggccaacagagcaagactacgtctccaaaaaaaaaa

SEQ ID NO: 6633 - DNA, 1637 bp, Homo sapiens
ggctgtattattacttaagctatgtttacaggtagacttctaagccttctagctttccactagtaccaggtgagaaagatacgtgctcatgtactgtataatgatgtttcagtcaacggagactggaaatacaatggtgggcccttaagactgtaacaccctgtttttactataccttttctatgtttaaatacacaaatacttaccactgtgctccaattgcctacagtattcagtacagtaccatcctgtagagatgtgcagccttggagcaatggcctgtaccacagagcctacgtctgtagtagctatgccatcttggtatgtgtaagtacactctatgatgttcacagaatgatgaaatcatctatcaatgcgtttctcagaatgtatcctgtggccattcattaagtgatgcatgactgtactctaatcgaacccctaacatacaatgagatttctagaaagcctgacttgaactggtatcaactaatgatcactaaagtataaaggatcaggttcaatctactgtacatcgaggcggaagtcactgggttagaacactgtattgaggcttattcctaaattctgcaaggcctgggataagaggacaaatggaggcccacatactatatgtagctaaaaatttaaaaatgatcaatcgagctagtaacttaagtaaaatatattgtatcctcctgcactgacaaacttatctttgtaacaacctggttgattcaggtttgaatttagaattcttagtccctcagagttttattccagaatgcagcagggcacagacagctgatccccatatcccaggctcttcccttccactgcttcctgaatcccgctctctccagcactgggaggcacctcacattcatttgagaggatatcccagccctcggtgccaggatccatccacaacactccccaacacagcccttggccatcactcaggcccaagggcacagtcaatggtggcacgttcccacctggaggagatggactgaccttaggaaatagactgtgcggacgcagacgtgggctcagggatttggggcaaggaactccagatgtccagaacgtggtacagaaggagagcccacgagagctgaacaagcacattcccatggccccagtgatccctcacccctttgggagtgagggggcctagaatggggcactctgaagtgaggagtttcacttgccccagtctaagagcagtactgtgtgtgaggccaaggtatcagtcctctttcacactacttgttccatcctgggacctcttagccaaaagctgattgcaggcctagccccagacaactggtttcaaagacatactgagctatatcagcacatacacaaatcactgcttaagaagacaaggcactgttaattcccatacagtcccatctcaaactgaatcacagactggagggacctacaactcaagtagcttaaaattatatatgcacgcaaaacacacaacttagtacatcttcatattcgtaaggatacaaaaggtgaacaacagtgaaaacagccgtgcctggcttacgccttctgctcccttttactcttcccggggcaactgtgctttcaagaggatggaatctctaactctactaccc

SEQ ID NO: 6634 - DNA, 522 bp, Homo sapiens; identical to SEQ ID NO: 6632

SEQ ID NO: 6635 - DNA, 1637 bp, Homo sapiens; identical to SEQ ID NO: 6631

SEQ ID NO: 6636 - DNA, 3089 bp, Homo sapiens
ggggggtagtcggtctataagcctcgcccgttccgctccctggggcttccccgagcgccgtcggtggtcatggctgccccagcctcccggcaggtccgacgcagagcccgggcagcgccgcggccccgctcggccgaggattggtggtgggaccggctggcgccgaggggctcggggtaccacctgctgcagtccgacagcatgctgctggtgctgtctgaaccaggccccgcccggccccgcgcacagcggcgcgattcccgccgcattccccggcagccgccccggggccccagcgccgcggccaagcccaaggccgggctcaggtccgaggcggcggccgcgcccgcacccgcaccggcacccacgcccacgcccgaggaagggcccgacgcgggctggggagaccgcattcccttggaaatcctggtgcagattttcgggttgttggtggcggcggacggccccatgcccttcctgggcaggtaacgctggtgccgggcccgccgccgagcgtagcggcttgggccagacgtggtccgagcggtggcccgggcgggggcggagggcgaaagcatcggagcgcgcaccgctcagtccgagagcgcagccccttaggcgcccagttggagtcccaggagcccggctttgagccggggtgtctactgcgctgcgagaggggggcatcgcctacggaggggccggcaccctcagcacgctgtcctcccagggctgcgcgcgtgtgccgccgctggcaggaggccgcttcccaacccgcgctctggcacaccgtgaccctgtcgtccccgctggtcggccggcctgccaagggcggggtcaaggcggagaagaagctccttgcttccctggagtggcttatgcccaatcggtgaggggttccctcttttccttacccctggctccaggctccttccgtctccctgcaccaaggtgttgggtgggaaggactcgtgtgggaacattagtgcagctctgcctccgctgtcggcccaggttttcacagctccagaggctgaccctcatccactggaagtctcaggtacaccccgtgttgaaggtgagagctccaggctgtcctgcacatcagctgtgacactctgggactgttcagtactctaggaagtgggtcaggcaccttgggggcccaacgctgctccgtggggatgtctgcttgcctgcctggttctcttttcctgctgtttcctccagcagggaggtatcagaggcggggacacccaagtaggcctggcatgggcagaaaggaggtcacagctaaggcggtagagtggggttggcaccagccacttgtctgtttcccttgtggatcttagcctgttgtttcccaaccccagctgcccctctgtctccccgcagctggtaggtgagtgctgtcctcggctcactttcctcaagctctccggctgccacggtgtgactgctgacgctctggtcatgctagccaaagcctgctgccagctccatagcctggacctacagcactccatggtgagccctgtgtcccaaggggccctgaaaaaacccaggccggggtgacgggtgctcttgtattggggccccaggtggagtccacagctgtggtgagcttcttggaggaggcagggtccctaatgcgcaagttgtggctgacctacagctcccagacgacagccatcctgggcgcactgctggtaagttggcattggtgggagcagaggcagatgctgagctggggactgccaggccactgaccctgtgacctaccccctccccccatctctgcagggcagctgctgcccccagctccaggtcctggaggtgagcaccggcatcaaccgtaatagcattccccttcagctgcctgtcgaggctctgcagaaaggctgccctcagctccaggtacctggcgccctgcctctcccacctgtcacaccctcccccatctacagcctggaccttgcccccaggtgctgcggctgttgaacctgatgtggctgcccaagcctccgggacgaggggtggctcccggaccaggcttccctagcctagaggagctctgcctggcgagctcaacctgcaactttgtgagcaacgaggtcctgggccgcctactccacggctctcccaacctgcgcttactggatcttcgtggctgtgcgcgcatcacgccggctggccttcaggatctgccatgtcggggtcagcagtcctgggtggtggccgggcgggtgaggtgtgggggcccttgtcaccttgtagcttatgctcactcctttcactgcagagctggagcagcttcatctgggcctgtatggcacgtcagaccggctgactctagccaaggagggcagcccctttttgacccagaagtggtgccatacactgcgagaactggacttgagtggccaggggttcagtgagaaggacctggagcaggccctggctgccttcttaagcacccctgggggctcacacccagccctgtgctctcttaacctcaggggcacccgggtcacaccaagcactgtcaggtcagcatcccctaccccagtccctggagccagtgtggctgtcactgtgtctgcctggggcctggaagttgtgtcctgcctggcctgagacctccaggggtcagaggggcatgcatactgtccaagcccctgcgtggggtgggcctgaggacaccaggggaactgggcttggccttggtggctatgggtggcagagccaggtgtcgaacaccagcaggcacagctccctagcctggcccagcccttctgaggcaacagctcaacttcctgtggtctgccctccccacagctctgtgatcagcagctgcccgggcctgctttacctcaacctggagtcctgccggtgctttccccggggtttgaagcgggcctaccggggcctggaggaagtccagtggtgtctggagcagctgctcaccagcccctcacccagctaggcagccacagacctgggacacctcagccagcttgcccaccctccacctttgcccaatttcagatatttgagcattttgttaaaataaaacatttttaggagtt

SEQ ID NO: 6637 - DNA, 2722 bp, Homo sapiens
ttaatgccaactcattaaatacaaatgttttattacgcaaaccacatgtaggtcccaggctcaggggcttaccctacagcccccactggtccctggctccaagcctgctccttgcccttgcccaccctggaaagccaggatctcctatggagtgtgtaggtgtccacgagtgtaccggtgtgcgggcctcctgggctgcaggcactcaggcatggtggcagcattgagggaaagacaggtgttggggagcggggtccccacctgcccaggctcaggagtcacaggggtctgcacagtcctttctgctgtggaacacgtgatagatgctggtcggggggaacatagcaacagcgccgagcagagagcccacctggatggccacgccggctgccagcaatgccggccggcccccgccatgcagcagggagctggctgccaccttcacgtaggagaacacgccaagacacagcacccacgacagcacctgagggggacacagcaccagctgagcgtgagatgtgcctgctccagggcaacgcccccccaccccacttcatgtccccctgtgctcaccacgaggaccacccccgccgaggtgcccaccaggggcgggcaggggctcaggactgccagcgccatcaggtagcccccacagaacacgcccagcagagagaggccgcccagccctgccaaggacctgcagtgagcgagcagaatgtcagggctgactgcgccaggacctggctcccagccctgagttccacccgcacaggggctgggggtccttgtgtacctgcacagcacacccatggccaggaagcaggccaggggattggcagcactgcccagcaccacagccaggtggtaggccagacgcccgtagggtaagcaggaaaagctctgcacggcaggcagcacgccattggtcagcgcgttggtggcggccaacaggcccagcaggcaggcactgcgggctgatagaagctgataggccttagggtctggaccaggggtggtgcctgctgcctggcttggtggctcttgcagtggtgaggactcttccacctcttcctctgctcctggggctcccacctggaggcctgatcctaactcccctgtgggtacagatggtggtggcggcaacagcagcagaagaccctggaaggcagcagctgaagcgaccagaagggcagtcagtgcccagaagaaggtgctggcgggaaaacgctcaaggaagtcgagcggggggccaggggtgccgttgatgggggctggcgggcactcgaggcggcccacaccctgcactagggccagcacgcagggcagcagggcactcaggccttgacccaggaagaatgaccgtaagaagcgaggtggcaggtggctcaagaagggcaggaaagtgacattcgaggcacagcatgccagtgccagcacaaaggccagtgctaagaaggccacagaatgcaactgtcctgccactggggccacatggtgccacagagaggccagcagggctgtgcccaccatgcccagcacctgcaccacccggatggggacctgctcgtcctttcctggggccagcctcctccagagggtcaccaccagcagacccaggttccccagagccacaagcacagagacgtaagaggggaggctccaacctgcagggaagggaggaggccatgtcagggtcatgatgcccaagggaggaagagtgccaaagcccaccttcctgggcacacctgcacctcctcccactcaccctctggaagctctctgaccaccacaggtagctccacccagatcccactgaccgcagcccaggagtcttgggcacacctgcacctccctcccactcaccctctggaagctctttgaccaccacaggtagctccacccagatcccattgaccgcagcccaggagcccatgccgaagagagccaccagcaggtgggtcagcaccggacgggcgggcgtgggtgctgccattcagcccaaggctgggcccttccaggtcagggcaaaggtcacagccagttcttttcccacctagggccagacacgctttggctctcctgggaagtgaagacttcttctagcttgaaagaaacagagaaacagataggatgcagagccggagtcagaacagggtgagaccaggggaactgggggagccccgggcaggagcgcagatggggaggattggctaaaacgtacccagcgggaccgccggcaggcagggaagcaggaagccggcccgagtcgctgcggccccaggggaggaggccgaaggagcgagtggagccctcctctccagggagaggcggggctggagtcaacgccaccaccaccccaagccggacgccgggaaagggcgcctaccaggaggagccacgcacaccccagggcttcacggtgcccgcgaccgcaagagccaagtcagatcccaggggagtggccgggacggctctgctcggaggggcgccgccctctcggtaccgtcaggtgggcgactcgggagccgtccggtccctgcgcctcccggtcccgcgcccagtgcgctcccgctccagtgccggcttcccgccacgccgggacaccgccgtccggcccagggacgccacctcagtccggagcgcgcaggacccggcagcagccacgacccgactcacccgtggcggttccgggcccgcccccggcatggcccacgaccggaag

SEQ ID NO: 6638 - DNA, 2263 bp, Homo sapiens
tccattctttcttaaccatcttcttctgcccccatctttaaaaaaaaaaggcagtaggctttatggctctaaaatcaaatgcttatgttggattctaataagggggttttatttcaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactggtatgtgataattatccactgtcttagcaagtcactatttgaggaaataaactttaattcaaaaatgtttgtagttaacattattttgatttcttcagttgttgcttggaatgtttttatactgaccaagttggtatgtgacgtttatttttctctgactataaaagtaaaaaagaactgaaaatacccaaaaagtaatgttttatagaaagtctcccattgatttaagaagttatctattagattgatatcagaagtttcatatgagtatttggcttatgcatttctgtcttttggttttaggcaaaaggatgtcaattcttgatgttaaactttaggattcttaaagtataatgaagactggaatgggctgtggggaacataatagtggatgacagtgacttaggattcaattcagaaaatagttgtgaatctgttttattttggttacagcctactcatacgatttatttcatattttctaagtgtatttttgttcttcctgtatgtttcttggcccttgagtcttctctgtctttaatctttctctcctctcctactatttatagccagtctcatattaatttcctttctctagggcctttaaccacttggtgctcatttcagaccagtagtagtagcaacaaagttctgcaaatcaaatgtatcttcactcctgctgtatttaagacacagctatctcagtatcttaaaataacaatgtaattattttttggcatacccttgcctgacttctgaggacctcactaagtctagttctagcctttgtagaatggtcaacttctttcatcaaggctttggtttcattactggtgtctgaattagttccactcctagcttgacccagattttagtttttattatggattttttcttcaaacttgtttatttaatattaagttttcatttttggcagcatatggatgattttatttttaataatcatatctcttagtaaactaatggttaaataatattaaagtataagaagctaaaattggccaggtgtggtggctcacgcctgtaatcccagcactttgggaggctgaggcaggcagatcacctgaggtcaggagttcaagatcagcctggccaacgtggtgaaaccctgtctttactaaaaatacaaaaattagctgggcgtggtggcgcatgcctgtagtcccagctacttgggaggctgaggcaggagaatcacttcaacccaggaggtggaggttgcagtgagcaaagatcatgctactgccctccagcttggatgacagagcgagactccatcttaagaaaaaaaaaaaagggctacaatttatcaagaaaatccactatagtgatttaaataaaacatttttcaaaattttataaaattttgaaagtattgtgtttggtagacaatttaaaactatatatttagaattctgtgacttctgtagaatttgaaatttttctaatatctttgcattgattaaacatagttgttaccctttacatattgttattttgagtatggcttacctatatgcaattacatttccaaggaccctgaatgatcagtctcaggtatttttttctgaaaaatctgtggaaaaacattttcagatagataaaattaaaatatgaaataagatattttaaacaataaagtgagtcctttttatatggaagagtagtgaaggttaacaaaaccaaactaaaacaagagactgtaacaatgaagtttaaaatatacattcatattatggaaagcatgagggaacttggtgagttgatgaagcagggagcgtttggccttaaattgttgaattttttagattaagatcaattgtcctgagtttggggtggttttggggtctctggttcttttcttattgcagtgtgacagctatgaaattcgccctggtaaacaccttggagtgtgcatttctgtggcaaacaacagactttttgttgg

SEQ ID NO: 6639 - DNA, 14327 bp, Homo sapiens
tccattctttcttaaccatcttcttctgcccccatctttaaaaaaaaaaggcagtaggctttatggctctaaaatcaaatgcttatgttggattctaataagggggttttatttcaggtatttgtaggcaaaataccaagggatttatatgaggatgagttggtgcccctttttgagaaggccggacccatttgggatctacgtcttatgatggatccactgtccggtcagaatagagggtatgcatttatcaccttctgtggaaaggaagctgcacaggaagccgtgaaactggtatgtgataattatccactgtcttagcaagtcactatttgaggaaataaactttaattcaaaaatgtttgtagttaacattattttgatttcttcagttgttgcttggaatgtttttatactgaccaagttggtatgtgacgtttatttttctctgactataaaagtaaaaaagaactgaaaatacccaaaaagtaatgttttatagaaagtctcccattgatttaagaagttatctattagattgatatcagaagtttcatatgagtatttggcttatgcatttctgtcttttggttttaggcaaaaggatgtcaattcttgatgttaaactttaggattcttaaagtataatgaagactggaatgggctgtggggaacataatagtggatgacagtgacttaggattcaattcagaaaatagttgtgaatctgttttattttggttacagcctactcatacgatttatttcatattttctaagtgtatttttgttcttcctgtatgtttcttggcccttgagtcttctctgtctttaatctttctctcctctcctactatttatagccagtctcatattaatttcctttctctagggcctttaaccacttggtgctcatttcagaccagtagtagtagcaacaaagttctgcaaatcaaatgtatcttcactcctgctgtatttaagacacagctatctcagtatcttaaaataacaatgtaattattttttggcatacccttgcctgacttctgaggacctcactaagtctagttctagcctttgtagaatggtcaacttctttcatcaaggctttggtttcattactggtgtctgaattagttccactcctagcttgacccagattttagtttttattatggattttttcttcaaacttgtttatttaatattaagttttcatttttggcagcatatggatgattttatttttaataatcatatctcttagtaaactaatggttaaataatattaaagtataagaagctaaaattggccaggtgtggtggctcacgcctgtaatcccagcactttgggaggctgaggcaggcagatcacctgaggtcaggagttcaagatcagcctggccaacgtggtgaaaccctgtctttactaaaaatacaaaaattagctgggcgtggtggcgcacgcctgtagtcccagctacttgggaggctgaggcaggagaatcacttcaacccaggaggtggaggttgcagtgagcaaagatcatgctactgccctccagcttggatgacagagcgagactccatcttaagaaaaaaaaaaaagggctacaatttatcaagaaaatccactatagtgatttaaataaaacatttttcaaaattttataaaattttgaaagtattgtgtttggtagacaatttaaaactatatatttagaattctgtgacttctgtagaatttgaaatttttctaatatctttgcattgattaaacatagttgttaccctttacatattgttattttgagtatggcttacctatatgcaattacatttccaaggaccctgaatgatcagtctcaggtatttttttctgaaaaatctgtggaaaaacattttcagatagataaaattaaaatatgaaataagatattttaaacaataaagtgagtcctttttatatggaagagtagtgaaggttaacaaaaccaaactaaaacaagagactgtaacaatgaagtttaaaatatacattcatattatggaaagcatgagggaacttggtgagttgatgaagcagggagcgtttggccttaaattgttgaattttttagattaagatcaattgtcctgagtttggggtggttttggggtctctggttcttttcttattgcagtgtgacagctatgaaattcgccctggtaaacaccttggagtgtgcatttctgtggcaaacaacagactttttgttggatccattccgaagaataagactaaagaaaacattttggaagaattcagtaaagtcacaggtaaaacaaaaatgtatttagaaattacttttgcgaaatatgttgtactacttacaagtgctcaaaaaaactgaggggttgtatgtattaaattaagaattcaggtctgaagtatctaaattgcttcctttctgctttatagtggtttgggtttaagcaagttcccttatatccttcatttcttggaatgtccccttcacttctttgtcttaattgaaccttggcttttgctggagcttttgctctatagccctcaagtgaatgctttttttccccttgacaattagtgtattttaggaccaagaggatgaaagtttttactctctccctgctgccttgtctagatcagattttttttttttttgagacggagtttcgctcttgttgcctaggctggagtgcaatggtacgatctcggctcactgcaacctccgcctccttggttcaagcaattctcctgcctcagcctcccgagtagctgggactagcatgtgccaccacgcctggctaattttgtatttttagtagagacggggtttctctatgttggtcaggctagtctagaactcccgacctctggtgatcctcccgcctcggcctcccaaagtgctgggattacaggcgtgagccacagtgcctggctgatcagatttttttaaatatccaattctaaatccatggaattgattgagaagtagattttatatcacagttctatacacatttatatataactgaaacaatttaacaaaactgtacttttatttattatacatgatttattttgatatttcttattctatttcattttttaaaatgccaattgtgatctaatactacctatgatttaaaaacactgcgttagaccgctgcctccccttgtaaaaaccactgtttctttacatttttatcatccagacatatcctttcccttttgttgaagctgtcattcgttgctcttgtggtttcagcctttcattaatctaaagattgcttctggctcactgtcttcctcttctgccctaaattggcttctttctaatacctttaacatctacattggtgaaccatccagggctttagactcctacctacttctatgtctacctcatctttagtcctttacttcagctccaccatatccagattacattctggatctagtcaccagaaattctatgcactctgaactcttgatttctagcgtcccactttgtaaccactgctaccacccgctatattgtgttgtcaagtattgtgttgtcaactgctggcacagttctttgacctcatcactttattatctatagctccttctggcttcatgatcatttattcattctttcagcaggtgtttattaaagttcctgttaagtgctggcattgtgctatgtgcctgggatacactgatggctaagagacatattctctgctttcatagatcctatatcctgagaaaggagataagaccaagaatataaaaaataaaaattaaaggaatatttagacattgtgataagacactgaagcaggaaatacaggatatttagctagagaatagctactatccctgtttccatggttttggaagacttttctgataagatgacatgtcaaccagcacctgaaggatgaagaggttgtagcatacaaagagcaaaaggaagtgcattccaagacagcaacacgtgccaaggttccaaggcaagaaagaagtcagtatattacagtaactgaggaggccagtattattaaaaggtagaattaggagtagagttgtatgaaatgaagtaggcagggcttctgtaggccatgtaaggagttgggtttttattgtatatataatgagaaggtatttaaaggttttaagcaggaaataacacctatttcttgtttatgggatattattcctagcgctctgtggataggggcttggagagaaggggtgtgagtggaagctgataaattagttgaagctgtcatactagtacagatacaggattagactagggtaatagcagtggagatagaaagaagtaaatgagtttggaattggataggagagatgaaggaagaaatcaagaatggctaaccaatttctggcttcagaaccaggtggatggcactgtttattagataggaagtctagggaaggcagattttggccatggtggttcagttttggaaaagttaaatttgcaatgtctaagacatcaaagaggatacatcgggtaagaacgtaggcacatctagagcttagagaagtctggggtaggaaaaaaatctaagtatttataagggtataggtaacatttaaaagtagggctagctgacattatttagaaagaacacatacggagagataagggcaaaggactaagaccagaggaacactaatatttagtgatcacttccattcttggtaaaaatagtaacttttaagttagcttcaaggaagatttttggccatgattagttgtcaaaagttagttctcttgggtttatattactaattttgtttttaagatccttgttagtgctttaataaagtcatgttatatcaaacgctctaaaacattgtagcatgttaaatgtcagaatatagtagatttgttgtatatggctgtaccttcagaacccctaaaattaaaaaggaacatcaaatactgtcccaaaccccatatctaattatgttgatctaattgtctacaaaattagtgactcatgttgaggctgcttcacttatattttgctcatcgtcaagtggatttaggtctgcctaatcgctagatgtgtggtggatgcttttggcttatatatctggctgttggtttaacagagggtttggtggacgttattctctatcatcaacccgatgacaaaaagaagaatcgggggttctgcttccttgaatatgaggatcacaagtcagcagcacaagccagacgccggctgatgagtggaaaagtaaaagtgtggggaaatgtagttacagttgaatgggctgaccctgtggaagaaccagatccagaagtcatggctaaggtaaatacagttgcttggaatgggcatagggtcatcatttaaattttgtactcagaataaagctcaaatattttgagttttatgataaatagaaattgtagctttagacttcaactgtttggcaaggagcggctttaacactaaagttaacagcctgtcttggtatccaggaatttccattaacaatcccttttcctgcagattaaatgtgcaaaaggaactgaaatgaaattccttcaattaagtagtcccatacacactgggtgtttgtttagtgctaggcactgtgagggatagaggttttttttttttttaaaagtcctgagtaaagagagaagtaatgttttggagattataagttataatcttcattgactatattatgactttattacttggccatgaattatgttttatttagatttatagctaatttttctttttttaagctttttttgtagtttttatttttaaaaatattttatttattattattattttttgagacagagtcttgctgtgttgcccaggctggagtgcagtggtacgatctcggctcactgcaacctccacctcccaggttcaagcgattctccttcctcagcctcccaagtagctgggactacaggcgcctgccaccatgcccggctaaattttgtatttttagtagagacagcatttcaccatattgcaggctggtctcgaactcctaagctcatgatctacccgccttggcctcccaaagtgctgggattaaggcatgagccaccgtgccccgcctcttgtttttaaatgatcagattcccttagtgtattgtccccatgaagaaaggcaaaagattgtcatgtttgctcttatttgttagtggcaaaatatgcatggcaagtcctgtaaagggccctcaattccctcctgattcctgtacttgcgttgccaggatcttaatagtggtgccttgagtactggttcttaagttttcctttgggcgactcctgggacacatcagagttgcatttctttttttttgagatggagtcttgctttgtcccaggctggagtgcagtggcgcgatctccactcacggcaagctctgcctcctgggttcacgccattctcctgcctcagcctcccaagtagctgggactacaggtgcccgccaccacagctggctaattttttgtatttttagtagagacggggtttcaccatgttagccagggtggtgtccatctcctgaccctgtgaaccgcccgcctcggcctcccaaagtgctggggttacaggtgtgagccactgcgcccggcctcagagttgcatttctgctgcttgcaatgagctcttgagcattttagttgtctcttcccttcacagggaggcagcaactctgaatggccatgagttaatggttggattcttcttgataagtcagaagtcaaggtttttattccagaatttgaggaggcaaaccctcgttctaagtagtttggaggagaactctggtttatacttgtataaagtctgggttggcagtgacatctttgggttaatcagataagttctattcagaatgaaccagagaggctctcagaagtgctactcagtatcttttatctcatattccttgagtagatgggtgtctaggaaagggatagagaatttaaatagctctgagtttttattttgattttttactagcttgattttaattcctattgtttcttctcctaatacaactatgactttgggtaaactactgaacatgaatgtcatctattttattgagcctggatcaatctctaagatccaccacaactttgaatctacctgtagtaactaagtatagcctgtattactttttctgtaaaaatattttaaaatagtattatagatgtattataatagaggaataaaatattataaaagaggaataaaatcccatgaaaaccaaaagtatagcttgtaatttgcttaccagccacttctcacataacctttagtaactgctcagatggaagttcatcctaatctttttttagggttagaaaacttcaagatttcattctggtaactcctttttcctagatctaaaacaggtttcagaatgaaaaggaggtctctataaacttaggattaaatattatggagccctttattgtttcttttttttaaaagatggggtctcatgttgcccaggctggagtgcagtagctgcccacatgtgcagtcatagcacactgcagccttgaactcctgggcttaagcgtccctcctgcttcagcctcccgggtgcttgcaaccccatccagctcctttattgtttcctaattgaaaagaaaagtttatccatttgagtaaagcttctgttattcacactatcaatttacaattcactgaagattttttttgccaagttgggtcagttttacaatgtaccataacctaaaagcctaaatatatgtctcttaaagggaccctttttcctgttgaacattttaaacacaatttcagtaagtaattttcacatagtatgttatcgtttcatcatagaaaagtccatgttgaattttttttaaaaagcaactaaaccagtgggagtctgtgtaacatagaggctggaccttagtatgacaaattgagaataataaaggggatggagcgtttgtggaaaatgttagtttttttcctccttaaattagtatcttcttattagatagccctttatctgaagcaacaatttgttcaatatgttagttttttatttggataggtactatgttttcttagttcaaaagttatatagaaaagtatagacaaagaaatttcctttctacccctatccctgtgtctaccaaatcccctttgtctcctataaggcatccagttttaatagttgctggtttccttttagtatttccttcggcaaatatggatatacttccttaattcttagatgagtggtagtaatgttggtagcctaccatatccactgatctaccttttgtttattcaccatcctgtttcatcagctctgaggaaatacatcattactatatgtactactaaatagttaaaaaacactgccaactaaactatggcacagtacttgcttatcacattgactgtaagttgtcctatcctacaactcatagagctcctcttcattttttgggtttttgttttttttttttttttttttttttttgagacggagccttgctctgtcacccaggctggagtgcagtggtgtaatcttggctcactgcagcctctgcctcccgggttcaagtgattctcctgcctcagcttcccgagtagctggggttataggtgcctcctaccacgcccggctaatttttgtatttttagtagagacagggtttcaccatgctggccaggctggtcttgaactcccaacctcaggtgatctgcccacctcggcctcccaaagtgctgggattacaggcgtgagccaccgcgcccagccctcttcttcattttttatgactacatagtagtctattctgtggaggtactatagtgtatttaaccagctggatattgtttctaatcttttgctcttacagtgctggaaggaataagcttatgttagttgatacaagtggagatatatctgtaggatagattcttaggggtagaattgtgggccaaagggtagatatatctgtaattgttaagatactgccatattcctttctgtaggagatacactattttacattcctaccagcaaaatacaagagaattattttcctcattcttgacaaaatagtgtataatcaaacttttgaattttgccagcctgataacaaatgtctcagtgccattaatgattaatgatttgcttctcttactatgaatggtttgaactttaaatatattttaagagccatatgtgtttctgtgtatgaaccatgtattcaggaattttgcctatttttctattcagttgttgagctttttgttattttctggtgctctgatataaaagagagattagctgtttgtgatacatgttgcaaatttttcatccatatttattgtctttgcttatagtatttttttgccatatagaagtcatttatttttagtagttgagtataacattcttatggctcctagattttaagtcataaggtcatccccactccagtgttatataaaggaatcattcttgttctaaaatttcacagtcctccctccacccttttattatttaaattttcaatctatttggagtttatccttgtgtatagtgtaaggcatggaccagcttttctcctttttttctaatttaacactacctgatttaatgatttaagcattatagtttgtttatatttggtagggccagcctctaaatttcactcttttttttcctggttattcttgcttatttattttttcatatgaacttttgaaagttactcagttttagaggaaagaaacagaaaaacttgttttgaaagggactttttgttgattaacttggtaataataattatgtgttggttccttgaaggttctactcagtgttaggtgctttaatgacaacataggagaaggcaggaaccaataatttttgtaaattggtgactgatatcagtgtcattttcctagcaatttctcttactacctgtaacaacacttttagcacttaatgttttagaggagaaaagctatgctatgaagacaggaagaaacacttttcaggtaaaattaagtagccaatgacggttttgtttatttgttgcttactaggtaaaagttttgtttgtgagaaacttggctactacggtgacagaagaaatattggaaaagtcattttctgaatttggaaaactcgaaagagtaaagaagttgaaagattatgcatttgttcattttgaagacagaggagcagctgttaaggtaggaattttgaaattttggttcttgatatttgaattttgtttttgaaacttgccaaacgcaaagtaactttaaaaactgaaacaatattggttgtcagcttttgctgaactctttctatttaatctctgtaaagtggtaatagtatgtaacagataagactccatatttcaaagccaggttattactgagtttgtgatcttaggcaagttatttttaatctctgtattgttttgtaagattcgatagcatgatgccttggaagtattacaaggtataaaaattagctgctgtaaacactgaataggtaatgaatgcattataactacttagttgacctcagtttgtgtacctatgaaggaaactgagtggtgtacatgactcatacagtataccatgtttaattgagtagatagattttgagggtatgattagttttacctttatttaatcattttagagttaaaatagcattcactatgttttactgatttcggtaattgttagagatatcacttgtgtataatagttgatttagtctttgatgataatgaaaagtttgaagaaagtattttcatatggtatctggaacacaaaacctgctttctatcgacaatggtttaggactatctttaatgggtgaaattttcagtttcttttttttattcatctctccttccttgggggggtgggagcaagacaaaacactactaaaatcttatttatgttattaggaagatagatccagaatgcttagtgacacaggcatggttctttttctgcatgtttggtcggtgggatactgccatctctaatctgagcattttttggttttgttttttgcccaggctactgcttttaaaacaggctttatagaatccctgattggtttataattaattggcttgctcattgatggtagctaattaatgaggcagtattgttcataaaattcataacttgtccaagatcacaaactcagtaataatctggctttgaagtatggagtcttatctgttatgctgttatactcttatccgttcatttgtggcttctgaaatttcactggtatagaatgcagataactaataattttatgctgtctaaatattcctcctgactcgactggtttcaaataactggttgtcctgattgaaaatatttataggatggtttgccaaagaagcctatgaaattataaaatatctagtccaggaactgggagtcaccaggatggtcagggcagagggtagatgtttcattttttaatttatgccaggaagcttttgtaaacttgtttagttgctttaactgaagcaacgcaaagctgaggtggtaaaagggaaaattgcagtcttgaggactagtttcgtttttgtctagatacttataaatcactgatagctccaatagaacatttttttatgtgtgcccagagtggggaaaggtatagggaaacaaaaaataaaatatcatgaggaggtgacattttgttactgagtacctgaaccttttgatgtatggcagaggttgttaggtggaacaacgtgaacaaagggctagaacatggaatgtttgattactgctttctacataattgcttgagtcttcattagtccaggccttttctggctctgtacttttaactgttcaagcaaagtacattttgggttaagcattgtgagggaaacctaggcttttttgtgttagtatcttcttgaattttacagataatctcactcagtaacctcatttgtgcttcaaatccttgaaattgtcgtataagaacagtggaagacctgtatgttgtatgctacatgtttattttaaaattctaatcctgagaagttaatctttgtctggctcgtattaatactggcatttttccccggtatggatttgcttctttggtatggcttatcttttaaggagttatttggaattaaggagcagcaataggtggcagcccttttaccttttaaaatataatatcaggtggtcggttttgttctaaatgtaatttatgtataaaaagataacgtcaagggaaacgtattttctttgtgtgttagtgtttaactttctggctagattcaccttttgccatttaaaataattgtgaagtaaattgttaagtgtattaaattacacaagtataatagcttacatactatataaaacaaaatacagttttatatcgttgtaaaataatttttctaattttttataggctatggatgaaatgaatggcaaagaaatagaaggggaagaaattgaaatagtcttagccaagccaccagacaagaaaaggaaagagcgccaagctgctagacaggcctccagaagcactgcgtgagtctacattttagtagatatatctttggacaaggaataacgtgataatggagatcagattaataaaacaaaatcagagtcttgaagcaaactgatttgttttttcttttctcccttctctactttgctaggtatgaagattattactaccaccctcctcctcgcatgccacctccaattagaggtcggggtcgtggtggggggagaggtggatatggctaccctccagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttatatttttcctcttttcataaatgctcttggacattattgggctggcagagttcccttattctggggattacaatgcttttatcgtttcaggcttcatttaagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaactaaaaaatctattcaaaacattacctatttcaaattcaattgtgtcctaaaacattattttattcgtaatccttgcaaggaatattgttttcaaagtataactgcctatgtgagtgatcaaattcatgcaaaatttcttgtttattccaacatgtgttgtggatattagactgaggattagtctaaattcaagtatttattccaattagcactttcattgattggtgttctctcatagtctcttctaattttgaaattttatcttttattaaaaaaaaaaaaa

SEQ ID NO: 6640 - DNA, 482 bp, Homo sapiens
tcacgccattctcctgcctcagcctcccaagtagctgggagtacaggcgcctgccaccatgcccggagaattttttgtatttttagtggagacggggtttcaccatgttagccaggatagtctcgatctcctgacctcgtgatccacccacctcggcctcccaaagtgctgggattacaggcgtgagctgccgcgcccggccgaggttgctttttaagtagtaaagattttagagttgaggagataacttgaggagagctatgtcaatcttttattcaattattttatttttattcatttttatttttaatttataaattaattttttaattttaaataatagaaatggggttttgccatgttgcctaggctagttttgaactcctagactcaagtgatccgccttccttggcctctcaaagtgctaggattacaggcgtgagctgctgcgtccagcctcctttattctgtttttatgagaa

SEQ ID NO: 6641 - DNA, 188 bp, Homo sapiens
tcacgccattctcctgcctcagcctcccaagtagctgggagtacaggcgcctgccaccatgcccggagaattttttgtatttttagtggagacggggtttcaccatgttagccaggatagtctcgatctcctgaccttgtgatccacccacctcggcctcccaaagtgctgggattacaggcgtgagc

SEQ ID NO: 6642 - DNA, 2154 bp, Homo sapiens
gtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaa

SEQ ID NO: 6643 - DNA, 1205 bp, Homo sapiens
tgataattttattctaggattttatttttggcctaatataggaatgtttaaaaaaggcttttctatgaaaattataaatttatacttgagattaaaagtctagaagggggaggacctcaaagctaagttaccagtaagacaatgaataattcagaagagacactactcttttactgactgagtgcccaagatgccatttccacgaagtcttgattatatagtaaacgtatgccatatatgtgtgtgttttctaacagtatttttaagctttagagataatttagaccttcagaagagtggtaaaattagtagagttcttgtatactctgcacccacctgccccttatgttgacatcttacataacaatagaacatttgtcaaaattaagaaattaaccttgatataatactaactaaagtagaaagtttaaaaagtagagattttagtcttttcactaacgtccttttactattcgaagacccagctttgcatttagctgtcatgtctatgttgtgtcttccagcctgtgatgtgtatcataacaggggatacctgatgttgtaatgtatttctggtgttgttaactttgatcactgtgctaaggtggtgtctgctaggattcgctactgtaaacttactgtgttttccttgtaattattgaatatttgctggagataccctgagactatgcaaatgtcccatttctgcttaaacttttgctcattttactatccattggcagatcttgcttgtggcaattactactgtggtgttctaatggtgatattctgtttctctcaatccttctacatttattattggaattcttctgtaaggaagagttgtcacgtctggatttatatttttaactataataagatattcaggataagtatagatttagaacttaaagatgttaaatcatgttaaaattattccaaataccatatcaaagaaaactaagttggtaatctatctcagaaaatatatgtacttaagaagggaaatagtttttatgatttgtagaattgattcaactttttacttaatattgactttggactgaattcaaagttttcttgaaattctacatctggactttttaaagtgtctagatttatattactttggggatcattttgtcaaagtcttgaataaagttacccagtcctggcatgataaatttaaaaaaaaagaaaaataa

SEQ ID NO: 6644 - DNA, 1969 bp, Homo sapiens
ggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggtaggagacctaaatgttgttcctttaatgtgtgtgtaattaggagaacataacatggtttatatagtttctgtactggtttgtgttaaatggggactaattacaaaaagttggtgactacttatctatagctttacctcagctcggtttcctttttcttttttttaatagactttatatttagagaagatttagattcacatcgtttttgttaaaagacagaaagatacacattttctgtttgttgtaattcttctaaacgttaaatgcaaagatgcattttactacttcaaataatctatgaacagaagacaaaaccaatgtgaaatatctgtagcatgagcttgtatttaaaccacagacttgaacattatcacttgtggctgtgttccttttcaagaccttgcttgaggtttttaaccttttaggggaaaaactaattcttattaattaggtcacaggatggactatgaggtgctcatggtgatggacctgccacagggcaggttccagccattataactcaaaaattctgtgccttttgtctgacagggcactcccttttatcttcttaggactgtgtttttttgcaaatgattaaggagaggggtccaattttattgttagggaatcttttcatgtacctttctggtcaagtgaaagatgtgggctaacaaatttgatgttgatgcattcccattaaaacagctcttttcctctttttgctctcccactccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctcta

SEQ ID NO: 6645 - DNA, 635 bp, Homo sapiens
ggaaattttagtgggaagaggaatatatttaagataactctacaaaaataagatgatactcaatctgagcttttaatttttatattgttatgctgcttcattttgatttaaatatctcaccaataaaatgtacttaaattttatttttaatagtaattttcacgtataaacatgattttaaatgtttataagaaatatgaccaaaggcaagaaatctttaaaaagatatgcagtatcaccttaaagagttacattcaattgtcagtgtttcagaagacaagaaacaatctctgcaacaaaacaaaccaaaagaaaacaacatttaataattaggtaagtgacttccaggaaaatccacatgttatttaggacaacaacatatattaatagagtactattaagtattactaaaaagggaagaagaaaacaattaagattattgaaaaatgttttcatagaggtaaaagaatgggtgggaggaacttctgacaattaaaatttttactttgatagacttaatgaaaaatgtaattagaagggagtaaagtagttatgaaaaaaataatgaagaataatgtaacgtgacttttatatagctttataagaaatttgtttttaaacttttagaataaaaa

SEQ ID NO: 6646 - DNA, 6126 bp, Homo sapiens
ggagccgcgagacaggtgcgcatgccagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccgccgggcgccagagctgtaccgggctccgttcccgttgtacgcgcttcaggtcgaccccagcactgggctgctcatcgctgcgggcggaggaggcgccgccaagacaggcataaagaatggcgtggtgagagcgcagggccactggggctgggtcttgctgcgggctggcggcgattccagggtggccggggggtcgcggggcgggccacactccagcttcgggccctgcccacttctgttgggaagacccgcttgcctgacgcccaggggcgaatttcagtcgagaactcagcgggcggaggagaggcttttaaggtaaagtgaaaactgcacacagctgcagagtcgccaggaacgcttcagctccgcctcagagcagctccaggggtcttatactggccttttccgggaggtcttgcctgccctctagcagcggcgagagtggtgcatttgggtttaggctaagttccttccctctcctgagcttcaccctgttctgtaaaatagaggtaataatcccagtcctgctcactgtgtagatttgtgaggcccaaatgagagaaaaaagactcgagaaacccttgtgaactagaacgtgcagaaagcaaaggggtaagacatcagactcttccctaaacgtgctctctgggcacccctgaacttgctcatccgggttccccctcccacagcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggtgaggagctccctctctaaccccttggggaaagggttgaacgagtaaggtcactcttggtgtctctaaagaagtgggtctggaagtagggttttggtagcaagctagaagttgtatggcacctgccatggagagaggggccagtactccttactgtagaagcctggaacctggccaagtgtttgtgttacaggttccaaggagcaggggcctcgacaaaggaagggagcagccccagcagagaagaaatgtggagcggaaacccagcacgaggggctagaactcagggtagagaatttgcaggcggtgcagacagactttagctccgatccactgcagaaagttgtgtgcttcaaccacgataataccctgcttgccactggaggaacagatggctacgtccgtgtctggaaggtgtgggtttgcagggttagggagggtgaatgtcagtagcaacaggatcaaaattgtgagaagttgaacgtggcatctgggaaacttgtgaatgaagcttgcattgaggggccattagaaggggtggcgtgggcatcagtcacagtgtacttgctggacacctgagttaaccatggtggttgtttggctacaggtgcccagcctggagaaggttctggagttcaaagcccacgaaggggagattgaagacctggctttagggcctgatggcaaggtgaggggctgggggtgggaggaggatggagaaaggagagaggaggtgcttatgctgcttgcccagtaagtggatcccctaactgtccatccttggaatctttattcctaactagttggtaaccgtgggccgggaccttaaggcctctgtgtggcagaaggatcagctggtgacacagctgcactggcaagaaaatggacccaccttttccagcacaccttaccgctaccaggcctgcaggtgtgaagactttgggtggtggctgaaagaggcatagcccagctgtggtgggggagagggaaaagactggggatgggagagctggggaggaacttgttgagtgttaccccaggtctgaccagggtgcaggtggtgcacaaacctctgaggagggttggcaggccctaggagctgaatagcccctcatccggcccccaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcaggtgtgagacattgctgccttggctaggtagggggtccctgagggagcttggaaaggagtcctgcctgggtccctacggaccggtattggggtatgagggttgctgcacaagcctccaggacaatgagctctttattgtttgttgcagtgaatccggcaccttcctaggcctgggcacagtcactggctctgttgccatctacatagctttctctctccaggtaatgggtggaggttggcatggccctgtgggtggactgtaggcctgtctctaccctgagtttgcaggaaggagtctggcccatcctatcgagggaaatcctgggggtggggaacatgctttccagaaagagagttcccagctaggcctttcctcactggtattccttctgcccacagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcgtgagtcattggggcagggcaggcaggcaccaccccacgtttaatgaccagaaacgtgccccccggaggctgggctctttgtgccactcctcctttgaagggttctggttttcaggctgggaagcccttttgcccgctgacctcctccctttccctcctgcagggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgccgctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaatggtactcttgtcagctgtttctgtcctcagaaggtaagagagccctgaggtcaggcagcccctctgggtcctggaagatggctttggcgtactgatgcaagaggcggctcatgtaccagtgctgccacgggagcagcccttccaggaagccgatgtggccaccccgggctgtgatgagcagcgcaacgtagggggagtgttgggcggcctgtatgggaagggctaggagagggtcagaggttagaaacactggccttcactgggagcccaggctgtctgttgcgtccctcatggcccattttccttggggccaaagtgtcctgaatcagagtactcaccacagacgggggagaaggggtcatctgctgcactgagatagagcacagggatccggatggcatctatcttggttctagggcttgctgctttgtagtaggtaacacagtcttgatatccaaaggccacagatgtgtagcgctcatcaaactggcggattgtacgggcctgcaggtcttaccataggataggctaagatgataaagaataggaagatagtggaagactcatttgggggaaccaggggcatggctgaatattatacctgtagtacaaagtctatgtccaccaccttttcaatcacctttctgtttctgcaaaagtacataagagtttggcttgacacctggatctgatcccccacccccaggccctgtcttactatctcatgtgtgaggaagcccagagagaactgaccaagcactaggagagcctggagtgtctgccatcctactctgtctactgcctcctcccacttgccacgaccctaccgttccacaagttggcagagcccagcagtgaggggctgattgaagagcagtgagttgagtggggtttccagggagcgagtggtctcaaaggaatcccagcatgcagacagagtcagtgctgccaccagccctgcagcctgcctggcctgtgccaggtgattcagcaccagtatcctgtggaattggacaagggaccatgaaagaagggtttgcattaatgtgggttgggacagaggaaggggacatggaggaggaaaaaaaggaagactgggcctctgggctaagcccaggcaatctttaccctccaaaagagatgcccacggccagcagtggagcttggggataacgatgctttatgtggttcacgactgtctctagatcttcagtattgctggcacaaaaagccctgtgggtctgagggcaaaccagatcattgggtagggagggagaccgtggccagaaggtggaggggaaactgaggaaggataggtaggaggtgagccccagggccaaggatctctaaagggagtgggtgaagggctgctatgaggaaggcagctactcacccgcagttcctccccacggcagccccggttgttaaacacgacagccctgtggcacacacaggtacatcttagccagacccttcttagcccctctcccctttcagtattcagaaagacccctgtccaaagactccctttgtgtagcattcttcttatctatcagtgtccggattgacttctccctaatacacgttctcagatgccaccccactctggggctgcacccatccttactggtagccatccctcagagcttggttaactaggtgcaagacgtatgtatcctggctactgccagtgatgccaggaagcagcagcacaatgggctgggtagtaggatcagggtcttggctgctgtcaggctgcttggcccagtctagcaggagctggcctccatctggtgtttggaggatgtcactggttttggaggaagaggcacacaaagatactattaagaacttaatgtaattcaaaagctttgccccctgccccacccacaaacaagtcttatcacttcccgtcagcatcatctgagggtgttcttcatgtaaaacagtaaggcttgacaatgtgtgatggggacataaaagatgacctggtggccgtgcaattatatagcccttccatataacatccattgtcattgaaccctcaacacagggatgtagatgaggcagattacctacattttaaaagtggtagataggtttttccctagatacctggggtttcatgttcaccctgttctgtcccttcttacctctgataaaggactaggggctgagactgcaggaggacttggaagatgctttgtagtcgcccctcaaaac

SEQ ID NO: 6647 - DNA, 102 bp, Homo sapiens
aatggcgcgatctcggctcactgcaacctctacttcccaggttcaagtgattctcctgcctcaggctcccgagtagctgggattacaggcgcacgccaccac

SEQ ID NO: 6648 - DNA, 8143 bp, Homo sapiens
ctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggtgaggcgcgtgcggtgccaggtgccagcgggggacgcgggatctctccgaaggaggaggcgttgggatgggcttctcttggatgacagcaggagactttggtgggggtgtccgtggggaggtgggggtcgggaatggggagatctctccagtagttgacgggctggggttccctctgatgggggagtgcttggggatgcaggtccttgcgataaggggccgataccacctcccgggctccttccgcactctgctgggtaaggaccctctagcacccaacccccagctccctcaggcctgatggtccccccacctcattcctcctcctccacatcgtgttccctccccactcagagctaccagcccctactcataccaccactccccaggattcaagcctgatctgcgtgtgaccaaaaccccctcctctgagcctccccctcctcctccaggtctgagaatccttctccatgtctcccctcctccctggaacctagtggggggaaggctcatttctctccaccttcactgtccatttctcttctcaagctccctccccatctccctcctcagagctaagagcccccactaatatttgtagcctctcccaacttcatctccatctggctagatgtcgtggggagcggggaagcctttccctgcctctgctgaatgctccggtccccccaccctcctcctgcccctccccatggcctgagccccctgtcctcccctcccccaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcaggtgagggcccgccggcagggtgggccagcgtggggagaggtggcctgggaagggccgtccccagtcacccgctcccacctcccacagcctgcgtggaagcctatgtgaaggaggcagagcagcaggcctgtagccacggctgctggagccagcccgcggagcctgagccggagcagaaggtgggcctcccactgcggcctggggtcccttttcccaatacccccaccctcttcaccccgtgggaaatcttcattcacgtgcagaggctctgccagactctgcgttctataccaggcctgcagggcaacctccatccagccccgtcatgtctccagccttagttacatgcaacaacgccccccatgccccaccaccttttcaggaataagtggcagaaaacagccatcatttatcaaacatctgtcctggttcgggcctgacttcaacctgtcccaaatgtttttgtgtcacttggaggcacaaaggacaatgtcacccccatttagtgcccagggggcaacctcccaggtcatacacagggctgtgcaaggggcgagatttgaagccaccagagctgtggccactcctcacctcactcctcttaggcgcccccagagctgccaggtgctggtctaagcccttcccctgtgatgagctggtggtcactgtcacctggaggggctcagaactgcggctcagggtagagcaggcttgcctcgcaagcacgcacacactgccttatgggagaaataataacggttcatctattgtagtccaagcaatgctgcatcatggggaaactgaggcacagaaaatcatgtagcatagccagagacctaggggctgggactccccagaaagccctttccccacttcccccattttcctccaccccttcccagctttcactgctgttcagaaaagctcactgcactgtcagcccttccaattcagagctccctcttatttatttatttattttttgagatgaagtcttgctctgttgcctagcctggagtgcagtggtacaatcttggctcactgcagcctccgcctcccgggttcaagtggttctcctgcctcagcctcctttgtaggtgagattacaggcaccccccactacaatcggctaatttttgtatttttaggagagacagggtttcatcatgttggccaggctgatcttgaactcctgacctcaagtgatcttcccacgtcggcctcccaaagtgctgggattacaggcatgagccaccatggccggccatcagacctccgtcttgacgctgtcaaaataagaataatgaggatgatgatatttttagtaatagggactactacgcattaagtgcctgtgccgtgccaggcacctggcaggcatcctctagttgaaatttcatggctactccatgaaggaagagaacgatacccattttagggctcagagagcacaatccacttccctaagggtacacaggaagccaactgccacgctgagatctgtgttcactataagaagtcctattggcccaaatcacttagccacatccaatccaagtgaattctcctagctcctctcctgttagtttatttattcatttatttatttgagatggagtctcactctttcacccaggctagagttcagtggtgtgatcttggctcactgcaacctctgcctcctgggttcaagcaaatctcctgcctcagcctctggagtagctgagattccaggcgtgcgccatcatgcctggctaatttttgtatttttagtagagacagggtttcacgatgttgtccaggctggtctcaaacttctggcctcaagtgatcggcctgcctcagccttccaaagtgttgggattacaggcgtgagccaccacatcctgccccctcccattcattggttaatgccctatttcggtgccatctttgtgtcttggaccttttttcaccagagaaaggtcctggaggctccaagtggggccctctccctcttggacttgttttccaccctctgcaatgaccttgtcaactcagcccagggatttgtctcctccacctggacatactacttgcagactgacaatgggaaagtggtggtgtttcaggtgagacctctgacaggggccacgccagagtggcagatgggtgggcagggtaagaagatgggatgcattggctcttagctcatgagatgcaaagtccacagtgggcgagcttcaggcacagctggatccaggggctcagtgtctcactccatgccttgactctgctttcttttgtggtggcttcattcccaggcatttacttcttcttggcagtaaggtggatgccagaggctctaggttacaaacgctgtggtttttttttgttgttgttgttgttgttttgagatggactcccattcttgttgcccaagatggagtgcaatggcatgatcttagctcactgcaacctccacctcccaggttcaagtgattctcctgcttcagcctcctgagtagctgggattacaggcggccaccaccacacccacctaatttttgtatttttagtggagacggggtttcgccatgttggccaggctggtctcgaactcctgacctcaggtgtttcacctgcctcggcctcccaaagtgctgggattacaggcatgagccactgccccggctccctctggggttttaactgagctgggatttactctgattggccctggctggatcatatgaccatctctcaggcaattcactggcttggtctggatcatgttcctacttctggagctaaaggatggggttaaggcaaatggaggagcccatgaaagcagaaaacaacatccctgacatcaagcccacccctgatacccaggggaactgggtatcagctgggcgtgggacatggcagtcacagagggcctgcctgggcccaggggtgctgttctcacaagcctctctgtgctgtcttgttcctggcccagactcagcccatagtggagagcctcggcttccaggggggccgtctgcagcgcgtggaggtgacctggcgaggctcccaccctgaagccctggaggtgcacgtgggtaaggtgcaacctagaccagtgttccttccatgggtggccccactgccacaaggagtcggcctggcaaacagaccttctaggatcgggatctccatctctcaagtcctgggttccatggctcatcccccaggtctccatggtctatttcccagggttccatggtccacctcccagggttccatggtccacttctcagggttccgtggtctacttcccagggttccgtggtccatctccccgggttccatggtctatttaccagggatccgtggtccacctctcagggttccgtggcccacctcccgggttccgtggccacctcccagggttccgtgttccgcctcccagcgttctgtggtccacctcccagggatccatggttcactttccagggttctgtggcccatctccctgggttctgtggcccatctcccagggttccatggttcatctctcagagttccatgggttcatctcctagggtcatctcctagggtccatctccaagggttctttggtccatctctcagggttccatggttcatctcttaggattctgcagttcatctcccagggttctgtggcccatcccccagggttctgcagtccatctcccagggttccatggtccatttcccagggttccatgttccatctcccagggttccatgttccatctcccagggttccatgggttcatctcctaagggtcatctcctaggatccatctcccagggttccatgggttcatcttctagggtcatctcctagggtccatctcctagagttctttggtctatctctcagggttccatggttcatctcctaggattctgcagttcacccccagggttgcatggttcatctcctaggatccatctcccagggttccatggtccctgtctcagcattctgtggtccatctcccagggctctgatctccattccaggactctatgccccaggtcctgacctcctccctcctggtcatggttattgtggcctcttagcaaagacctggtggtcgctgagtggcagctgatctctcagaccctgtaggccccctggacaaggtgaggaaggccaagatccgagtcaagaccagcagcaaggccaaggtggagtctgaagagccacaggacaatgacttcctcagttgcatgtcccggtgggtggcaggaccttgggggtgggaggggggtgggactggaggtacgggtctccctggtcccggcctgggcagctgagtggtgcctgccgggcggggcaggcgctcgggtctgcctcgctggatcctggcctgctgcctcttcctctccgtgctggtgatgctgtggctgagctgctccaccctggtgaccgcgcctggccagcacctcaagttccaggtgggtgggatctgtgaatggcgctgggccgagggagggggtgaaggcagagagagctgtttgctggtcctggatttggccacctgctcccatggaggccaggacctcagacatttttttcttttttcatgtatatacatatatatacatatacgtgtgtgtgtgtgtgtgtgtgtgtgtgtatatatatatatataatatatatatatatattttttttgagatggagtcttgctctgtcacctgggctggagtgcaatggcaccatctcggctcactgcaacctccacctcctgggttcaagcaattctcctgcctcagcctccgaagtagctgggactatgggcgcgggccaccacacccagctaatttttgtatttttagtagagacggtgtttcaccatgttggccaggctggtcttgaactcctgacctcaggtgatccatccgcctctgcctcccaaagtgctgggattacaggcgtgacccaccgcgcccggcctatatatatatttttgagacaggatctcactctttcacccaggatggagtgcagtggcatgatcacagctcactgcagcctcggcctccctggctcaagcaatcctcctgcctcagcctcctgagtagctgggaccacagtcacgtgccaccatgccccgctaatttttgtattttttgtagagatggggactatgttgcccaggctggtcttgaactcctgggctcaagtgatccacctgccttgccctcccagaataccgggattacaggcatgagccacctcacccagccaggacctcacacttgctgcatgacttgggccagtttcttcactgccctttgaattggtgggaagaaaatccactcttagttggggcgacatgaagtcagaggtggccacacttctgtggtgttggcctcacctctatcatgcccaggtgtgttggtgacacctctgtggtgcccagagcctgggcaacatagtgaaaccttgtcactacaaatcatttaaaaattagctagatgtggctgggcatggtggcccatgcctgtaatcccagcactttgggaggccgaggtgggcggatcacgaggtcaagagattgagaccatcctggctaacaaggtgaaaccccatctctactaaaaatacaaaaaattagctgggcgtggtggcaggtgcctgtagtcccagctactcgggaggctgaggcaggagaatggcgtgaacccaggaggaggagcttgcagtgagccgagatcgcgccactgcactccagcctgggtgacagagcgagactccatctcaaaaaaaaaaaaaagaaaaaaaaaattagctagacgtggaggtgcatgtttatgatcccagctacttaggaagctgaggtgggaggatcacttgagcctgagagttcgaagctgcagtgagctgtgatggcaccactatactccagcctggacaacagagaagaccccatcacacacacacacacacacacacacacacacacacacacacacacacaaaagtccaggtgtggtggctcacacctgtaattccagcactttgggaggctgaggtgggcagatcacttcaggagttcgagaccagcctagccaacatagtgaaaccccatatctactaataatacaaaaattagctgggcgtggtggcgtgcacctgtagtcccagctacttgggaggctgagaaaggagaatcgcttgaacctaggaggcggaggttgcagtgagctgagatggcgccactgcactccagcctgggtgacagagagagactctctcaaaaaaagaaaaaaaataaaacaatcagaggtgggaaggagacagtcagggttgggggctcggcctctccccgtccctccacttccctcctcccctctcttcctgcagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctatgtcccctctctgcggggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaagag

SEQ ID NO: 6649 - DNA, 13275 bp, Homo sapiens
gcgaaagtccagcttcggcgactaggtgtgagtgagccagtatcccaggaggagcaagtggcacgtcttcgggtgagtgtgcggctgtgctggagcccgggttaccagctcttgcccgcgcggaataggctttaagaaatcggagctgcagccatctgtttttctcttaatgctgcatctctgttctcacggtggtccttggggtgaggttagagaaggagccgagggatcctgacaccacctccacagcaccggcgggcgaggtgccctactttaggcgtagccttctgcttttggagccagatgtctgtggacttctgttcgcgttcagaaatgccgcctcaaacttctctcaattgttcattaagtgaacttctctcattcccttcccctttgccgataattggaggggaaaagaagtaggaagcgggacacggtgtcctggggcaagggacttattacctaaaattcgcggccccttctgtccctaaaggttcttctccctgcccactttttggtctctttttagacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggtaaaggaactggggagtggctggggcggaaagtgatatcctcaggccaataattgtccatacagggtagtatgaggtcaaagactagcaatcctaaaggtctgagatcaattcaaaattaagggcatttaggacaaaatggctatgaaaagaaaaaaagaaaaaaaaattaagggcatgacaagtaaaaaaaaaattgagttgtgtgtccagaagaactataatttgcattgcattaatgaaataccctcaaatgcatgctcttagttaatctttcagggaataatagttatctctctttgccttgaggcccagttgtgctaaataatttgcacaaggtcatataggcattatgtaagtggaatgtatgttcaggttttaatagtatcaccatagcttcaatttgttgtaggtttcctgctaggccagggtttctcagttacagcattattgacatttggggctagacagttcttgtagggatctgtcctgtacatttcaagatgtttaatagcattcttggcatttacccactagatgtcagtagtgccttcccatttgtgacaatcaaaaaatgtcttcaggcacttcaggcattgctaaatggcccttggagtggaaatgaccctggttgagaaacactgtactaggtcctatgctaaacattaacatacattgtcagattttgtgctcttatagagtttctcttagagacttataaagttccatgagagcatggtccttgatgatgtctctcactatggactatcagagcttctcagttcctaggccatagtagacactctaaatatctgggttttttttgttttttgggtttttttgttttcgagatggagtctcgctctgtcccccaggctggtgtgcagtggcacaatctctgctcactgcaacctccgcctcccgggttcaagcagttctccctgcctcagcctcctgagtagctggaattacaggcacctaccaccaagcccagctaatttttgtatttttagtagagatggggttttgctgtgttggccagactggtctggaactcctgacctcaggtgatccaccctctttggcctcccaaagtgccgggattataggcgtgagcccctgcacccagcctctaagtatctgttgaatgaatgacataggtgctattattaaccccattctgcagatgaggaaactgaggccaagaatttcaagaactcataattcaaggtctcatagttactaagtcatggaattgggactcaaattcaagtgtttgcctctgctttgctttaatatcacatactaattttcataccagtcaataaattcgaactcagatcatcggtgtggcaagccacatttgcaggataatgacgagacagggaagggtgacaaagtagtaaaaatgtccatgtgggttggaatgattgtggaaccaaagagtagctgcacagagacatttgaggtgaaatggggtagtgttatcatagttcctagaaactactgtttgcccatttgctcagaggtaactgctgaaattaatctgtggttctgggctgggattctgccacaggttccatctgaggacagtatggagaaggtgaaagtatacttgagggttaggcccttgttaccttcagagttggaacgacaggaagatcaggtaagtgtctgagaagggaggattcaaggtgaaatgatgcagtacaaaagattcccaggaatgccttctgtgacaactgtattttctcccttctcagggttgtgtccgtattgagaatgtggagacccttgttctacaagcacccaaggactcttttgccctgaagagcaatgaacggggaattggccaagccacacacaggttcaccttttcccaggtatggagggtactggtttgtgaacaaaagaccaacatgtaagggcaactttattccctctttagagggaaagcttctcttcctgactgtgagttccttgtatatgcacacctacaattttgagggccctagttatgtgttagtcaatgtgtcaagtaacatatgtatatcagttctgaaaaattctattgttattatcattatttccttattttcctcacaaggatagtgtggctcaatgaatgtaatattgctgaagccatgtagctagtcactagtagagttaggacctgagtctagatccatgtatctccaaagcccatacttgtgggccattatattgccccattgtgtgtgcagcatcaggcctagggcatagcattccttaagtgtttgttgatttggtggaaagatggactagcagagagtgcttgagtcctcagtgtttagggaacagccagcagcattgcaggaagaagctgcttgagtggtctccagagccaaccactcaggaaggaatatatctgctggctctgcacaggaggcaagtgggagatgaaggagaggcctctaaaaaactgggtctctctctagatctttgggccagaagtgggacaggcatccttcttcaacctaactgtgaaggagatggtaaaggatgtactcaaagggcagaactggctcatctatacatatggagtcactaactcagggaaaacccacacgattcaaggtgagtagtaagccttcacgggattcctgattggctggtaatggtgttgtttttaccttttgagactctgagttagggggagaagggcacttgcctcagctgtccatctttcatatgcctccaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggtaaagcattggtatccatggcagtgggggtagggggtacaaatctcggggaagttttgtgcttaccttctccctgtgcccctccaggaggagctgtccacttccttgaagaggagtgtctacatcgaaagtcggataggtaccagcaccagcttcgacagtggcattgctgggctctcttctatcagtcagtgtaccagcagtagccagctggatggtatgtaccgtgactgggctctgccaaaaaatagtaggaactcactccctgttcctaatagctgccaggagtacagaccagaggttgcaatctaaggtctgccttccaaggcccctgcaggccaaaagagaggtgaactgctctaggttgatgccctatacattggcttcttctccagaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaaggtaaaggaacatggggaaagctggcatgaaccctggagggcaactggggagagactggcaaaagagttggatgttcccatcttacacccctctcctttggccccagatctcaactggattcatgtgcaagatgctgaggaggcctggaagctcctaaaagtgggtcgtaagaaccagagctttgccagcacccacctcaaccagaactccagccgcaggtgagtagattgtaagaataaactcttcactgtgttccaggaaacattagtcctctgcctggtcatggaaaatgtgcaatgactttttgtttttcttaacttccagtcacagcatcttctcaatcaggatcctacaccttcagggggaaggagatatagtccccaagatcagcgagtaagtttatccatttagaaatttgggcttcttggccataaatgatagttgggaaagcatggaggaggtcctcaggggaactatgtgttctccttctttgggtacagagattcttagtgggccgtcccctctccagaattatacaaagggccagaaggctcataacatgtgaggcccttatgtcagatcctgtgcatcattctaggctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtgagcttttgactataattcctgggctctgcaatttgctaagagacttcctggacaccactggggatggtgctaggatacccaaagggctggtgttctgctcacagctctattatctctgattctctgccaggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccaggtgagaagctagaggtgtgatgggtgtgcgcacttggaactggtaactctaagaaagctcctagggactacttatggagtcaagtaagatattttttttccctctagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggtgagaatacaagaaagctttagtgtagcagcttagtagctacacatttttccatggtgccttccaggtgggcttgtgccttctgagggcatgagcatctgatgacctctgacatgtgtgtctctcctaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcaggtactagctgagtgacccctcttgctctgtcacctgagacagagggtgggaagtaaggagttaggtggagttgtgcctcaagatctgttccccaagttcactcctcagaaccttcacttacctctcttttctcctctgtttctgacagtgaacatttggacacccaaaaggaactattggaggaaatgtatgaagaaaaactaaatatcctcaaggagtcactgacaagtttttaccaagaagagattcaggtgagttgccctgagccagctccaattagctgctcagatttccatcactagcttgcctgaagtaaagagattttataaactactccagtaagggcaggaatatataactcccttttctctattccccatagtgctttgggttcaatctatgtttggtgaattgattaagggtttagttggccaggaaatcgtattaagtgctaacaacaggttttcaagggatcagtgtcacaagtgctttgtttgttcagtcatctgtcttagcaatatttttctggctctgcaaagaattgtgctctctgcttccctcttaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaaggtgaggaaagagacaggcaggaaacataacagtggttcagggaagagctgttacttaaacccaggccttctaactcctgctctaacataatttcctaaactgcaagctacatccccctgacatttcaatctaggatacacatagcctcactttttatatttgctgcaagctactgttacctcagttaaagaggttagtccaaggctaaaaaaaccccacatattttaagtttcctgtttccttccctcagagttgcataagtatcagaaaatgttagaaccaccaccctcagccaagcccttcaccattgatgtggacaagaagttagaagagggccagaaggtaattaccaccattctctgtttaccaaactcttacctaaggcaatttcccacatccaacactctatcactggttcatgtgaagacaagatgttttttgtgcacagttctggagagtggctatttcactcagctgactagcctttctaattttacttctcttcaaatggctacctgacccctccagatcattatcctggttgctcttggccacaatatgattcctacttcccctttttcagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggttagggcaaactatatacccacttctgtcctaccagcccactccagtgtatatgtgagaaaggaaagaggaccagaagaaaaaggtaaagatttttaggctgaatttatagtgagagcagtatatttgcaaaataaaaataactattctttgttaagcatttactaagtaccaggcactgtgctaagtaatttataggcattttctgtcacaaccaccttagggaggtagttactgtcatatttcatctaagatgctactgattataagaaaccattattttatgtactactaagaaaaaagtaacaatttctcatcagtaagatgcatcctgattccaaagagattaaaatgttaaaattgtgtatcttaaactaaactcaacatttaatttgacatttagagactgaggcacttagaaattaaatttactcaagctcatactaccttatgtgttagaagatgtcctattcagcactgcttatgttttgttctcagaaaatgtccccttattcagttataagctccgaccttaaagagttttaatctttgaagaaacagttgttagtaactagtaatggatggtatgtattacccttagccctctcgtttctctaatataccagacaaaagtgttttctataactttattgatcttccttaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaattaagaatcaaacatcactctggaccatgggaaccttgaaaaggcatggcagtggagaccagtaactagtatacagcttgcctgagaaggcttagtaacaaatgaattcaagtcgtattagatattctaaaccttccttaatataagatgaagtgtcatatgttaggaggtaaaaacgtaacacaaaattctgggaataagaataaagtctggaccctgagctcagaatgatccatagcatctactgtgcaaatatattacagcagacattatagcatattacctcctgctgtacacacatgcacaggcctgaaactctccaagagcaccataagaatgattccctttacctcatctagataaaggctgaaaaaaatgtattctgttgcagatgggagggaaaaaaatagacaattacgttgaaaatttattaaaacagaccagcttgaagtgagtttattcttgtctgtataatcaccaatgttatttccaaatgtccgtgaaattatctataatcctatctccttgcttgctttggtaggagtatagctaacaatatagccatcttttgccctcagtaagggctatcagcagttccaagctctgtgagattatttttgcccttcttttattcaactctagttgaataaagttacttccaatttgaaagctttagaagacccccccaaaactgttttggaagattgtctccctagagagtaagaacaaatggatagctctattccatttaaacctaatctctgacatcagaatagggatcatgctcagcaaatccaagagcaaggtcatttgtatccattgctctgacttcttcctagggtactcagtgccctactgccagctcagggtagagtggcagactttcctcctttctttcactctcagcagcattgaaactttgttcctgtagcattgcctgtgctaaagtgctataaaagggactttcttgggggccaaaaaaaaaaagcattcagggaagaaggccaagatctatagccactctttggacataagtgagacagaagtacttctaactggcaagataatgtctgttcctgccaggattctgtcagttggcctctgaaggtaattatacaagctgtccctatggagctgttgccatctgtagaaacaagaagagctgaggtccttggaacagacgtgctgttctttacatggaggtaaggcttaattaagatgggtctaacaatgtgctggcttgagagtagccaactatggcgtgacagaagacaagttgagtggagaaactctgcgtgtgggggtattgttagcagagagtgaagcaggtaggaaaaagggagcaggcacctcggtggtaggagtctcgccttggttccgaagctgtaggatttgccggagtaaggccttaccttcttcccgggtctgcaacaaagtcagggaaatgtttcaaaacatgtccaaagctagtctcgaaaacaagttattaagatgctgttaaacaagttccacagatcaaggaggcgggaggcttgcttgttttttttttttgagatggagtctcactgtgtcacccaggctacagtgcagtggtgtgatcaaggctcactgcagcctcgacctcactgcagaggatcaagtgatcctctcacctcagcctcctgagtagctgggaccacaggcatgcaccaccaaacctggcaaaatttaatttttgtagagacaagctctcccttttttgtccaggctggtcttgaactcctggacacaagcgatcctcctgcctcagcctcccaaagtgttgggattataggtgtgagccgcttgcctggccaaggtaggctttccacttaaatatcttatgttctagcctaaaattcaaaccttttattaaagaactgatactcacatcattaaatgcacaacacttttgtgcacaagttgaagcttcatcccacagtttgcacttaaaatagtactgggccagatagcgaaaggcagtgctttcctccaagtgttctactatttcctagaaagggaaagcaaaattactgaggtgacagtaataatatcagcagtacaattctcatggtatgatacataccccacaggaatagatatcttggatatatttgatgtaacactgggcagcctgttctgactcagtcaactgttcatgaagcctacaaaagaaactgatctttaaataccaatgatatcccaaagcaacttagtgataaaaaaagtaaaagtacataagaccaaaaaaaacaatacataggtaagtatcaattttgacataaatgacactcttggaactagaatagtattagatgtgatagttactgttatcaaagcttagaatcattactctgctaatgatggaaggagagtcagtaaatattaatatctaagctagataaaccatccttgcaaaaattatctagtaatacccagagtaaagtggctcatgcctgtaatcccagcactttgggaggccaaggagggcagatcacttgaggtcaggagtttgagaccagcatggccaacaaggtgaaacctcatctctactaaaagtagaaaaattagccgggcgttgtgacacatgcctgtaatcccacctactcaggaagctggagcaggagaattgctttaacttggaaggtggaggttgcagtgagccaagatcataccactacactccagcctgggccacagaatgagactctgactccaaaaaaagaaaaaaaaaaaaaaaagctgggcactgtggctcacacctgtaatcccagcactttgggaggccaaggcgggtgggtcatcagagatcaggagttcaagaccagcctggccaacatggcaaaactctgtctctactaaaaaatacaaaaattagccaggtgtggtggcaagcgcctgtaatcccagctactcgggagactgaggcaggagaatcatttgaacccaggaggcagaggttgcactctagcctccgtgacagagcaagactccgtctcaaaaaaaaaagataacaagtggccaggcatggtggcatagggccataatcctagctactctctaatctggctgagaccaatgacttcaagaccaacctggtcatcacagcaagatcctatctataaattacaaaaaaaaaaaaaagataccaagcaactcaatttttttcctaagaatccagacaggaacctctttacatttaagaacctctttgcctactatttgagttattcctaatttttctggcccttagcaggaaattaatactgaaagtagtttgacacaaaaatgttatcctttcttcaaatcaatcttgatctcttgctttaataggaaagcaacggccctccttcaagagaagtagcattctctttttattttttttattttgagatggagttttgctcttgttgcccaggctggagtgcaatggcgcgatctcggctcactgcaacctccacctcccaggtcttgaactcctgacctcaggtcatccacctccctcagccgcccaaagtgctagaattacaggcatgagccactgcacctggccagaagtggcattctctaggaacaagatggctacattcacaaaccagcattcacacaccctgctacatccctacacctatgtagaatgatgggtgtatgggaggctctagaccatgcaggacccaccatcccagagaagccaacagaaatatcaatagcatttcactcctttcactcactttgccagtttcaccagagccattttctccacatctcccacggcgtaagctctccaataacactgtcaaaaaaataaactggtcattttgaccattgtcccatgtgtcacaactaaatcatatgaaggttaagaccctgcaagcctcccagaagttcagatttatagaatgcaagacatttttactagttctgataggtctaggctacacactgacattcccactgatgaccttggcccagctttgctttcagactatgtatctataaatattcagactttcctatgcacctagatcagaataagggaaaaattagagcacagatagcccaaccttcatctaaacagcagatttccactcaaattcttcaggacccaatttaaggtacctttttggcttccactagttgattgagtttctcgtaacattctcctaaagcaaccagcatgcgagaatcattgggtctgagaaagaagaacaggcagtctgagcaaagactttacagaaactgaagttctcttttgaggaaccagtacaccactatttcaaatctatgcaacaactggtctttaacctgatgctccatataatagattactttgtgttcataattatactattaacccattagtgaaatatactaaatgaaaataaccaaacagccttcagcaactttaacctcagatccccaagagccaaaaccatccactgtgatttgtcaatagctatcaaaagaggaaaaaaaagttattagcccttcccatatcagacgcattgtcaagtgaccaggcttaccgaagctggtgggcccgtctataataataaaggcagtaaaatggcatcttaaggatttcataggtctgcccgaggccataccaagctctgtagtcccgtttgttgacctcaatggcatgtctaagaaatggaaaagac

SEQ ID NO: 6650 - DNA, 39119 bp, Homo sapiens
ttcctattgtgtaaatacatttatttatagagtaaaaggcttagaaaagatctaatggaattgtctttaaatcaagccgatggaacaaagatgtgggcaacatttatggcataaatccaaacctcagcttcccctttttttctttatattatgtccacatgcatctttgactcgttggttgtgagttaaggtattattcttgttggaaaagaaaatgaggacatggcaaagaagtaccaggatcctctctaggtcagagttccgggagagattcaaactctagaaaaagtcaggatagcagctccaggttagaaaacaggttttccatcatctactgggttagctggttctccttccagactacttgagccttttcttttgtctaaccagatattcagtacctaaagggttaaggaacacatagcaagctattatgaaccttaaacactaaagtattgcaagtttatttttttggcaaatagactcaactatacttttttctttaaagtatgatgctacccagaaaagaaacccacaaatgtcttctagctactatatcttatcccctaaagatgggaaagtgtgaacgtacattaataacaacagatgaagcaaccaaaaaatacacagtgactccagcctctttggagtttagcccttgacttgaggctctggaagcgggaattcccattacttgtctatcctcagctctcttgagagctcttcactgctgcctgcattcctagactacttcactatcagagctggacttactgaggctcagggttttccaaaccagcaggcacattatcaatccttcagggccttaatcacctttaaaaataaactctgagaacacagtcacctcgaaatcacctttattctcataggcgttctgaaatcaagattccagaggctacaggtatctgcatacagtacctgaatctgctccaggacttctcgccgcatctccacagccatatggtatacatgatgatcagagtcattgtacattacagcattttggaacatcagcatcaggtctcgcaggaattgggccatggtgcgaatccgacccttagagagatttctcttcaggctagttaagtccatgggtctgcaggtggccaagaaaaaacaaagaaaatcaaaccttcatgtggaacatatgataacctaacacgttctcttgaagaactaaccagttcttaatgaaaacagtagcaaagataacaaccctcatcagataataaaatagcaacagcagttaatatttgcctgtttacaatgggccaaacactgtatttctatactaactcacttaatcctctcaataaacctgtaaggtaggtatcattaatatctcattttttttttttttgagtcggagtttcactcttgttgcccaggccggagtgcaatggagcaatctcagctcactgcaacttccaccttccaggttcaagcaattcccctgtctcagcctccagaatagctgggattacaggcgtgcgccatcatgcccagctaatttttgtatttttagtagagatagggtttcaccatgttggtcaggctagtctcgaactcctagcctcaggggatccaccttccttggcctcccaaagtactgggattacaagtgtgagccaccgcccccggccttattatctccatttcacagatgaagaaattgaaatctaaagaggttaagtactcactgaaaggcacacagcctgaattccaattcagaggcagcctgactccagagcccacaggtcaagccactatattctactatcagaggaggagtgctggccccaggtatcaaagttgtaaagagcaccaatcatcagtttatcacacagtagttatttgctgtttacaatgtatagtcatatattatttcatctacttctcttactgcacaaataaaaagctaagaataatttttttctcctttcatggagatgaaaaaaggatcaagtgaatattaagacaatattaatgagacacagaaagtagatatataagagaaggcacagcagtgtagaaagaagactgaactgcaggtaagaatctggggcttagttctagctctgctattaactgttggttgatcacgagcaagtcatgaccaagcacctctgagctttagtttcctcattcctaaagaagtttgtctctgctgtttgaatgatggtatcattgtctctgctgtttgaatgatggtatcccctccaaaattcatgttgaaacttaatcccaagtgcaacagtattaagaggtggagcctttgggaggtaattaattcatgagtgctctgccttcatgaatgggattagcatccttataaaagggctccatatcgaagagagtgccctcttatccttctgtcccttctgccatgtgaggatacagcattcgtcccctctgcagaatacaacaacaaggcatcatcttagaagcagaagcagagagtaacccacctcacacaccaaaactaccaatgccttgatcttgcacttcccagcctccagaaccaaaacaaagaaacatagatttctattatttataaattatccagcctgtggtattgtgctatagcagcacagactagtgactctccaaaggtcctatcatgatcttttacattctattaccatacaggtttatgacagcattttagatgacctatgctataaaaacccaaaataggccgagcacagtggttcaagcctgtaatcccagcactttgggaggccgaggcaggcggatcacgaggtcaagagattgagaccatcctggccaacatagtgaaaccctgtctctactaaaaatacaaaaattagctgggcgtggtgacgtgtgcctgtggttccagctactcaggaggctgaggcaggagaatcacttgaacccgggaggcggaggttgcagtgagccgagatctcatcactgcactccagcctggtgacagagcaagactgtctcaaaaaaaaaaaaaaaaaaaatccaaaataggctaggattacctgcctgtaatcccagcattttggaaggctgaggtgggaggattgcttgagactacgagcttaagaccaacctgggcaatctagtgagaccccatatctacaaaaaatttaaaaattcctcctcagtgatattctgaagaaaaataaagttattaataacatttcaaacaaagaaaatattttattataataaaaatatcaggccaggcacagtggctcacacctgtaatcccagcactttgggaggctgaggtgggtgaactgcatgagcccaggagtctgagacaagcctgggcaccatggtgaaactctatctctacaaaaaatacaaaaattagccgggcatggtggcacacacctctagacccagttattagggaggctgaggtggaaggattgcttgaacctgggcagttgaggctcagttatccaagaaatgtgccactgcactccagcctgagcaacagagtgagacctgtctcaaaaaataatagtaagtaaaaatttaaaaaataataaatttaaaaattagctaagtgcagtggcacatgcctgtagtcccagctactccggaggctgaagtgggaagattgcttgagcccaggaggtcaaggctgcagtgaaccatgattgcaccactgcactccagcaacagagtgagaccctgtctcaaaaaaatttttttaaataaaaaataaaaataaaatcccaaaatactgagaggtgaagctggctgggcttctgggttgggtgggacttggagaacttttctgtctagctaaaggattgtaaacacaccaatcagtgctctgtgtctagctaaacatttgtaaatgcaccaatcagcgctctgtgtctagctaaagctttgtaaatgcaccaatcagcactctgtaaaaacgcaccaaaaaaggtttgtaaacgcaccaatcagcactctataaaaatggaccaatcagcactctgtaaaatggaccaatcagtactatgtaaaatggacaaatcagcaggatgtggaggaggccaaataagggaataaaagctggcccctcaaggcagcagtggcaacccgctggagtccccttccacactgtggaggctttgttctttcactccgcaataaatcttgctgctcctcactctttgggtccgcactacctttatgaactgtaacactcaccgtgaaggtcagccgcttcgctcctgaagccagcaagaccacgaacccaacaagaccacgaacccaacgggaggaataaacaactccggatgtaccacctttaagagctgtaacactcaccgccaaggtctgcagcttcactcctgaagccagcgagaccaccaacccactgggaggaacgaacaactccagaggcgccacctttaagagctgtaacactcgctgtgaaggtctgcagcttcactcctgaactcagcgagaccacaaacccaccgggaggaagaaactccggacacatctgaacatccgaaggaacaaactctggacacaccatctttaagaactgtaacaccacgagagtctgcagcttcattcttgaagtcagcgagaccaagaacccaccggaaggaaccaattccggacacaatactacaatcaaccaatgttcataacttccatttggatcgacatctgtgccttactatacctataactaactgaataaatacagggttccttttaaagttttgctccaaaagaatagtgtcaaaaacaaccaaaggctaatttaagattataattaatgatcaggctggacaccaaggctcacacctataatcccagcctttggaaggcctaggcaggtggattgcttgagctcaggagttcaagaccagcctgggcaacatggcaaagctccgtttctacaaaaaatacaaatattagccggacgtgatggctcatgcttgtagtcttagctacttgggaggctgaggctggagaatagctgagcctgggaagaggatgttgcagtgagccaagactgtaccactgcactccagcctgggcaacagagtgagaccctgtcaaaaaaaaaaaaaaaaaaaatatatatatatagaatggatcatattacttaaaagtcaatagtacaaaataaaaaccctatatcatccttttgttccctgcattccttcttaaatgaagatatgatactgagctcatcataactttataaacttgtttggctatgaaacatatcttgagtttgtaagttataaaaataatctaacagatgggaaataaaaaatgaaaaggcagatataaaagcaaccaacctttcttgacccctttttcactgaccttttcaccacatccttgtaccctggggcctgcctttctgacacaggcttcagaaatggactgctgaacctgttaagggacaaacccagagaggataaagaaaccctggcaaggcactctgaaggagaagagtagctcagttcttagtagacttcctttaggggaatgcagactgtcagcaccattaggaaaaaatctatttgttccctcttgccagagagttaaaaaaaacacaaaactataaaatatttcactattattacaatatactgatttagggctcagaaatttgttcaaagttcccaaggccctgtctctgtgaaaaaagagaatccaccagattgaaaagaagaatatacattttaaatataaattttatcatgtagtaggaaccaatttctagaggcaactcaaatggcacagcaactatttcttgtacagacttgtgaaagcagctgtgggtactttgggataaatcgggcttagatacagaatctacctttcaactatggctcatttgagggatgaacatatctccttttatgcttaaaccccaatatgtattactgcttcagctctgaacataatcctattaccactttggagacctacctgtgactggcaatcatcttccagactggcaggagagtcttcttaaatagcaaatgatcctgaacagggtcatcctggcttagatcagtcctatgaggataaaacatgaagaaaagagacagtaacttcacaaataatattctatctcccccaggtgggtaatgaggttttcttaagacatgctcctaattaatatctgaagctttttatctccccttatctggccaagcagacttagttattaatatctattgttttctcttttaattttttaattttatttttctgagacagagtcttgctctgttgcccaggctggagtgcagtggcatgatctcagctcactgcaacctctgcctcccgggttccagcgattctcctgcctcagcctcccaagtagctgggactaaagttgcataccaccacacccaactaatttttgtattttccatagagacggggttttgccatgttggccaggctggtctcaaactcctggccttaagtgatccacccgcctcagcctcccaaagtgctgggattacaggcatgaaccaccatgcccagccaattttttttttttttgagacagggtcttgctctgttgcccaggctggagtgcagtagtgtgatcgtggcttactgcagcctcaacctgctgggctcaagcgatcctcctgcctcagcctcccaagtagctgggactccaggcacatgccaccacgccctgcagctaatttctgtatttgttgtagagacaaggtcccactacgttgcccaggctggatatctactgctttctaataaagatttcatatttaatctaaattgtaaggtaagaatgtggaatttaccatccaagactatgaactgtcatgagataagatgtctcagattgggcccggtgtggtggctcacgcctgtaatcccagcactttgggaggccgaggcaggcggatcacaaggtcaggagattgagaccatcctggctaacacggtgaaaccccgtttctactaaaaatacacaaaaaattagctgggcgtggtggcgggtgcctgtagtcccagctacttgggaggctgaggcaggagaatggtgtgaacctaggaggcagagcttgcagtgagccgagatcacgccactgcactgcagcctgggcgaccgagcgaaactccgtctcaaaaaaaaaaaaaaaaaaaaaaagtctcagattgcagatttcctgctgtttgtacagtcacagtatgtcatctctgcactctattgctcatacttaaggagttaaagaaaagcaaatgaaggcattcctcaccaatctacattttaaactgtatcctatttgtgtaccaaaaattgaaatctaggctgggcacagtggctcaggcttataatcccagtactttgggaggctgaggtgggattgcttgaagccaggagttcaagacccagcttgggcaacaaagcaagaccctgtctctatgagaaaaaaaagaaatctgctcttcaaaaaatatatatatatatatatattcatatataaatatatgcatggttcagctgtatatcttaaacaaaaaaacactagaataattattagttttacctttccacagacaactgggtggatctgggatatactgaagaaaaaaaaaacagttcatactatattctctcaacagatggatctgacacaggctggaaaaagaacaatttatttattaccataacaaaaataactttgctggacgtagtggctcatgcctataatctcagcactttgaaaggctgaggcaggagaatcacttgaggccaggagtcacagataaaaacaactttgtttttctgctttaaaaagtaattcacttcatgccagatgcagtagttcatgcctataatcccaggactttgggaggccaaggcaggggatcgcttgagtccaggagtttgagaccagtctggtcaatgtgatgaaaccctgtctctaacaaaaatacaaaaaaatcagctggttgtggtggtgcacatctgtgttcccagctattcatgaggctgaggtgagaggatcacctgagcccaggaggcggaggctgaagtgagccaagatcatgccattgcactctaacttgggcaacagagtgagatcctatctcaaaaaaaaaaattaatatttttttggtttcctgttaaaaaaaaacagcccccattaagatttgaaaatgtgttatttagtcctataattatctatacaaagatgagacaattgcataaaccaggggtgtccaatcttttggcttccctgggccacactggaggaagaagaagaattgtcttggaccacacataaaatacactaacaatagctgatgagctggaaaaaaaaaaaaaaaaagaaaaaaaaaagggaaaaaaaaagggtcagtgcataaatctcataatgttttaagaatttgtgtttggccacattcaaagctgtcctgggctgcaggctagggattagacaagcttgacataaacaatcccctaagagatgtgaaaaagaaacaaagatcacaaacttcaaaataatttttttcttctcttttatttcttgttttgttttctgagacagggtcttgctctgtcacccaggctgtgtagtgacatgatcatagctcactgtaaccttcacctcccaagttcaagcagtcctcctgccttggcctcctgtgtagctaggactacaggtgcatgcccccacacccaataaattttgtttattttttgtaaagatgaggtttcactatattgcccaggctagtctcaaaatcctgagctcaagcaatcctcctgcctctgcctcccaaagtgctgagattacaggtgtgagccactgcgcctggcctaattttttctttaaaaaaaaatttttttatcctcttccttgtctccatcaaaataattttccatttcaagttcataaaatctattttaatatttttaaaagaggtatagtttgggccaggcacagtggctcaagcctgtaatcccaacactttaggaggctgaggtaggaggatcacttgaaaccaggagttcaagacaagcctgggcaatatagcaaggccagccctgtctacaaaaaataaaaaatcagctgggtgtggtggcccatggctgtattcccagctacttggaagcctgaggtgggaggatcccttgagttcaggaagtcaagctgcagtgagtcatgatcgtgcccattgcactccagcctgggtgatggagctagaccctgtctctattaaagaaaaaaaaagcaccatagtttgtatattaggcatagtttgtataatattagctccatcacccaggctggagtgatacagacttggctagagtacagtggcacaatcatggctcactgcagcttgacctcctgggctcaggtgatcctcccacctcagcttccggagtacctgagactatagacaagtgacaccatacctggctaatttttttttaatttttattttgtagaggcatggtctccctatgttgcccaggctggtctcaaagtcctgggatcaagggatcctcctgccttggcctcccaaagtgctggaattacaggtgtgagccaccacacctagccttgaaagacagtcctaatattgattaaacatatttgttttataacaggagagcatatagacttctatttatatgatgttaaaattatacttaattaattatattttttgtgttttccaactctaattttctttaacttataaaagtaatccatttcatgattcaaataggcataaacagaagtatgaatcttaacaaacttggatgaaagtctacgcttacagctttgaggaggtagcatggctgaaaagtgtatccaccaagggagtctccttaatgttaaaggcatcatcacactcgcctgaagggggctggtcttccatctctgacacatatacttcaccctggtcctcccctttggattcttgctgagcctccccctaggaatgccaggaaacaggaaactttagaaggagatttactttctgcatagtaattttacttgcatagagtaaatgaaggctgcccttaaggtgagaagaggtcaattacataaagctacaaaagaaattaaagaaagctgacttaactagatttaagttaatgagttcttggtaacaatcttgctggaggactttgactctgtgccactcacctccagcaaaatggaaaagcattatttgcccaattctcattggattctttaaaaaccatcatgatcacctgtggccctggagttaactactctagctggccagataattttttttttttttttgagacagggtctcactctgttgcccaggctggagtgcagtagcatcatcatggctcactgcagccttgcactcctgggctcccccgagactcctaagtagctggaactacaggaacatgccaccatacctggctaatttgttttttgttttttgtagagatggtgtctccctgtattgcccagactggtcttgaactcctgagctcaagagatcctactgcctctgcctcccaaagcactgggattacaggcatgagccattgcaccccacctgccagataatattaataatgatgacggtattctaaattttactgattgcttactataagccaggcactgtgctaagtgctttacatgaattatctcatttaaacctcacagcaatcccacaaaatagggtgctattattgcatttctgcagagaaaactgaagttctaaaatgttcactaacatgctaaaggtaacacagctaaaactggtgctaaatccaggatttggatccaggtagtttaactttctggagttagcctatgtgctctaactactctgttctgcttccctaggcagaagaccaacaagacagctgatttaagttaccttcttacctcttcactctctgtgagtagtccctgaactgtacaaataactgagggagctgaagccacctctggctttccattttctcccagtggcttttcagctactaaggggtctcctttagctgaaagctcttcagtctctctgcagagctccctttctccttcgctagctttaatttcccttccttcttgtctggtaccagatggagggcagcagccttcacttgattcgttgctgctgatgcacaagggctccattaaataagctacctgcaatcaaagtttattattagatgcacaggaacaccactgaaaatcatcatccacatatcaacaatgccacatgctaacactgtcacagtgactaagtctgagaggacaaaatggtttaattaatacaatcatctaaaatctgccaaaatatcttatatacacaggcactgggctggttggtggggacactacagtgaacaagaaagatatggttcttgcctcttccaggagtttatgttctactttttcatctcagctgtcaactctgatcaattgggagtggctgtctagaataaagtgttgaaaattttgtctaccacagacacttgtagagagaagtggcaacatttgaaatggatgcttgctgatcttgatctagggtcttctaaatgtgttcaataacagcatacatataactctctgtccaattctgtttatttctggtcctcagcccttaaccaaggtaatgacacttaaaaatactaccttaaagttacagcattttaagcttcaaggaaaatttgggcaagtataacttcccacaactccaaaagcatgaattacaaggatactcataaagcagtccttatgacccaggcccctaatgactgaagtattagaaattcagtcaaaaagcatgttttttttatttttaatttttttacttttgagacggagtctcgctctgttacctaggctggagtccaatggcacgatctcagctcactgcaacttccgcctcccgggttcaagcgattctcctgcctcagcctcccaggtagctgggattacaggcacatgccaccaagcccggctaattttttaattttaattttaattttaattaatttatttatttagagacagagtttcgctctgtcgcccaggctggagtgcaatggtgtgatctcagctcactgcaacctccgcctctcaggttcaagtgattctcctgcctcagcctcccgagcagctgggattacaggcgcccgccaccacgcccggctaattttttgtatttttagtagagatggggtttcaccatgttggccaggctggtcttgaactcctgacctcaagtgatccgcccgcctcggcctcctaaagtgctgggattacaggcatgagccactgcgcccagccatttttgtatttttagtagagatggggtttcaccatgttggccaggctggtctcgaactcccaacctcaagtgatccactggcctcagcctcccaaagtgctgggattacaggcgtgagccactgcacccggcccaaaaagcatgtatttggtgcatattctgtatcagcaccaagtgctgaggacatagcaatgaacttaatccctgccactgtggagcttatattttagtaaacaatattaagagtggtagaagcatgtaaggataagcattctcttagaaagttgaggcttttccagctttggaaataagagctcactgttacctcagagagaaagtggaggaggttctggtggctggctttccttgccgcttcctgagattcctcactgcctccatccccaacaagcagttcactaggttctctctccgggctgctttcctctagttcctcagcctctggatcctcagtttccctccagttgcccacatcaagatccagactggagtcccatgagctgaagagggacctgcagtcattgctcaactcagagtcattgggatgatcttgttcagaatccagccaaacccactcgtgtcccatctgtaaatacacaggaaaacatgcattaaattcattcaaataaatattcctgaggcatctccatctcccgagttcagtagaaaaataaggggccagaaatttatttgtattcaagtattcatcattaggaagaattaaaatcttgctgaagggagacatgagatgaaattatatttgtctttgggaataaagaaagccccatgtcagtataacagagatattgcaccatacaatacagtataatagagacattaatattacctaataattatttttacttggaattcctcatattcacaccaaaagaagggaaagaactggagcatagctagctcaattattttcctctagcccaaatcatccataactaaaccgtaaggcaaacaaattgagggggcaggggatattttcctcagtgtataaacatttttaacctatgaaccattaaaccttcaaaacacactttaggattgcctttggcatccttctggtcatatccaaattgatgttgagaaacattaagcttaaaatatatcttcccttgctctcattacaccactatcttggtttttttatatctttctttgtcctctcccttttacaactttcaataaatccctaccttctatgttcatgcttggtcctctgctttcttattaatgtattttaaaaaaatgtatatatactttgaggtttcaactttgacctctattcaggtggctcccaaatctctctacctttacttcttatatgaattctggtgtcatttctccatgcatccaaaagtcaattccctttagatgctctaccacctgctgtaacatttctaaaataaaaatcacatttcctttatctccaaaatcactgcttcttcccaatttccttatccccatcaccattttcttttcttttcttttttttttttttttttttgaacgaactttcactcttgttgcccaggctggagcacaatggcccaatctcggctcactgcaacctctgcttcctgggttcaagcaattctcctgcctcagcctcctgagtagctgagattacaggtgcccaccaccatgcccggctaatttttgtatatttatagagacggggtttcaccatgttgactaggctggtcttgaacttctgacctcaggggatccacccacctttgcctcccaaagtgctgggattacaggcgtgagccaccacacccgaccccatcaccattttcttagtctacagaacccacaattctgttttgacccttccttctcttatattcagtaagcaagtcctcttcccagttttctcccacaataagttttctcagtgtccatcctttcctgaataaatgccatagtctcctagtcagcttttctatctttaatcctatctgctctcaacaaatatagttattctactcaaggctttataacagctatcacctcaaatataaatttctcaatctgccaaagtcctccacaaatttagccttattttgttcccttcactcacatgtacacctccttattccttagtataatccctgttctaattacatttttctccgtattgccacccaccacccccaccagatgcctacaccttccattcggtttgctagtctcatttatcaccttctctaccaactcaaaacgtatgtcctttaatggaccttttccacacacttctcccagcttttagagcttgtgtttgtatctcatgcctgtttgcagactgctttgggactacaatgttattttttattttcctttcttgtttgcaacatgtccatgtaacaaggaatttcatgttctaactcctggactaattgaatacctttccattgcctcacaaagactgtatcttctcttccttagcatcctaatatagttctattaaaggcaaaaagatctgtgacttctaatcgtatcctcttaaacccttctcaagaagactttgactattagaccaggctccagtgtgacatattgtctaaatatttagttataaagtgatattcatctaatattttttcatcatagccatgtttataataaaaagttcataacttttttttttttttttttgagatggagtcttgctctgtcgccaggttggagtgcagtggcttgatctcggatcactgcaacctctgcctcccaggctcaagcacttctcctgcctcagcctcccgcgtaactgggattacaggcgcccaccaccatgcctggccaattttttgtatttttagtagagatgaggtttcaccatgttggccaggatggtcttgaactactgacctcaagtgatccgcccaccttggcctcccaaagtgctgggattacaggtgtgagccacggtgcccggcactatttcatttcactatttttaaaaatgttggcagggcgtggtggcttatgtctgtaatcctagcactttgggaggccgaagcgggtggatcacctgaggtcaggagtttgagaccagcctgaccaacatggagaaaccccacctctactgaagaaaccacaaaattagccgggcttggtggtgcatgcctgtgatcccagctactcgggaggctaaggcaggagaatcgcttgcacctgggaggcggaggttgcagtgagccgagattgcgccattgcactccagcctgggcaacgagagtgaaactccgaatttaaaaaaaaaaaaaaagtttagttggccaggagcagtcactcatcacttaaaaaaaaaaaagttattaacagaagttggaattgaactgagattttaaatttaggggtgttttttctctgttgcccaggctggagtgcagtggcatgatctcagctcactgcagcctcaaccggccagggttgtgatcctcccacctcagcctccaatgtagctgggaccacaggtgcgtgccaccacacctggctaatttattatttgtagagacaaggtcttgctatgttgcctagactggtcttgatctcctgggctcaagtgatcttcctgtcttggcctcgcaaagtgctgggattacaagtgtgagccaccgtgtctggccaaattcagtaattcttaaaactgggcttagccttcaaacagcaatgttaagaactatatttatttgagaaagggtcttgctctttcacccaggctggagtgcagtgatgcaattataggtcattgccaactttgaattccgtggctcaagagatcctccagccacagcttcccgagtagctgggactacaggtgcacaccaccatgctgggctaatttttttttttttgagaaagggtctcactttgttgtccaggctggtctcaaactcctaggctcaagcaaccctcccacctcagcctcccaaagtgttgggctattttttttttttttgagatggaatcttgctctgttgcccaggctggagtgcagtgacgcgatctcagctcactgcaacctccgcctcccgggttcaagtgcttcttctgcctcagcctctcaaatagctgggactacagacatgcgccaccacgcccagctaatttttgtattttttgtagagacagagtttcaccatattggccaggctggtctcgaactcctgacctcgtgatctgccagccttggcttcccaaagtgctgggattacaggcatgagccaccacgcccggccgccaagaactctttatacagagtctttaaccataaaaacaggaaaaaaatggtaacacactatcctagaaataccatctgcaaagatagcattaagtgagacaaatgttcctgaggtaagggtcaatgctacctatgtccatgctctaatcttctttaagcaatgccatgaacagaattctaaaaaccttacttttcccaaacattcaagaaaatctgagtaaggaagtctttcctgcgcaatgcaacaccttaaggtatattaactataaactcaattctggttgcttaccttctcacactacagcaagcagttcataagacttttcccctgtaacaatctcattcctacaaatgaaatagttatgcagaagaaacaagtttcaaatacacacacacacacacacacacacacacacacacacacacacagaacaagccaaaggctagttttttttttcagtttattgtatacacacacatttcactggtggttgttttttttaaaaagtctgtacaattgacaagacaatacaaactagctacgatctgctagctacacattaggacattaacatagcccatggtttctgccctaaaacaggcaattgtgctactccaactctctaagagagattttccagctcatgtcgtgtggcccaggtacctcctcttctgtaacttccacctctggaactgggcccgcaagcccaagctctatcttgtttacttttattttaggttcggctcaaagagggtaactctgaggcttcactttttcatcttcatatctgcttcaatggcacagcggcgtcccctggttcctccatcctagatgacaggcagagaaagaaagggagcatgagttggtcaggagacaagagacggtgcaacagaaaagttggggatttggtttcttgggggagagggaagagaatcagcagaaaaatccagagggatgaggggcatatttctgtcttcccacagagtggctaaagaacacctggtagtttgtgagaggaaatgtaggatggaatatcttgctcatgcccactacagaggtccttggaattcacctagggtcccacagaataactattagtcatcccacccaggcccaaatcatgtgcaaaggagcaggagagtaaaagaaaggtaggagagtcagaatgggcaatgggtagtgaggttcttgactaacatacctgtccaactgttggtccctataagaaaggcctttcctgcagactgaccctggcactagttccctagcacctcctgacagtggttttccatgagatcaggacaattagaaggcttctttccatctgctgctctctccctgcagcccagctccttcctcttgtgcaatattttgctgtcttcaatagataaaagatcccattaaccagccttgcaatagccagccaaatgctttgcttgggggatccagagtcactgttgtaggccaataagaaagaacggagattataatgttctgtctgtggtacagcctgtaggcaagatgaattactgaaacctttgctgggccaggccatttttacatttctaatatgcaaggactctaaaatttttagagtccatgaacataagttgcccatgaggcaacagtgaaaataaaaaggtggtaaccttgcatgtgtataatgcttttcttttttttccaagccagtttcatatctattatctcattttatcctcacaacatccctgtgaggtaggctggacaagtacctcattatattagcttcatcacacaccaaggaaaacaatgccccaagagattatccaatgaccttaagaccatgtagttttctagcctgatgcccttccattacatcatacctcactgtcccataatgaacaacacagagtcagagccagttaatttatggaggaaagtaataaaagtctttaggctagctctcctaagcttatctgtaattccagcagccactattgatgcagtggtcacttttttttttcttttttttgtttgagacagagtttcactcttgttgcccaggctggagtgcaatggtgcaatctcagctcacggcaacctccgcctcctgggttcaagcgattctcctgccttagcctcccgagtagctgggattacaggcgtatgccaccacacccggctaatttttttttttttttttagtagagacggggtttttacatgttggtcaggctggtctcgaactcccgacctcaggtgatctgcccacctcagcctcccaaagtgctgggactacaggtgtgagccaccacacccagccacagtggtcattattactgagattgtttttttttttcttttgagacaaggtctcgctctgtcacccaggctggagtgcaatggtatgaacagtgcagccttgacctcctgggccccagtgatgctcctaccttgccttctgagtagcttgtagttagggaccacaggtgcgcaccactccgctgcacagctagtagggttttttgttgttgttgccgtttttaaattttgtagagacagggtctccctacgttgcccaggctggtctcaaactcctgggctcaagcaatccttccacctcagcctcccaaagtgttggaattatagacgtaaaccaccacacccagcctatactgagttctttagcttaaattttactgtttgttacattagtcttgcaacttaattttaggagacaagagaaaaactatttgctgagtactgccattatgagaaacactgttaaaaagccagctagcagctcctgctctgaccaattttaaatttgttaagaaaagaattggtaaaaggtgaagtcaggaaatgacgagcaggtacatcctagatccttcacccctagaatacatttcagcccagtgatctcaaaaacagtccctacccagcccacacacacacacacatgcagaaagacaggaatgcagaagaaaagagtttcttattcaatgacctgaataaacagaagttcaagacactgccacagtctgcatgttggatttccctctgccacccacccccattaagagctgagaatctttgtggcaacaccaccccttgcagccattcaatacttacaaagagagagagaaggaaggcaggagagcccattgggacactgtcctgttagaggacaaacaaacactgatcaggttccacagaaactctcagccacaagcaccccaaacctcaggacagagacacaagcaccacacacacaaggacaaaattttaaaactcaagaacaagaggaaagagatccaaaagcaatctgtccattacgcctctagcacagaaactgatggtccccaactgctgcaggctaagccatttcccccgccttgagagcactctcccagaggaattaataattcccctactcatgatttctcccatgtgactgggcctttcggttacaataggcttattcaacgtttagatgggtgcaaaccaccatcattctaagatctatgtgtctgtatatcattggaatctagaagcccaataccaagtagtaacataagggtccttggatgcttcagacttctactactggaacactggcacacaggttccttcctgatcgcctcaccttctctgaagcatcctgtttgcgggtagaatctctccctcgaagacttttagcactgatcccagactcggatgtttgcataatcaactgcgtggccaagaattgctgtagggagaagaaacagggtaggccatggagacctgatttagtagggacaaattaagtacactttaagcactgtaaatagaactttgtatagtactcttctggctcaaatatattttgactgattggaagtttagcatattaagttttaattctagttgcaatagggatgctaaagaatcaagcagccctaacttttttttgctataacataggatcaaaatctctatcctccaggaatgagaaaaataataaaactagaatgaaccaaagatcattcagcaatttaagtaatttgacaaatcgtgcaaagatttgcaatattcttccaagttcaacaccccaaaaagtacctggtaacacaatcataggataaaagcagggaaaaggaaaggagaaactcttatttgctgatcacctactatgtaccaggtacttaatgtaattaaaaaatatacattcaccatttttaaaaaattttatttaaaaactttatgaaactgcaaataattgcccaagaaaggtagaatattgtatcacaactctttcaccacaccaaagaaaataaaagtaagaacaaaatattatgttttcaattgtgtccctgacagctatccacgtaaaagccacagcaacccttcttggcatcaatatgaatcctccccttgaagtattttaatttcatccttgctgaaacacaaaggatcctcaaagtacctggatctgttccaagacatctcgctgcatctccactgccatgtgatagacatcatggtctgagctattgtacattacagcattctgaaacatcagcataatgtcacgctgaaattcagctgtgcttcggatcagtccattttctatgtttttcttaatagttgacaaatccataggcctaaaaaaaaagaacaggggtaagtagcagtggggatggaaagaggacgcacctagatctatgaatacattatcatatagactttctcatatataccttaactcccagctgccaggacttaaatgctaaccccttatcccaaaacatgcacttaacccaagaaacaatctatataataagcattgagaaaggtaataaagggagtttatttaggttttttttggagacagggcctggatctgtcactcaggctgtagtgcagtggcacaatcatggttcactgcagcctcgaacttccaggctcaagcaatccttggttcactgcagcctcgaacttccaggctcaagcaatccttcccacctcagcctcccaggtagttgggactacaaatgcgcgacaccacacctggctaagtcttgtattttctgtagagagggggtttcgccatgttgcccaggctagtcttgaattcctgggctcaagtgattcacccacctcagcacccccaaagattacaggcgtgagccaccgctcctggtggagatttattcttttagactatcagtggtgatctagccactggaattatcagtttagcactcagtgccccttatagcaaaaccataaacttacttgctttaaactttctatcgaaagcaaaacttcactaagactggacaatttataattcaggcaagttaccatgctgggtggaccatggctcacctctgcacaatgctgtggtagccaggtgctatgtcatctgtaacaggctgcaggaagacattggcatacctgtccaaaaggaataaggtgcaattactgacattctccagaagtgcagggagggaacttactctaagtaactaaaggtagtaagaactaataccagcagttccacagaagcctactcagacttttttccagtcaccaacaatgaagagtaggagaaaatgaacctactgactggtaaagcccactcacctatgattagctgcagctctccatacaagcatgatggctttcttccaaattttctgtgcctgaatagcttcctgatcctcactacagacagagctgaaacagagatacagcaattccactaggcacaagttaaaaaataaaaattataattctcttttctttttgagacagggtctcactctgtcccccaggctggagtgcagtggcatgatcatgttcattgcaccctcaacctcccagactcaatcctctcacctcagcctcccaagtagctgggactataggtgcataccaccatgcccagctaattttttaatttttttgtagagatagggtctcactgtgttgcccaggctggtctcaaactcctgggttccagcgatcctcctgccttagcctcccaaagtgctgggattacaggtgtgagccactatgcccagccctaattatttcttgtcagctgtttattccaggtcaaaaaagggaaacactaaagaaaagatcaggccaggcatggtggctcatgcctctaattctactgctttgggaggtcaaggcaagaagactgcttgaggtcaggagttcaagaccagactggaccacatagatcctgtcccttaaaaaaatttttttaaaataaaaatttaaaaataaagaaaaaggccaggcatggtgtctcacgcctgtaatctcagcactttgggaggccgaggcaggtggaacgcttgagctcaggagtttgagaccagcctgggcaatgtagcaaaacttggtttctactaaaaaaattttttttaattagcagggtgtggtggcacaggctggtagtcccagctactaaggaggctgaggtggaaggattgcttgggcctgagaagtggaggttgcagtgagctgagatcgcaccactgccctccagcatgggtgagtgagaacaagaaaaaagagaaggaaaggaaaggaaaggaaagggaaaagaaaagaaaagagaaaagacaggaagaaagacggaaggaaggaaggaaggaaaagatcctctcctcaccttcactgccttggcctcaaagaaagaatctcagatactcacaactgtgaagaagcagggctgctggggatggagtctgccagtgtgtgtgactgcagtgtagcattgtgtatgctgaagccatcatcactctcgctcacaggaggttcattatccatttctgacaagtagccttctccttgatcctcttccttaggctcctctaggctggccgcttcactgacaccatcttcctcctcatcctcacctggggcatccttagatacagtatgctccagttaacaaatgcaagcaaagctatccagcaaagcatcattaaacatgatctgtcttttgggttagaattagttctagaaatgacctcacgctgtttcctgactcagctgtctatcacttatactaccatctacttacagacactgcgttaagtaatttagaacctggacaaagaataatacccaggatcttttaaaaagaaagaaaaaaaaaagctacttacttaagactaagctaagaggcgttccttctttccccttgctcgagagtaactctgaccctgggtacaaagttatcaaaaataatttttattttgtgtctcatttgatggagcaagctcacatcacattctttaagcctctgttactgctgctttaataattctaaaaagaaaactctggatgattctctttggatagtctaattaataaacttgattcctgtatgttctccttggctcaggtatccttattcactacaaatcactctaagtgtatcaagccttcttaaggactgtgtgatattcacatgctgtttcatatgggaggcacctgttgctatagtactcccattatgcctgtctactgcagcttttccccatgcaactccataccagtctcttatcagagaataaagatgtgactttactgaaattcattaaaaagtagtgctatagggaaatctaatcacatggcaagaggaataaagaaaagtctgaaatacctttatctggcttccaaaaatagtccctgattcttctttcaatgagtctgcagaggagagaaagactacctgaagatttttccaccttagccttccccttcctatggaccataatcccctgcagctctcctttacatgctgacctgttctacctcctctacttgcccacaacccacaacccctcagaagccaaagcaaatgatttcaagtcagtgaaagaggactttatttacctgacatttcaaacttgtgctgagtctctgcctctaaaggatcttcaatgggatttgagccatgtgatggagacaacatgctttcaggggatgcctgaaaaccagaaaagaaaaaacaccctaagtactgataaatcgctatagctcacacaactttattcttcagtgataatgagaccatagaagaaattctaagtcctactcatgtaatgtgactccaatggtcaccttaacaggaataagtatatataacactaatcacagcctatgggctttggacacatcaaacatgtcagaactcaggaatgcaactggaaaaccaaaaagcctaagctgtcacttcttatctaaggtataaacctccatctccccagccccgatctttcttaagtacctctgtcttcacatttgtaagtggagtctcatcgcctttcccaatggcaacatctgcttcaacaatctctccagctgcagtacttcccagttcctcatctaagtcctgactcctgagttctggtggctccatacttgtggctggaacaactccagctactatttcggctcctgaaatgactggctctggttctgcaggttccaccttgatctctgcactgggctccctgatgtccaccagttcatgtattcccttgttttccgtttcctcaaagtccagtctctcttgcttgaccgtcatttctggtgcagggagaggtactggcttgtcccgctcctgctggataggatgctcccaggggccaggcagggactgaggatcatcattttcttcacaaaatgacagtgctgcttccactgctgccacatccagcacttcaggatgatcatctacctgtcccacaaaacacaagactattgaggtcacagaaagaagcccaagtccttcaatttttgttagcaccaaatgtgatggcttgaatctgcagcttttcgctccattttttccatgtagtggaggcaaacaatgaagaggcacctgccctgtgcaaaccagtaacatgggtagacctgaggagatgactagtatgttagcaccaaagggctacaaagatggagatgggcagaagtaggagagttgtttaagtaattcttactgtaagaagcaaagcagccgagtatggtggctcatgcctgtaatctcagcactttgggaggccgaggtgggtggaccacttgaggccaggagtttgagaccagcctggccaacatggtaaaactcatctctactaaaaatacaaaaaattagtgaggcgtggtggcatgtgcctgtagtcccagctactcaggacgctgaggcacaagaattacttgaggctgggaggcagaggtaacagtaagccaagatcgtgccactgcacttcagcctggatgacagagcaagactctgtctccaaaaaaaaaaaaaaaaaagcagcagcagcaccaaagtgaggctgaaaagagaagcctatgtaggacccatgagattctctggggctttgctgaatagttaccttgtcctcaatgatggcaatgatgtctccaacagtctcaaaatccagctcttcacctgtgtaagacacagcaatatccatcttctcagccagatctaattcttccttcccatctatgctgggagcctttgatccaacaggagcctctgctacccctgatcgaaaacactcttctttgatagaattgatgatcatggatatttcactgctgtccatggaaacagtcacagtatgtggatcccccacagcctccatgggaacacagttgtcgggttgactcactgagtaacagaaagagaaaagcatctcagaagcttattgggtacaaagcgaccaccttgagatcacataagcgctacagacagatgtcaaatatccaaacacttaaggtcagaaagagtcatcaacatgtgcctatgttttcttctccccagttttatctagaaaggtgagaacatattttcaagcctgctcatatctgtatacttagcctcttcctgcaatacataaatgcccacccacctcttctcacatctatttctaaggatatttatttctaaggataaagatggcacatgtctatgtagaacagagaagaagcatctgaatcggagctgatgctcttggtcatttttctctaactaaagctcaaaatgaaattttagatctagtggctgctcagggacgcacctggagctacactttcagtagtggagacagccggagcagaggatggtgctggcagcgcaggcatcatgacaatggtagcttgggacacagactctacagggggtggcacaagtttaactggaggctcactggcaacagtagtgaaggaagcaagaggtgtggtgaactgtgtaggaccagcttctaaaagccgggaaagagtgggagcacctaacatataaagaggtacacaaaatgaagtaagaagaaagcacataaataagaagcaatagctacttgaagactcaactaagaaaattcttatggtctcaaaggatgagagcaactcctgcattgaataagttcatcatctatatccttactctaaccttacttaagatcttcctccaagttaggaatgaaccaaagcactagaacacacaacatatataaaaaatgggtggtaaggctaggtgcagtggctcacgcctgtaatgctagcactttgggaggccgaggcaggtgggtcacttgaggtcaagagtttgagaccagcctgggcaacatagcgaaaccctgcctctactaaaaatacaaaaaaaaaaaaaaaaaaaaaaaaaaaaaaattagctaggcgtggtggtgggtgctgtaatcccagctattcaggaggctgaggcaggagaactgcttgaacgcaggaggtggagattgcagtgagccaagattgtgccaccacactccagcttgggcgacagagcaaggctctgtctcaaaaaaaacaacaacaacaacaacaaagggtggtaatttttcctcagaggaaaattaatcaccaagaaacgaaaaactggtatgaataaatctgtcgcttctgctgaagttcagcatattgtaaaccacccaagttcaacaccattcaaataccaataaggtttgtatggtattctatggagctttttttatttccctgctttatactttctacctcattaaattctcatcacatccttgtgaagtatatatgttacaataaaaaaggaaactgaggctcaaaagctaagttacctatccaaggtcacaaaaccaatgtgtggcaggcctgagattcaagcccaattctctggttccaaatcttattccactattctataatcttaggtatctctagcaccttgattttgcaagccctaagaaagcagttcaatattactctcaatatccatgctgtggtcaatcagggctatcactatcttgaagatagatggctttataatatggagactacattgtttaccaggtaaagtagctccaaaaaaaagttagaaaaagttgggctttaaatctagcactgacaactgcttagtaacagtgaaactgaggtcagtcaatgtcaagttcaacacctttgaggttgataaaggaaaagtggtaacttacctgatgcagcaggggaggctgcaacagtattgggtgtttgctgtatctccccaccatgtatcatgggaaggaccccgcctacctccaggaggacacctgtactgttcaggtggccagaagccacagccatttcactctcattgacctaccagggaagaatagaggtgaaggctacactcaagctttccttcactaccatttcccaacaaagctccagcagttgatcaaacttcatgaaaactaatagctaatatccacagagaataatttaagacccaagggaaactctaaactataatgttcaaaacttatttgacaagagttctctggagaagagaaccaaaataattgtgattcagatacctcaggacccatgggtactatcaacttactgtatttttaaaaaattaacatttaattaggagatcttttcctcttttgaacttttattccccatgtcacattttaggtcccaggcactcccttccaagtactaaatcaccacagctctcaaacacccacagaagtctccataccagtctggggctagtaggcaggaggctgcccttcttcaagagctctgacagcagaggggaggggggtggagttgctttctgtccaagcatctttttctggggtgaatcatctgttactggggtcatgggggcttctaagggtgcagagcctggaggaagggtgtcaggaatcccaggaaacgaggtgactggggtactcggcaaagtcccgggggttacctaagagacaacagagaacctttatctgacttctcaaactatggaaggttccctactaatctgtatgggttagtgtgtctaactattattttattagtcctgagtggaattgcccagaaaccctctatccctcctgctcttagccatacttttcttccccacaatcttctctttcatccactcaaacccacagtgactcaaccatcccacccaacctgccttttatgaactccttacccactaccaatattacatttacaaggattttgtcccttatttcagcaggaatttcataagactagtatgaaacaatttcttaaaatagttttttacctatctctcaaaaaggtcaaaagcctcaatgcttttaggtccgttcttatctcagagcacagaacatggtaaattaagtctttagcattcagatcaagagaggaagttgcctctaggccaaaagtggtttcctcatcgctcagctctgccggcttattgccccttcactgatcaattcccacagatggaaatatactcaccccagaggtagcctcttccatagtggttggagtcaagtccccaagtggataatcacctcctggggaggcagaatctataggagagcgaaccatcacagtgggtaacctccgggggggtgtttttactgcttgacgagctagaacataaaagagaacaatgtccaaatcttcaagattaaataaatgaaacttgacactagtctgctattatacaataaaggacaaataggtatgttgcattactaaagcagcataataagtttggattagaaagctttaacacttctagagatggataactttttagcctaatttttcctaagggcaattctcacactaagaaactcctttaacaatctcaaactacttaattatcccaaaggtccttggagtgggaaagtagtttaaacatcctttaatattctctttagcaacttactaatattctgcttttaagaacaggaaggccaggtgcagtggctcacggctgtaatcccagcactttgggaggccaaggcaggtggatcacctgaggtcaggagtttgagaccagcctgcgaaaccccatctctactaaaaatacaaaaattagctaggtgtggtggcagccgcctgtaatgccagctactcgggaggctgaggcaggagaatcacttgaacccgcgaggcggaggttgcagtgacccaagatcgcgccactgcactccagcctgtgcagcaagagcaaaactccgcctgggggaaaaacaaaaaacaaaaacagggaaagacctcactggcgcacagcatgtattcctagagttgtaaatgcttaaatttctcctcatctaatgactgagctattctcaatcttttcacaggcccttgacttctaaaacattatgttcaatatctcatcaagcctttgtgtcctgaagttaatttaaggtctagtgagatctgagcacaacgcatgttctaggagtttcttcttaagacattaagggatgtttttattctggtagaagagaaaactgcaagtaaatttaaatcaatgtattctatgttacaaaacagtccaactgtcattagcatgcagtactgtgcaatcaattgctaaagaggcatactaggttcagcttaccctggtatgcagcatctgtagccttcctctttacttcagcctcctcttcttccaatttctttttcctaaacagggaattaagggttagatgctagacagctctggctcctccccagagttcacagaacccttacaaagtaattttttttgccaggccagcactttctggaagaaaggcctaaacaggaattctaaccagcaaaacagtgaattggggtatactgcctaactcccagttcttcacccaggcaaactatagccactcttaagttagaactaagttatgttttcatactgaaatgtcccattatattaccttctaggactcactcccccctcccagccaccaaaccactttgcagctttccccttccagaatctgtctcaagtctaaagggacggcaattggaggaaataagccagattacttgaggggaaaagagggtaaaaagaaagaagcacagaagaacaatataatataacccacgttgcaatgtcattgcaaagctcatccagtctgctgtccatgtgtccagcttgaattagttctgcatctctctttagccgtctataggaagaaagagaggtaggtagactgggttttttaatctgctattttaaaagttctgaccagtaccagaagacagtcccttatgtctttctcaattttttggcattctctctgataagtacctatatctctcctgggtttcctttatcactttctttagttcttcaactcgctcagcagtcaatttccgaacaataacatcttcaacagtttccaccacttctcccttttcacctcgtttccgtctgtggaaaattgaaaaaaaaaaattcatattcaaataacataacatttatcccctctcctacttgcttttaccacttaatcatagataacttctgctattttttaatcatccagtatcataactaagtataaaccagaattcctcagtaaatactctccactaaagaaatatggctgaagtacctggctttgtactcactttggtgtctcagtggtctctaaaagctccgagtactgggaagcacaatgctattaaaaaaaaaaaaaaagtgaaaatgtgatgagcaaggctggaaagaaatgacctttcaaagtttcaagagattagagtaagatttagagaagagaactatatgtaagacgggagtggtttactaggagggcaagtaactttataatcaaatcagttcaaaataatcaaaacaagacacagaaaaagacagtcttatggactggagtttgtgcatttgcggaaaggcaacctaactgccaatatttatagctaatatctaccaagtagttactacatgcaaggcactgtgttaaatgttttacatgtattacttcaattagcttcacaacaatcctgaagcaactcttttatctctattttacaaatgaaaaaacagaggatcatggcccaaagtttttagatggagtaataatgaacccagatctaattcccaagcttgggctcttaactgttatgcaacaccaataagaaaggtctaatatgatcatacatggatggattagcaaacagtaggaaaaagaaaaaggtattctcaactattttcccacatcatggtataaaagctttgtaactaaaagtcagggcctggtagagaacctactttacaacccaaagactgctctaaaagagcccttgcttgggaacttactttttgagagaaccagtctggagggcggccaggttctgcaaagggcttgattgctctgctaactgataccctacaaaatgaggaaagctttattacacaccaagcagaaaacaataggagaggtatgctgagagtgcaaggcttggagttcaaactttggaataaaaaagatgcgaatggccaggcgcggtggctcacgcctgtaatcccagcactttgggaggccaagacgggtggatcacaaggtcaggagatcaataccaacctggccaacatggtgaaaccccgtctctactaaaaatacaaaaattagttgggcatggtggcatgcacctgtagtcccagctactcgggaggctgaggcaggagaatctcttgaacacaggaggcggaggtcacagtgagccgagatctcaccaccgcactccagcctggggacagagtgagactccatctcaaaaaaaaaaaaaaaaaaaaaaaaagccaatgaatgcgaggtgtgcaatggaccgtgcctgtaatcccagcactctgggaggcagaggtgggaggacagctcaagcccaggagttcaagccacccgaggagatcccatccctacaaaaaaaaaaaaaaaaaaaaaaaaaaaaatcgacaaggtatggtggtgcgtacctgcggcctgtggtcccagctacttgggcagctgaggtaggaggatcccttgagcccaggaagtcaagaggctgcagtgagcccaaatcgcgccactgcactccagcctgggtgacagagtaagaccaccccctccgccattcaaaaaaaaaagaacagcatatatagtatataatcatttgtgttagaaaatgagggggatgaaggggaaaaagaaaatatttgctcacataaaattttgctggagagacacaagaaactgctaacactagtagacgggggatagtaacgggaggaagacactgcatataattttgaatcttatgacttagtatctgctgataaaataataaaatttaaaacttttactcaagtattcttatactatttttctatggctgggcgtggtgactcacgcctgtaatcccaacacttcgggaggtcgaggagggcagactgcttgagatgaggagtttgagaccagcctggccaatgtggtgaaaccccacctctactaaaaatacaaaaattagccaggcatggtggcgtgcacctttaatcccagctactcgggaggctgagccaggacaatcacttaaatccaggaggtggaggttgcagtgagccgagatcgtgccactgcattccaacctgggtgacacagtgagactccatctcaaaaaaaaaaaaagattcttaacactatttatctaataaaaatgtgaggaaatatacagattagattctatttcaaaccagtttacctgttttgtttaaaaatgagctcaatttatatacatatacaaatatatgtgatgtgtatacacacacacacacacacatacaaaacacacattgtttttgtttagacagtatctcactttgtcacccagacttcagtgcagtggcacaatcatggcttgctgttgcttccacctctgaggcttaggcaacctcccactgcagccccacccaagtagctgaaatcacagatgcaccatcatgcctggctaattttcttttttgtagggaacagtttctcttatgttgcctccctggctcaagccatcctcacacctcagcctcccgagtagctggaactataggcacacaccaccagacctggctagtatttttgtgtttttttatagttttgtcatattgcccagactggtctccaattcatgatctcaagcaacctcctgccttggcctcccaaagttctgggattatagatgtgagccattgcacccagccccattctattctctagttctgtgaggtctataatttttcctagattccacatataactgagatcatatggtatttctttatgtgtctggcttatttcactttacatactatcctccaggctcaaccatggaatcacaaatggaggatttaattcttttttatggctcaacagtattccattgtgtgtgtgtgtgtgtgtgtgtgtgtatacatatatattttttctttacccattcatctgttaatggatactataataattaccttaattgtggatagtttcacaaatgtatatatatttcaaaaataccatgtcttatgctctaaatgtgtgcactggccgggtgtcgtagctcatgcctgtaatcccggcactttgggaggccgaggcaggtggatcatctgaggtcaggagttcaagaccagcctggccaacatggtaaaaccctatctctaccaaaaaatacaaaaattagccaggcatggtggcaaaggcctgtagtcccagctacacgggaggctgaggtgggagaatcacttgaacctgggaagcagaggttccagtgagccaagattgcaccactgcactccagcctgcgcaacagagactccatctcaaaaaaaaaaaaaaggtgcagtttactgcacatcaattatatcacaaaaaagttgttaaaagggaagagatgtgacttttcttaccaacccccttccttcttgttgcatggaacaaggatgtgatagctgaaggtcaagcagccaccgtgaaccataagataaccagaagataaactatgcactgaggaaggtggaacagaaagagaatatcctgagcctctaatgtcactgtgaagttgctatgagagctgtggactgcctagacttcctgtatgtgtgacaaaaaataaactcaagttttttttttttttttttgagatggcgtcttgctctgttgcccaggctggagtgcagtggcacgatctcaaatcactgcaagccccgcctcctgggttcacaccattctcctgcctcagcctcctgagtagctgggactacaggcgcacgccgccacacctgatttttgtatttttagtagagacggggtttcaccgtgttagccaggatggtctcaatctcctgaccttgtgatccgcccacctcggcctcccaaagtgctgggattacaggcgtgagccactgcgcccggccttaaacttaagtttttaacccatttctttgttgctattgctttctatatagtgtttttgtttttatggtggccacatattacttcaaaaattagatttaaaaaacaaacaaaaaaaatgctaggaagcatgacaatcagcaaagtactgaattgtttataaatgtggcaagagagttaaattcataatggatgattcaaaagaaagggggtgaggggctgataccgagaaaggtaaaatgatgatagttctaggctgggagtgatggctcacgcctataatcctagcactttaggaggctaaggtgggaggatcacttgagcccaggagttcaagaccagcctgggcaacaagtgacaaaaaacacaaaaaattagtcaagcatggtggcaagggtctgtattcccaactactcaggatgctaaactgggaggatcacttgaggccaagagttggagaccagcctggggaacatagtgggacctcgtctctacaaaaacataaatatttaaattaaaaaaaaaaaaaaagttcagcctgggcaacatggcaaaaccccatccctaccaaaaaatacaaaaattagccaggggtgatggcatgtgcctgtagtcccggctactcaggaggctgaggccggaggatcacttgagcccaggaggcagaggttgcagtgaaccacgatcgcactactgcactccagcctgggtgacagtgagaccctgtctgcaaaaaaaaaaaaaaaaaaaaaaaaaagtcaaacataataaagttactacataacccagcaatttcactccttgaataaaaaactcaagagaattaaaaacattgtccacaaccttgtacacgaatgtgcacatcatcagcattattcataatggccaaaaagtggaaacaacccaattgtctatcaagtgatggataaataaaacttggtatattcatacaacagattattattcagctaaaaaaggaattaagtattgatacatgctacataagaatgaaccttaaaaagtgttatgtcaagtgattaaaaaaaacaaaaaaaagtccagaagagcacgtatcattccatttgtatgaaatatccagaataggcaaatctacagagacaagagagttggctgggtatggtggctcacacttgtaatcccagcacttttggaggccaggactggtgcattacttcaagaccagcctggacaaaacctcatctctactaaaaatacaaaaattagccaggccactcgtggcgcatggctgtaatcccagctacttgggaggctaaggcacgataatcgcttgaacctgggaggcggaggttgcagtgagccaagatctaactactacactccagcctgtgtgacagtgagactctgtctcaaattaattaattaattaatagaaagtagatgagtgcttgcttgggggtggtgaggaggggacaacatggactgacagttaaggagtaaggggtttttcttagaataaaatgttctaaaattagattgtggtgatggttgcacaactgtgaatatactaaaaaccattatattgtacattttaagtaggttaattttatagtatgtgaattatatctcaataaagctgtttaaaaaaagaaatacagctggcctggtggctcacacctgtaatcccagtaggttgggcggatcgctcgaacgcaggagttcgagaccagcctaggaaacatgatgaaacccccatctctacaaaaaaataaaaaaaattagctgggcatggtggtgtgcacctgtagtcccagctactcaagaggctgaggtggaggatcatttgagcctgagatatggaggttgcagtgagccaagatcacaccactgccctccagcctgggccacagagtgcaatcttgtctcaaaaaaaaaaaaaaaaaaataggcctggcagtggctcacgcctgtaatcccagcactttgggaggccgaggcggacagatcatgaggtcaggagattgagaccatcgtggccaacatggtgaaaccccgtctctactaaaaatacaaaattagccaggcatggccaggcgcagtggctcacacctgtaatcccagcactctggcaggccgaggtggggggatcacctgaggtcaggagttcgagaccagcctggccaacatggcgaaactctgtctctactaaaaaatacaaaaattagctgggcgtgtccgcaccactgcactccagcctgggcaacagaaggagactcagtctcaaaaaaagaagaaaaagaaaagaaagtctacttacagcttaatatgattaactatagaaatctaccgatgtgaaagagtatctaacaatttctaagacccagaaaagctgacatcctagataccttaccaattttgatcgccacttctcatgacagaagatgctaaacatagcttctctcggatggaccatggctctgtggggccagtgcttagcagcttgtgttctgggaaagggagaaaaaaaaaaaagccttggaaacaaccactgagactgtagtgctaagctccaaaatccccaaaaagaggactaaaagcctaatacaaaacatcccaacttgttaggacaaagtgagctactataaccaaatcttgattttcacctctccaagtgaaatatcaccagtgaccggggtacctattcgttgcatgtgaattattaacattttatttcttaaaacgccatggcttgaagctccgctttattaagaaacagggaatgtcagattaggcagttctccctaaaagcccagttttaagaatactggactttattccagtttgaacttattcagggcttatttcccaggaacccgagcggccagcccctcctactaccccgcctccctcttagcataaacttgtttacttctctcagatcctctactccaaatgtcgggggtaaaagagcttttcagtccaaaaaaagaaaaatggctgaaatccccgagatgcaatttcctgagtggcaagaaaagctcatggttaaaagaccccacttccactgcctcacaaacgtcagacaaaaaaatgaatggctctttgaggtgccggttactccgtctggctcataacatcttttcgtctgcacgcccaagtttctagagtgcttttacggttaacccgcagagttcctaacacactaggattcactaagctgcttctctcacacctccgctctctccctgagaaacaagaccccagatttctgggcccccaaacgttggtcttcacgatgctgtagagcgcaggtctctgaaaaccctgggctctcaagcaacccacttctcccactccctaagcgtgtaacaaaaatatggtgcctagcctcggatctacaaaggcctttcacgcaaaacctgctcagatactcactgcccgttcccgtcgccatcttggccccgaagtctccaaccctgaggagagacggtctggaagggccgaaaccctggaattctgggaaatagtgtaccggcgttggttcgcggtgcctcctgggaaatgtcgtttttccccttaagacaaagcaagcaccctaaaccagttaccctgtgcactcctgttaagattgttgctaaggaaggacaggagttggctgctgaagcctcaagatttcctttaggctcttaggtaagaaatgtctaaggttcaaggaaaaaggttaagttggaagaatcccaggcaaaataagtgcgaatccacgaca

SEQ ID NO: 6651 - DNA, 2241 bp, Homo sapiens
agtagtgtaatcacagctcactgcagcctcaacctcctgagctcaagcaatcctcccacataaggctttcaagtagctgggagcacaggcacatgccaccaagccggggtaatttttaaatttttttgtggagacagtctccctatgttgccagggtggtctcaaactcctgagctcaagcgatcttcctgcctcagcctcccaaagtgctggaatcaaaggcatgagccaccacatctggcctatatatacattttcttagattatgctttacatcggtggttttcaaactatattccttggagcctaggtttctaaagaggtacccaggctgggcatggtgactcacgcctgtaatcccagcactttgggaggccaaggtggacagatcacctgaggtcagaagtttcagaccagcctggccaacatggcaaaaccctgtctctactaaaaatacaaaaattagccgggcatagtggcgcacatctgtagtcccagctactcaggaagctgaggcaggagaatcgcttgaacctgggaggcagaggttgcaatgagctgagatcgtgccactgcactccagcttgggtaatagagcaaaacaacatcttaaaaaaaaaggaaaaaaagaggtatgattctgtctcaaaaaaaaaaaacaggtacctcaagggttaaaaaggtagcattctgaccaggagtggtggatcacgcctgtaatcccaccactttgggaggctaaggcgggcggatcacctgaggtcaggagttcgagaccagtctgaccaataggaagaaactcggtctctactaaaaatacaaaattagctgggcatggtggcacatgcctgtaatcccagctcctcaggaggctaaggcaggagaatcgcttgaacccaggaggcggaggttgcggtgagccaagatcgcgccattgcactccagcctgggcaacaaaagcaaaactccgtctccaaaaaaaaaaaaaaggtagcgctctaagtttccctctcacacaagaatcaaagcagttctattctcattggtcttaaaaagtggaagtgaaagatttcagctgaagaaagtataagagccatctgtcttatatcaactggtgaataaacaaaatgtggcatatccaaacatggaatactactcagcaataaaaggaactactgatacatgctacaatatggatgaacctcaaaagcatgctaatggatgggaggctgaggtgggaggatcacttaaggtcaggagttcgagaccagcatgggcaacatagtgagaccctgtctctaaaaataaaaagtatccaggtgtggtgatatatgcctgtagtcccagctactccagaggctgaggcaggagaaagcttgagcccaggaattcacgccactgcactccagcctggtgacagagagagaccgtgtctcaaaaaaaagctaactgaaagaagccagacaataagactaaatattgcaagaatctatttatatgaaattcctggaacaggcaaaactataaagaagcaaagcagtggttgctgggggatgggaatgggactgactgcaaatacacacgagggaactttttggggtgatggagtattctaaactggattatggtaatggttacaactgcataaatttacaaaaactcattgaaatgtagacttaacattttatggtatgcaaattatacctcaataaaactatgtgtttttttggtgtcttttttttttttttttttttgagacagagtttcgctcttgtcgcccaggctggagtgcaatggtacgaccttggctcactgcaccctccgcctcccggattctagcgattctcctgcctcagtctcctgagtagctgggattacaggtatccgccaccatgcccggctaattttcatatttttagtagtgacagggtttcaccatgttggccaggctggtctcgaactcctgagctcaggtgatccacccgcccaggctggtcttgaactcctgggctcaagtaatcctcctgcctcagcctcccaaagtgctgagcccctgcactggcctaagctatattttttttaaaaagaatgaagagctacaccaagactaagaaggattttcatgaaatactgttgaatgagaaaaccaaaatgcagagtatgtatataatatcctatttttgtaaagcaagcagcccattaaaccttgcatatgtatatatacatattccttttaatgtg

SEQ ID NO: 6652 - DNA, 38771 bp, Homo sapiens
  misc_feature (7892)..(9416): n equals a,t,g, or c
gtgacttgtagctttaacaaaaattaggttccctagttgcagctgccagggaaagctagtctaatatcaaagcaaaccatccttcttctcaagcacagagtttttaagataggagtgtgtgtgtattgacattttcctagcagtggctgaagtcaaggaccaggagatttagggcccacttggagttcttatggtgaaacagtagtagcttcctagagacctttaaagcttatctgtaatttgtatagttcagaagatactgtatacatcattatttctccctgctttcaaaacaggaagggggtgtggagagtaacacactaaaaaaaggataagtaattaatttctgggtaagaatttccttttggcttaaaatggactgatggtgtaagttcctccctttgcaagcagaagctttgaagatagtgagctagatgaagctctggacatcttgaatgaagtattctgtataagaaccaagtgtataataactgttagtaatagaggctgctcatagaaatgtcattgcattataattgtagggacagtttgtcagagagtaggtagaagattatcagacccaggttttgttcttggctcacatgaagtcatcaagtaggctatttaaatgcttcactttaaccataggctaagattaaattaaaaataaaaagcttttgtcatggccgggcacagtggctcatgcctgtaatcccagcactttgggaggctgaggtgggtggatcacctgaggtcaggaatttgagactggtctgaccaacatggtgaaaccctgtctctactaaaaatacaaaaattagccgggcacggtggtgcacgcctgtaatcccagctactcgggaggctgaggcaggagaatcgcttgaacctgggagggggaggttgcagtgagccgagatcgtaccattgcactccagcctgggggacagagtgagactccgtctcaaaaaaaaaaaaaaaaaaagcttttgtcaattaaagatgcttgtcagtactgagtattcatgttgctatggcacttttataagaaaactgtacacggtcatatctgcttccgaaaataatacatagtgagatagtaattttacaggcaattaagaatttgctggccaggcgcggtggcttacacctgtaatcccagcactttggaaagccaaggtgggtggatcacctgaggtcaggagtttgagaccagcctggccaacatggcgaaaccctgtctctactaaaaaaaaaaatccaaaaaattagccgggcatggtggcaggcgcttgtaatcccagcaacttgggaggctgaggcaggagaatcacttgaacccgggaggcagaggttgcagtgagccgagatcgcgccattgcactccacctgggcaacaagagcaaaaactccgtctcaaaaaaaaaagaatttgctataatagaagatccatgtgtacattctgtatgcaaatcttaggaagatattagatcccagaaggttaaagttccgatctctatatatttgtatatgctttaaggagaagtggcatccatgtagatgtggtaaatggcttataactctcgaggtttccaatttctgctgtggtagcaattctaaactcagatggacttggacactactctggattactgtccctaaatatcaactactgtttataagccagcagaggccaactgaaatagtacacataaagttcctacagcatatccctcagtcagaagtggaaaagattgattaaagttggagtataaacatatggggccctgaccaaaaatattgaaccgtactactagaaatccccattctttagctaaaggataatctgacttcacttttaattcttcattgactattggtgctctgaaagaataggaaataatagcaaaacatgggaactcctagatagcatacatttatttttaaaatgtataccatcggccaggcaccatggctcacgcctgtaatcccagcactttgggaggccaaggtgggcggatcatttgaggtcaggagttggagaccaccctgggcaacatggtgaaaccccatctctactaaaaatacaaaaactaactgggtgtggtagcacacacctgtaatcccagctactcaggaggctgaggcagtagaactgcttgaacctggaagacagaggttgcagggagccaagatcacgccactgtactatagcctgggagaaaacaaacaaaaaacatatggtcaacttcccaagtaaactgaccaatgtcagtttaggttcagtcttactgtaggagtgcctgccgtaggccagcgcctctcaacctttccactaagtacattaagatcctaacagtaatcattgggaccccaggtcatcgtctcaacagaagctccagatttcttcaagtcttggccctcttgttttatatcaaaattttatgtatattatttttatattttcaaaaattctccccagatcatcaagtaatattgagatgctgacatagaaaaaagtagatttccagctggtatgatcagtgataaattggacttcatcaaaattaaaagcttttgtgcaccaaaggatactatcaagaaagtaaaaagctatcccacagaataggagaaaatatttgtaaatcataagtctagtattcagatgtctaaagaactcttagaattcaacaataaaaagataacccagtttacaaaatggatatgaatagacagttctctaaaagagacatatacatggccaataagctcgtgaaaagctgtttaatatctttagtcattagggaaatgcaaatcaaaaccacaatgatatatcatttcacacctactaggatggcaataatcaaaaacacacaaacagatgttggtgaagatacggagaaattggaaccctcaagcattgctggtgggaatgtaaaatggtgcagccacttgtggaaaatagtttgtcagttcctcaaaaagttcacagttaccatatgacccagcaattccattcctagggttacacccaagggaactgaaagcatagattcacacaaaaacttgtacacaaatgttcatagctttattataatagccaaaagtggaaacaacccagttgtccaccaattgggacaaattgaatgaatacacaaaatgttatatccacacaatggaatgttattcagccataagaaaacaatgaaatcctgatcacatgctgcgacacagatgaaccttgaaaaattgtgacatgaaacaagccagacacaaatggccacatattgtatgattccatttatatgaaatacccagaataagctaattcgtaaagacagaaaatagattggtggttgctaggggataagaggaagggtgaattgggaatggccactatgcggtacagggtttctaatgttctggcattagatagcagagatgaaaatgttctggcattagatagtggagatggttgcataacactgaatatactaaaatccactgaattgtacacttaaaaaaatgaagaaagaaggactatgcatgatcaaagaaaaaaatgctttgtgctcaagtagggatagaataaacagtaagactggaaagactgtgaagggccttgaatggcaagctaaggaagttagctttcatcttatagatcgtaggaagccaccagagtattttgagcaggggtggcatgtttaaggtagtgttataggaagtttaatttgtgaaatgagaaagagatactatcagccaggagaggtagaaggttctataaagtcaaattgaacacccgaagtttcagatttcatgaatgaccctgggtatgtgtgtatacacatatgtatgggatttgtagtcatctggggaaggctgaggtgctaatatgaatactgaaaactagagagggtaatatagcagagtagttaaaaatgaaaacactctgaacccacatgctgtctgggttcaaattccagctgggctaccttccagcactgtgaccttaggtaagtcactaaccctgtctgtgcttcagcttcctcttccgtaagataaggatacctactcatcaaggttgttttgaggattaagtgggttaatacatacaaagtgtttacaatgtcaagcttaaagaaaggtccccaaaaatgtcagctgctagtctgaaactccagagcaggtttgagagtaacccgctgttgttctctgccccggataaactatgaagtaacagtcctaaagtgttaaaagacaaaacaaatttttctttgtgaaaaatgaccctttaaaaaaactccatctactaataatgaagcttagtagtagtaaaatgatgatttttagccataaaacgggttttctatatcttcacaaatatagtgtagagtttcacaatattctttgatatgaaccagtctctcatactttctgtatagcactgattcgctaagtaagatgccaaggcatgacctcccttcaggaattgggaatctgcatttttaataagcatcctaggtaattcttttttttttttttttttttttgagacggagtctcgctctgtcgcccaggccggactgcggactgcagtggtgcaatctcggctcactgcaagctccgcttcccgggttcacgccattctcctgcctcagcctcccaagtagctgggactacaggcgcccgccaccgcgcccggctaattttttgtatttttaatagagacggggtttcaccttgttagccaggatggtctcgatctcctgacctcatgatccacccgcctcggcctcccaaagtgctgggattacaggcgtgagccaccgcgcccggccgcatcctaggtaattcttatgcatgatacaggttgagaccagtgccatgtacagaagtgggaaaaatggcttatgaaactcagttgtatttagcacactgtgttagacataaaatttgaaaacccaacctggacaacacagtgagacccagtctctactaaaataaaataaataagtgaacattgaaaaccaatggatagtagaatgtattcagttcagtgagacatgaaacaatatttttgcttaattgaatcaaacatatgttaaaaaaaaaaaaaaaactcaccctactcccaaagcactcaataaattcttcagagaaaaggaagagctttttgtactacattgcctctaaaatcttctgtaggataagacattttaagatcacttaaaatcttgttttaagtttttaagtctcattttaataaccaaataaaatggtttttatttgagccagtttcaagttcttaaagtgacacataggacttaacaaaatccattagttgtcatttgtgctttgcccatttttactgatttcttcatactctgaaggaaaaaaaatgctacaaatgtatgttggtatataagagagtgcattccataaatattagaaattttttttttctttttttgagatggagtttcactctttcgcccaggctggagtgcagtggtgccatctcagctcactgcaacctctgccttccagtttcaagtgattctcctgcctcagcctcctgagcagctgggattacaggcgcccgccaccacgcccagctaacttttgtatttttagtagagatggggtttcaccatgttggccaggctggtcttgaactcctgaccttgtgatccacccacctcagcctcccaaagtgctgggattacaggcgttagccactgcgcccggccagaaaaatattttatagaattcaaacttgtattttcttttgaagggatataaaaagggtgagagaacccaacaaccacacttattcaaatttataaggataattaggagtattctcatggttatctttagaatcttagcagggtaaaaaagagtttattgtttcatttgctgaaactcctgagaagaagtctcaccacatttgtatttacagagattagatttggcaactctaaagacaagagaaattactcatgataagtgtttggaggggttggagagaaaacagctaattaggcacttggcagtgtggcagggcaacctttgggcaacccagtccagattaggttagaagaggagcacggaccttttgtccactgcaaaccagtgccacaaatgaagtgggaagagacaggttaccacatactggttggacttgagagagaaccagaaagtgtacaatcccataagcataaaaaatggggataaaacttcaagtgtatataagggtaagaacaggaggaagcagtaacagagagggcaggagagaaagatcagaaggaatcggacgcctgagaagaggaactgggggctgagtcctgtcctggcctggccgctccccattcctccctctgcctctgagggcttcagttttcccaagtgagaaacagctgtgctagattgcttctacagtcctttccactcctggaccgaaacagttgcccctgcatctaaaatacgtagctctagcatataaaatgcaggttacctcaactcccccccgactcccacatctcactcccttcctttccctgcctgccctaattctggctgcgttctgttcttgcctcatatggactctttttctcctccccttcttttccaatgtcatgcagtctcttaacactgggtttcaaccactatacagaaaaatgttagtgaaaaaggaagaggggttccatgctgcttgattctccctaaccaggcacactaaactaggggtgacagtgtatcacaaagtccagactcacagtcttgctgccccttctcctcttcaaagtttgtttccgaagtaccaccccttgcacctcacatcccagccaactctgcctacctgtcagccccagccctcctcaggcctgcctcagcctcacagccaggatcctaccaacaccaacaccgcgccaaataacccctcccaaaagcctcaccggaactaatctggggactctgcctattattaggaacaccttggatgaagcccctacccgcagaattctggcagtagcagcagaattttcaggcatgtgcctaattttgttggggtggtggttgattattttttttaaatctaggatttctgggatctgaagcttatacaatcttggatatcttctttaagaaaaagaatacaaaaatatcttctataagttttacaaaaatatatgaccatgtgagcacgttgctagctcccgcccccaccccaccccccagagccttggaaggggagtgaaactgaagcttttttagcttcatggcaaatatgcttcttcctgagagtactgggtacattcacagacctttattttttactttctatagatttaatttagttaagtcagttcgaagcgggcaaaggccaaaatttctcacccctaggtggctcaaatttctgagcctgagattttatatcttaaaatccattaaaagaatactcaattttcggccgggcgcagtggctcacacctataatcccagcactttgggaggctgaggcgggcagatcacgaggtcaggagatcgagactatcctggctaacacggtgaaaccccgtctccactaaaaatacaaaaaattagccaggcgtggtggcgggcacctgtagtcccagctacccaggaggctgaggcaggagaatggcgtgaacccgggaggcggagcttgcagtgagccgagatcgcgccactgcactctagcctgggcgacagccgtctcaaaaaaagaatactcaatttttaagaagttaggtgtaggtatgcttatataaaatatttagacatgcataagtattttaagtggcctgaaggaagtacatgtatgctacttttgcaaatattttcgctttttttttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgcctataatcccagcactttgggagtctgaggcgggcggatcaccagaggtcaggagttcaagaccagcctgaccaacatggtgaaaccccatctctactaaaaatacaaaaattagccaggcatggtggcacacgcctgtagtcccagctacttgggaggctgaggcaggagaattgcttgaacctgagaggcagaggtttcagtgagccaagactgcactactgcactccagcctgaggaacagagcgagactctgtctcaaaaaaaaaaaaaaaaaaaaagaatgtaagtaatttgcccaagctgcagagctaaattttaaactagataattctgattccaaagcccagataatctggctagaagttgcaccaggggattcactgatttacaaagaattagaatgtgataaaattccctgagtacaggcaagtgtgatttttatctttgctagtaaagccatttagatgtcttaaagtgcctcaatctgttgcacctgttctactaaaacaaagaaatgagtcaacggcctcttttagctttaacattctctctgtctatacatttttatagaataatttttagttattgcagcaggtttcaccagtcagccaacgggtgtgtataacattaatcactagcactacacctcagaagtcttgcttattaagagcactcagcttaagtgaagaaattaaagaattttggtaggcctttgggacagttcaagtttaggttgtttggctgggttgagagagtaaaaaactaacatttcttaacctaaccctttttctttctttctcacaggtaacaactatccaatagcttacctttaaaatgtcccctctattgttcctccctcagacatttttgatcacttgtcccagtttccatgagtcctgtatcacagctgtcacaatgcttgagctatttaggtggaggtaactttcagaaatgaactgctgaagggtgcagagtgctcaagaattagattaacaaagaaagtacacctaaatttagcattaaaatgaacttttaaaatatttttcaataggaggataagcaaacataaaaatgggtgtgcttatgtctataaacaggtgctggagcatagattgttatctggacatcaaagaataatagagctgtagctttaaaagagcacacagctggttattagtgattcactcccaggtcactgccaagtgccaaggcatgtggcaagaatagtagaatggaaatcaggtgatgtggattctaatttgagctctgctctgttaaccttgggcatgccagttatcccctttggaccttagtctcttatctacctaatgaagggtttggagcaggtaattcttcagttctaagtaagaatctgtattcatgaataactgttcagcatatgactcagcccaaggtgtacaggattgctggagtgtggaaggtatgttggctcctgcctgtactagcaacaaggcttaatctagtgaacagaaaggatcaaaggtggctatatccccacctaaatgtccatgatctacaagtgctcttctagctggcagagtgggtcagtaatgagattttgtatctcattatatgaagttctaagcactgaacctaatcagttacccatcacttaagtagacagtgtcaggcagagcttaactctccttcctattttcctttgtcttccttttctctgtaagttctctaacataaggaacttccattttggtgaaagaatagaaaagttgagggacaggccaggtgtgttgtaagtaagactgatccagctgattggtttgccatttagattgcatggcagacatctgccataagcacttaaaacacaccttcaataggcattagaaagcacacacacggccaaacatagtagctcacacctgtaatgccaatactttgtgaggctgaggcaggaggattgcttgagcccagcagttcaagaccagcctgggcaatatagcaagatgccatctctacaaaaaattttaaaattatctgaatgtggtagtacattcctgtggtctcagctactcaggggtctgaggtcggaagatcacttgagcccaggagatcaaggctgcagtgagccatgactgtgccattgcactccagcctttgcgacagagcaagaccctgcctcaaaacacacacactgactagggatggtggcttatgcccagcactttaggaggctgaggcaggcagatcacttgaggtcaggagtttaagaccagcctggccaacatggtgaaaccctactctactaaaaatacaaaaatcagccatgcggccaggtgcagtggctctcgcctgtaatcccagcactttgggaagctaaggcaggaggatcacctgaggtcaggagttcgagaccagcctgaccaacatggtgaaatcctgtctctactaaaaatacaaaattagccccgtgtggtggcgcctgcctgtaatcccagctacttgggaggctgaggcaggagaatcacttgaacccaggaggcagaggttacggtgagccgagatcacgccattgcactccagcctgggcaacaagagcgaaactccatctcaaaaaaaaaaaaagaaaagaaaatcagccatgcatggtgacacacagttgtaatcccatctacctgggaggctgaggcaggagaatcgcttgaacctgggaggcagaggttgcagtaagccaagattgcaccactgcactccagcctgggcaacagagtgagactgtgtcttgaaacacacacacacacacacacacacacacacacacacacacacacacacataatttgctgttgttttgggggcatggcggcacatacctatagtcctagctacttgggaggctcaggcaggaggatcacttgaacccaggaagttgaaactgcagtgagctgtgattgtgccgctgcactccagcctgggcaacagagtgaagtactgtctcaagaaaataaaaaaataaagaaataaaaacataaggtttagatggcaactttaaaatgtgaaaggaggatatacagtttttcaaaattcttctaggagctatgccagcaaaaaggtttgaagacctgaagaccattatatcagtggcataaacatctttaatttgtccttttccttctcctacacctagtcaattgattttttttttcccatttatcaatttcagactctgcctggtttttcactttcccatccattttgttacaatatttttcctcccttgaaattagcccagtctcttggagtgaatgccccatgctccttcctaccgctgtgtctttactacattatcctcccttggaatgccgtcatctcttctctgttcaagaactacttctcccgaccactgtggtcgagattgatttctctttaacctctacaacattggctattccatacagttagcccttagcatagaacatcattgtttgattttgctccttaagaatagaaagcacctcttaaaattctaccatattcccccaatgcctaatgcaatgctaaccacatagtgagtgcttaataaatattgtattgactgcctagagtacagagcacttgttcactcattgttcggccattcagctaatactttttgagaaattttgtgtaccaggaactgtactatgcactggggtacggtagggactaaagtagatgataatccctgctttgaaagactgaaaagtaagatatatggtatgtcaaaaggtaataagtactgagaagaaaaatagaaaaagcaggaaagaagaacaagaagtgtgtgatgggggagggttacagggtggggaggggtagtgttgtatacacttctagataagatagggaagtcctcactgatacttatggtgacattttacaaaggacctgaggtgtaggaaggatttgagcttatctgtgcaaagagccttccaggcaaggaacttaccatgtgaaggcaccaaggctggacctgcttaacattccaggaagggaaagctttggggctggagcagaagggtagaggccagattgagagatgagtcagaggacagtggggcccgggcagagggacagaacctgcgggtgctggcaatcagccttttgatctgagtgagaatagaggccttgagagggctttgagcagaggagtgacctgctgacttaagttgaatagaaccctctagatgcttcattaaggctagactgaagggaggcaaaggcagggtgagatcagtcaggaggcaagtatataatgataatacattgaatataataatgatatattaataataataatccagagatagtggcaactcagaccaggggaagcagtagaggcggagagaagtggtcagattttggatttattttgaaggtagaacagacaggattgctgactctgttgagtagtcagctgggagctattgatggtttctgagcaggagctgaaggaagattaccccggtataggactgctgggaagacgtggtgcaggcagagatcaggtaggaggccattgcaaggatttaagggtgagatccataagggttttaactgcaaatcagcagaggaaaaagggagtggtgatggtcatggtgacagtgatggtgagagagactggaaaggaggaatcaacaggatttcatgactagataacagagaaccaatatgaagaaggaaaacactttttttttttttttgagacggagtctggctctgttgcccaggctggagtacagtgagacgatctcagctcactgcaacctccgcctcctgggttcaagcgattctcctgcctcagcctcctgagtagctgggattacaggcatgcaccaccacgcccggctaatttttgtatttttagtagagatggggtttcaccatgttggtcaggctggtcttgaactcttgacctggtgatccgcctgccttggcctcccaaagtgctgggattacagacgtggagccaccatgccctggcaggaaaacacacttttgaatgttgtgtgacctggagaatggtaacactgttaatttaaaaaaaaaaaaaaagcccagagaaggctgatttagggagaaatttatgccttagttatacagagtttgagatggtaatgaaatatcaaattaaaactgtccagcaaggaagtaggaaatgtggaactgaaaaagaagttagaactaaagatgtggatctgtctttggcataaagattatattaagttacttgagagtagatgagtttccaaagaagcagtgtagcaagaatagtggagggccaagactggatcctgggggtcagcaacatctaggagccagaaaaaatgccttcggtgaaagaaacggaaagatgggtctattcaaattgtagtcagccaacccatgccagaagtaagcacagaaagtaagagtgaacattggccaagcacagtggctgatgcctgtaatcccaacactttgggaggccaaggcgggcagattgcttgagctcaggagttcgagaccagcctgagcaacatggtgaaactccaactctacaagaaattagccggtcctgtgcacacctgtagtcccagctgctagggaggctcaggtgggaggatcacttgaacctagaaagttgaggctgcagtgagctgtgagcatgccactgcactccagcgtgggcaacagcccggtggctcacgcctgtaatcccagcactttgggacgccaaggcaggtcgatcacttgaggtcaggagttcgagactagcctggccaacatggagaaaccccatctctactgaaaatacaaaaattagctgggcatggtggtgcacacctgtaatcccagctactcgggaggctgagacaggagaatcacttgaacctgggaagcggaggttgccgtgagccaagatcatgccactgcacttcagcctggacaacacagagagactctgtcccaaagggaaaaaaaagaaaaagatccaggagatccattcctaggtatatacccaagagaattgaaaacataaaaacatatgttcacacaaaaacttgtacatgggctcatacctgtaattgcagcactctgggaggccaaagcaggaggatcatttgaggccaggagttcaagaccggcctaggcaacatagtgagaccctgtctctacaaaatgcatgaatgtttgtagcagcattcttcataatgttcctaaagtggaaacaacccagttgtttgtcagctgatgaatgggtagattatatgcagagtatccaggctgggcgtagtggctcatgcctgcaatcctagcactttgggaagctgaggtggacagatcatttgagctcaggaattcaagaccagcctgagcaacatagtgagaccttgtctataaaaaatttttaaatgttaaaaaaaagaatgcagagtatccatacaacgggatattattcagccataaacaggaatgaagtactgatacatgctacaacatggatgaaccttgaaaacatgctaagtgaaataagccagacacaaaggtctacacattgcctgacgccatttatatgaaacacctagaataggccaatctatagagacataaagtagatgaatggttgccaggctctgggagttaagagagaatgggaaatgactgccaacatgtatggggtttctacttgaggtgatgaagatattctgaaattagatagatagtggggatggctgcacaaccttttttttttttctttttgagatggagtctcgctctgttgccaggctggagtgcagtggcgcaatctcagctcactgcaatctctgcctcctgggttcaagcaattctcctccctcagcctcctgagtagctgggactacaggcaggcaccaccacgcccagctaattttttgttagtagagacagggtttcaccatgttggccaggatggtcttgatctcctgacctcgtgatctgccctcctccggctcccaaagtgctgggattacaggcataagccaccatgcccggcgacaaccttttgaatatactaaaaaacattacattttacactttgaagggtgaattttatggtaaattatatctcagtagaaaaaaatccaggaaactgtgtatagtcagccctccatatttgtgggttccacattcatggattctaagctaaataataatacaataataaaaatataaataaaaaacaatatgctatatagcagctatttgcattgcatttacattatattaggtattatgagtaatccagagatgatttaaagtgtatgtgaagatgtgcataggttacatgcaatactacaccatattatataagggacttgagcatctgtggtgtctgctgcgagtactagaaccaatccttcatggacaccaagagataactgtattcaaaaccaatgaaaccagtgaaagagaagtttcaaaaagattgaaaacacagcagggcagtcaaggaaaccagggagaaaggaaagactagtggatttgggtattagaagatgaaagattaaaacaaatcattccatatcagcatgcagtccatagactactcctaaaagttcctgagacttctttaaggaatctctttggggtaaaaattattttcatgatactactaagatgtatttgtcttttccctatgttgacacttgcactgatgttgcaaaatggtggtaaaactgctggcgccttagcacaaatcaggacggtgacaccaaactgtaccagtggtcactgcattctttactgccatgcactcacaatcaaaacagagccagtttcacttaagaatcgttgatgaagtggtaaattttttttgttttttttttttgaggcagggtcttacccaggctagagtgcggtgggggcatcacagctcactgccgcctcaacttcctgggctcaggtgatgctacctcagcctcctgagtagctgaggctacaggtgtgcaccaccacacctggctaatttttgtttttgttttgttttgttttgtttttagagatggggtttcactctgtcgcccaggctaaatattgttaattgtatcaaatgtcagtccttgaataaatcttttttttttaactggtatgcaccaccacacccagctaatttttgtatttttagtagagacggggtttcgccatgttggccaggctggtctggaactcctgacctaaagtgatctacccgtcttggcctcccagagtgctgggaggtgtgggccaccatgcctgatcctgagtacatctttttaaacttgtttgaagaaatgggaaatatgcataaaccgcctctgctgcacactggtagagtacggtggttgtcacaaggaaaagcatttgggcgattattcaagttgcatattgatttagcagcttcttttttcaccgaccaccatttttacttgaaagaatgatagacaaactatggttttagacttaggcatctggcagacagtctcttgaaactgtatgaagtgagcctgtcacttcaaggtaaacaaatgacaatatttgtagccagtgataaaatttacactttcaagtaaaaattagaattttggaaaacttgtatccactcccatgagcttgaccacttttcaatatatacagacttttctgctgaaatcaatggtgaaatttaaggaatatgattttttgatatgtattctaatgaaatatgtcagtatttagaagatctgcctaacaacagggaaccagtattttgcagtgatctatgtgtgatgttacaaagtcatgcatggtaaaatatccattcaaagtgcaagagaagccaatgggttttattataacaaaagttcctaactgttaagaaactactacttgtcaagttttgatgtagcgctaaagaatatccaaaattatctgaaaatgcagatactttctctgtctgtgtaaagccagattttctttgtatattttaaccaaactaacatattacaacagattaaatgcagaagcagatttgagaatccagtcatcttctattaagtcagacagaggccataaatttatgaaaatgtaaaacagtggcattcttctcattagatggctttatttctttgattgttttgggaaatatagtggtttacatttaaagtatgttatttatattaatataatgtgtagtagttttactgttaatatttttactgaattaatcatatcttttactttttttttagttttattttcttccttttttttttttttttgatttggagtctcgctctgttgcctagtctggagcacagtggcgtgatctcagctcactacaacccccacctcctgggttcaagcgattctcctgcctcagcctcccaagtagctgggatcacaggcgcctgccaccatgtctggctggtttttgtatttttagtagggtttcaccatgttggccaggatggtctcaaactcctgacctcaagtgatccacccacctcggcctcccaaagcattgggattacaggagtgagccaccacacccagtttttagtcttattttctaacacagtagacattgatatatagttcccacattaacaaaagttgtttggggtgctcaatttatttatttatttatttatttatttatttatttattttattttaattttctttttgaggcggagtctcactgtgtcgcccaggctggagtgcagtggcacaatctcggctcactgcaagctctgcctcccaggttcacaccattctcctgcctcagcctcccgagtagctggggctacaggtgcccgccaccacacccggctaattttttgtatttttagtagagacagggtttcaccatgttaaccaggatggtctcgatctcctgacctcgtgatccgcccgcctcagcctcccgaagtgctgggattacaggcatgagccaccgtgccccgcttatattttttttatttttatttatttatttatttatttttgagacagggtctcaaaaaaaacaactttgttgcccaggctggagtgcagtggcatcatcgtagctcattgtagcttctgtctccccagactcaggtgatcctcctgcctcagcctctcaagtagctgggactacaggcacgcaccacccaccccacccaactattttttttattttttgtagagacagagtcttgctatgttgcccaggctggtctcaaactcctgggttccagtgattctcccgtctcagcctcccaaagcactgggattacaggtgtgagccaccactcccagccaaatttaccagacttaatggaaacagtccatttctgtttcttcagatgaaacctcacaactttaggattaataagtaatctcacaactattgtacaggaaataagaaaacgttcccgctaacaatgcacgttgtgatagatctggtccctgacacaaacagcacttggaactgagtgaagtccagagactgaataatacagttctatccactccctgtgcttgactacaacccctgaagagggcttgtacaaattaaatgtatcccagcagctgcttgaaagaccacagcattggccgggcacggtgactcacgcttgtaatcccagcactttgggaggccgaggcgggcggatcacgaggtcaggagatcgagaccacggtgaaaccctgtctctactaaaaatacaaaaaattagctgggcgtgatggcgggcgcctgtagtcccagctactcggagaggctgaggcaggagaatggcgtgaacccgggaggcggagcttgcagtgagccgagattgcaccactgcactccagcctgggcgacagagactctgtctcaaaaaaaaaaaaaaaaaacacgcattttgaatgtccctagcattagggattataaaggtcccattctagtagaagatcctcaggtttggagtgtactaaaggtcatcatccttcgcctgctaataaatttctgaagtccctgctttaaacaaacaatcaaaaagaaggaacagttacagtgctgccaaacaagttctttttttttttttgagatggagtttcgctcttgttgccaggctggagtgcaatggcgtgatctcggctcaccacaacctccacctcccaggttcaagcaattctgcctcagcctcccgagtagctgggattacaggcatgcactaccacgcccagctaattttgtattttttttagtagagacagggtttctccatgttgaggctagtctcaaactcctgacctcaggtgatccgcctgcctcggcctcccaaagtgctgggattacaggcgtgagccacggcgcccggccaacaagttcttacaaacctctgggttgttacaaacccatctggtgctaataaaggtaaggcatcaaccccaatctccaagctgagaattttatcctcaggactgagcactgcggcctgcattcggatgttagtggggctgtcagaaccgtgtctcatgctgttaaaagtggaagtccttcccactcagacccacggaagccaactctgatgagtgggagggtgagcagaaggggcttcggtcattttttatagattcttcaggtaactctagccaccatattaagcattggctcccacaaaaaagcattaaggctcagaaacatcttgtagggtcacaccctccctaaaaacagcacatccctgaagtggtggctgggcagccaggctccaaagcccgctgagctgagcggcagccaagaacaaggtttggtgtttacatactcaaaatcagcctgggttgtcacagcaactcacctcagcacagttcttccttctccacggcggcttgcttccaggctttgctgttctccgtcaccgtcttaacgttcctgctaacctggcctgctgcattctttttatttttctcccaattcctccgccttcttctcatgtgtttgctagtgtgcaatacctcacctgtttggaactcaacaacgtcccctcctgcaaaacgcacctgaaaacaagaaatagcacacaaggcctctaagtggccagaacagatgttaccaggcctaagtccataaggaaagcacccaagccccttgcttttgtcttaaatctttttttttttacacctttaaaataaggttatggtttctaaggcctgccgtaaattaggagtagggagaggaactattgccaagcaccccaaaagttcaagaggtgactgttgatcccagagtagcaaggaaagggacagacaggctataagaagtggacacaagaactcagaactcaggacagtgtaggccttgttagagtcaggcagacaatttcacatacctcagaacgtcataaagccatcatgactttactctggaatagatacgatccagacacctagaaaatgttaaattagattcaacttaaagaggcagagtaatatgtgtggtgttttttaatttcgagcattccaaatggttaagggttttcatgcttaaagagagaaacttagctacctagaacttatttatgagtgctctagataattatctactgttttatatttttttatttataccccgttactaaaacaaaagtaaaaataaagcaaaagattgaaggcattgacatttagtctatatactttctagttcctggctctagttcttagcaatatttgctgctaacctggtgttctgtctctgccaaatttctgcccatgtgaaatatatgagacttgatcctatttccttgctcattgatctacctgaaagggtcatagatgtctccacctccctagagctagtgatcctatatcccatcatctcagccagctagaaaacgaaccatcacatgccacctcctacccaattacgtgcttcataaacagaatacctggcatatagcaggcatttactaaacacttggtgaatgaatacatgagccagtaatccataagatatctgtagaattaattacagttgagccttgaacagcgcaggtcctatgggatcccaccccttgtacagtcaaaaatcctcataaaacttttttttcttttttttttgagacagaatcttgctcgttgcccaagctggagtgcaatggcgtgatctcagctcactgccacctccgcctcctgggttcaagcaattctcctgcctcagcttcccaagtaggtgggattacaggtgcctgcaccacgcctaactaatttttgtatttttagtagagatggggtttcaccatgttggccaggctcgtctcaaactcctgatctcaggcgacccacccgcctaagcctcccaaagtaggggattacaggtgtgagctgccgcacccggccgacaggtgtaactttttttttttttttttttttttttgagacagagtctcactctgtcaccaggctggagtgcagtggctctctctgctcactgcaatctctgctcactgcaacctctgcctcccaggttcaagcgattcccctgcctcagcctcctgagtagctgggactacaggtgtgtgccaccatgcccagctaattttttgtattttagtagagacggaatttcaccatgttagccaggatggtctcgatttcctgacctcgtgatccacctgcttcagcctcccaaagtgctgagattacaggcatgagccaccacacccggccacatataacttttgactctccaaaaacttaactactaatagaagacttaccaatagcataaacaagttgattaacatatattttgtatgtcatttgtgttatatatgtatttcttaccataaagtaaactatagaaaagaaaatgttattaagagaatcataagcaagaaaaaatatgtttactcttcattcagtggaagtggatcagcataaaggtcttcctcctcatgatcttcaggttgagcaggcaaggaggaggagaaagagaaagggttgccatctcagcagtggcagaggcagagggaagtctaaggggacccttgctgttcaaaattgtgttgatcaagggtcaactatacttgcatgaagctataaatttaagagcctagcctattatgggaacagcaattaaaaaaaaaaacaccagttggccgggcgtggtggctcacgcctgtaatcctagcactttgggaggccaaggcaggtggatcacctgaggtcaggagttcgagaccagcctggccaacatggtgaaataccgtctctactaaaaatacaaaaattcactgggcatggtggcgggcacctgtaatcccagctacttgggaggctgaagcaggagaatcgcttgaacctaggggccggaggttgcagtgagctgccaagatcgtgccattgcactctccagcctgggtaaaaacagctaaactccatctcaaaaaaaaaaaaaaacaccagttgatcctggcaccaggaagatcaaatggcatttgtttgtttgtttgttttgagacagagtctcgctctgttgcccaagctggagtgcaatggcacgatctcagctcactgcaaactctgcctcccaggttcaagtgattctcctgcctcagcctcccgagtagctgggattacaggcacccgccaccacacccagctaattttttatatttttggtagagatggggtttcaccatgttggccagtatggtctcaaactccggatctcaagtgatccacccacctcagcctcccaaagtgccttggtttacaggcgtgagccactgcaccagccagtacagttttttgttttgttttattttggttttttgagacggaatctcgctctgtcgcccaggctggagtgcagtggtgccatctcagctcactgcaagctccgcctcccgtgttcatgccattctcctgcctcagcctccctagtagctgggactataggcgcccgccaccacacccggctaatttttttttttgtatttttagtagagacggggtttcaccgtgttagccaggatagtctcgatctcctgtcctcatgatccgcccgtctcagcctcccatagtgctgggattacaggcatgagccaccgcgcccagccttttttttttttttttttttaatgtatgggggaaaaatgactagaaggacagaaaccaacatataacatgattgtgtgcatttacttatttaacaaataattgagcaatttatttctgtatgatactattctaagcgttttagagttaagcaaactcacagtaaactgtattgcccatgataaaaactgcagttacataatttaaaagcaagaatcgcagcaattcatcaggcacagtgactcacgcctgtaatcccaacactttgggaggccaaggcaggaagattccttgagcccaggaggtcaaggccagcctgggcaacatagtgagaactcatgtccacaaaaattacaaaatagccaggcatggtggcaagcacctgtggtcccagctactcaagaggctgaagttggaggatcacttgagcccaggaggtcaaggctgcagtgagcgatgatcgtgccactgcactccagcctgggtgacagagcaagagaccctgtctcaaaataaataaaaataaaagcaagaattgcagaaagtataaaccatgaccaactcaagagaataatcaatgaaagaataggcagaatgtctttccaaaaagcagttgagagatccccatcctccacatatgcactagtgcagtggggatgttgccaggcatggccgccagacctctagatagaacactgaaggtgagtctgcagtaaagccatggaatgtgctaattttagtttaggaataccaaattttattgaccgtttttaattcaataagcaacccttggccatgtataatcagttcatgacccatcagaagatcctctgtggttcactcatggcctttggactatactctgaatcatggctttagaagacatttttttagtatacttaaatggattttataacttggttgatgcccagattacagactgtgaggagtatctccacataacttgtaactgctatatatgcagtcagcaattccagtatttagcctgatattaatttatatttttcctcataatctgataatacagtgctagcaagatagatcacaaagtgtaaatgagtgtttctggagcatagatgggtacgctcaaatctttgtatcttgttttttaatagagacggggtttcgctatgttgctcaggctggtgtcgaactcctcggctcaagcaatccccttgcctcagcctcccagagtgctgggattatacatgggagccaccatgcctagcttccttgtatcattttttaaaattcaagtaagagaaaatgtctggcaatagttcataagctataaatgaaacctagtcttaggacccagctttatattgcctcaatcaaatattaatatctttagttcaaaatttgtatttacaaaaaacttttggttcttggggataccgttattgccttctctgttgccatccatataatgtatgttgttttttttttctctctccctctgggctgcgtttcatgccagataaacttccaaaccaaactgggatggcaccaggcacaaataacactcttcttatcttttcccccatctaggttacccctttgctttgttttatcggcattaccttttctacaaggagacctacctcatccacctcttccatacctttacaggcctctcaattgcttattttaactttggtgagtaaactaaattagcagtgacaccgcaattagtgggaacctggaaggaacagacttgaacaaaatttccttgagagaatctaataggtagggaagttataatgctcccacttgcaaagagggttgtatgaagaggaacacagcttaacttttcctttttttcttttatgtacattcttctgtcagataaaaacattttgagggtggttacccttgccatacctcatcaacaaagaatcctcagtttctctgtgctgtggatgtaactgaatgaccgagccaagcagtccccacttagattcattcttcacttcagacattcaaaaatacagtaacaagctgggtgtggtagcccggaattcaaggctgcagtgagctatgattgagctactgcactcaagtctggacaacagagcaagtcgcatctctaaaaaaacaaacaaaaaaagaaaagaaataaaataacaccctaataatcttttttattttaataaataatttccatcctctcctccaaaacatgaggttattctgaaaaaaaagatcctgatgccaacattttttctttatatattacgttgtgattggaagtctcaggacggtgggagtgtaaaaaccaggctaaattctctcttcttgcatccaggaaaccagctctaccactccctgctgtgtattgtgcttcagttcctcatccttcgactaatgggccgcaccatcactgccgtcctcactaccttttgcttccagatggtaaacgtctttcccttagcagctcaggctacagctgacagcggttcaggggacaggggtaggcaggggactgtggtatagaaattagcagacctaatttctaacccctctcccagcacttagcagtatgacttcaggtaggtggcttatcacaggcccaagtgttccatccacagattgtaatggtaactctttgcctgcctcaaggaagggccaccagctaaccctttgcatactgtgccattaggctctttggtttaacccactatccaggagcagagtcacttcaaggcaagacagaaaagcaacttagaatgagttaaagaacctaagcctaggccaggcaaagtggctcacacctgtaatcccagcaccttgggaggccaaggcagtcagattgcttgagcccaggagtttgagactaacccgggcaacatggtgaaaccccatctctacaaaaaaaatacaaaaattagccctccagcctgggcaacatggtgaaacaaaaaaaattaaaaattagccgggtggggtggcatgcacctgtggtcccagcatctaaattctcatctcagtttagccctcattttgccaagaagccttgagcaacgctcttcccattacaggttttcagcacctccatttgtaggaatttattaaggcttttaatgatgggatgaggagaaaggaaaaaggaaagagaacattgaatttcagagcaaggagaagaaatagtagtgatgctagaataaatacttctgcctctcctaggcctaccttctggctggatactattacactgccaccggcaactacgatatcaagtggacaatgccacattgtgttctgactttgaagctgattggtgagtgatggtcactgcctgccttccttacatgtaggtccctcccccatctcactaaaaacttcctcggcaccccccctccgccccccgccatacacttctggctgcactcagtctacaggccacatcctcagtgtcctctcccaccaccctacccatccgttctctctctgctcaggtttggctgttgactactttgacggagggaaagatcaggtaagtacccattcatcggcagagaggttcaagacttaatgaaagggaagaaaaaagttgttaacaaaagactgaacccaaattccagagcggagcctctccctcattccccagcctgtgcaatctccctttcagatagcactgagcaaggatcaacaaatctaatttgcccaggatccagctcttgcacaaagtccagagatcaatgccagcaaggcatttgctaaagcagcaacagccagctatgcacacacatacgcatttccacaagaagcaactatttgtcatcccccaaagagaaggctatttgaagaaccccagtcagtggggcacacaggtggggaacactcaaagtggctcttgtggggagattcaaggctatcctgaaccatgcattctcttcttggcatagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacaggtaattgcccctcttggtccagatgtttgtgtaggtatttcactcactctgaagtgactcttctgaaagctgcattctccagcatgaccctggcatagagacctgagtcatgcaggccctggactgttgtaacaggcactctgtgccaggagtgggccctttttagtttagggttcttccagttatccattctaacactagtacaaacataaaaatccacatttatgccacaggattttgcctgaaccagtcacatttctgcctttaaagcctattttcatgtatatatgaaatatatttatgattgataggtaggtaggcaggttgataggtaggtaggtagatagaggctgggcacagtggtttcacctctataatcccagcactttgggaggccgaggtgggaggatcacttgagcccgtgagttctagaccagcctggcaacatagagagactctgtctctacaaaaaaatacaaaaattatcagacatagtggcatgcatctgtagtccaagctacataggaggctgaagtgggagaattgcttgagtccaggggaggtgggtcaaggctgcagtgagctttgatcacaccactgcactccattctgggcaacatagcaaaatcctgtctcaaaaatatttatcagtaggaaatgcaggagggcacagtggctcatgcctgtaatgccaacgctctgggaggccaaggcaggaggatcactggaggccaggagttcaagaccagcctgggcaacatagtgagaccccatctctacaaaaaaaaattatccaggcaaggtggtacatgcctatagtcccagctactcaggtggccaaggcaaggggatcgcttgagcccaggagttcaaggccacagcgagcaatgactatgcctctgtactctagccggagtggcagagcaaggccctgactctagaaaataaaaattaaaatggtaaaaaaaaaaaaaaaaaaaaagtttaattgccagaagaattccttcactgagaacttgtccatcctgtgtttcagcatcaattcaaccaagaaatgaaggagcagattcaaagtggttatttttattatcttacctccactgggttttcagtcccaatggagattgtgagacctggcaagaccttgagatcagtagcatccctgaggggtaaacacaagactggtccactgtctgctgccctgactttcctacaactcttaagaggtttgcagtccccattcctcatagccagccatagaaatctttccctgaaacaggaaacactttgggcagcagagcttctcatcccattccaggtagacaaccacacccctaaacactcctctccataactgaaggtcagagggtgaagggaatagtctctgctctctgtgaccaggaacttcactcgttcctttccagcatcattcctgctctcaagcgcctgagtctgggccttttctacctagtgggctacacactgctcagcccccacatcacagaagactatctcctcactgaagactatgacgtgagtgtctactaaagcagcagcagcatgactgcaccagagctagaaaatggacaggcaaggatccctacagatagcagagaagtaggaaatatcatctacaagtgcatgttggttttgctctagatctgtgagttgtcaatgccagccgtgctgggacatgttcatcagccagcactgaacaaccttcgcgggcacagggctgtgccaggtgcacatttagcacccgttgccttctctaggagccgctcctagcttgccttatcacatccacgtgacccctcagagcacagcagcttctgattctccatcctattttcttctcttgactgatacatttgggcacttctagggaattcagaaaccaagggaaggggggaagtgctggcttttgctcctgcccagctgaaaggcttgaaaacagttcagtaattctgggcaggtttctctccttaaattaaaatccaatatgggcccctctgtacttaacattccaaatgctcattccaaacactttgccaacgaaggcaaacagtagagaagttaaatacagtgctgcccttgaggctctccaagggaaaggcgaatgaatattctccaggccctctgcttattcctctctgcctattgtgaaggcaatcaggccagactattgagggcatctggcagcaggactcaggcaggtatgaagtagccagccacaagtgtgaaaaggaagagtgctgagagaaactgcctagtcatgtgatatccctaatgcactgtgctttcttccctcaagaaccaccccttctggttccgctgcatgtacatgctgatctggggcaagtttgtgctgtacaaatatgtcacctgttggctggtcacagtaagtagaaaagttgaaacaaggtcctatttagacaagccatgggggccagtatggggagtggcaagagccctaactgagctattccctctcaggaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccggtgagctgctggtggggagcctggaccctggttccttccttccactgtcttcccagattggagggcaggggtgtaccatgtcacccctatgcgtctttcccatctgggcagaaccccctgtcgctcacactgactttgacccccacctatacccccctcccaaaaaaaccattactgtcatatttgaaaaaaaggcaagatataaaagtgcgttaagacctgggtgttactccagctctgccaatggacttatgtcctccactgccctgtttatcaacagctttacttgtttgtccccaccactagagtgtgggcagcttgagtagagtgtctggttcaccactgatctcagcatcagcctcagtcactgctgctgaaccaagtggctcgtgcgcacacggtctccagctccgccttgggtctgctttccatctctaaaagtaatcagtcagcactgcctcctgtaccctctgggggctacacgtgggaacccaccagcactccaatccaatcctcagggtgaggacccagaggcaggtggcgggatgcaaggaccagtcagtttgagggtcgccccacccacccttttctccagctacatcttcaaacgactcaagttccttggaaataaagaactctctcagggtctctcgttgctattcctggccctctggcacggcctgcactcaggatacctggtctgcttccagatggaattcctcattgttattgtggaaagacaggtaggcctccagggtgggggtgaaggggaatataagggacaagatgctgatgagctcctcctccctccccaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggcaagtgaaggcctgcttgtgagactgggagggactcactgcaacctcaaaggttgcaaaggacactccaggcctgtctaccttagtggcctctctctccacaggtgtataaatccatctatttccttggccacatcttcttcctgagcctactattcatattgccttatattcacaaagcaatggtgccaaggaaagagaagttaaagaagatggaataatccatttccctggtaagttaatacagctaaactaaaactaccaccaggttacagaatagagcaacagactggaaaaaaacaatagtattagaaatctggggtgaattccaaggattagcctggctactaaggaacacagtatgggcaatgactactgtgacttattgaggcatgctaggaaacatctggaagggctatagaccaggaattacaggagtaactaaccagccttccaaactcctcttgtcttgcaggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttcaccactagcattcctgactgctctctttcacagttcttctccatcatcagggttctctcctttagcacatgggaatctgggagctaaagcctgccttcaaagcatggaaccaaactgcaaactctgtaacctcctatctgtccctgaagtcccggggaacaaacagttttacaccactggatactttaggaaccccaaaacaaccaggtttgcaagaacagtattcataggataaacaaatagcaaatgtacagccttggcttccccaaactccacagtctcagtgcagaaagatcatcttccagcagtcagctcagaccagggtcaaaggatgtgacatcaacagtttctggtttcagaacaggttctactactgtcaaatgaccccccatacttcctcaaaggctgtggtaagttttgcacaggtgagggcagcagaaagggggtagttactgatggacaccatcttctctgtatactccacactgacctaagaaaagaacagttttgtcagccaactctgtcactcagtagctgtttcagcccttctttagggcaggaaaactatggctgagctagtatttcagctgtgctgttgaatatcaaatccctacaaaggatgaagaaggtcctaactgtgacttccaattatggcagcagccctcaaaggatgtgccctggggcagggtgtggaactgtcatgtgtcttctagctcattgtaagcattgttaaaatgcctactgctctgggaattctatactaagttcagctctaccaagaatttcagggttgagcccagaccttaccttgccatgggcaaaggcccctaccacaaaaacaataggatcactgctgggcaccagctcacgcacatcactgacaaccgggatggaaaaagaagtgccaactttcatacatccaactggaaagtgatctgatactggattcttaattacctaaagtaaaaaagagagaaaagtcagccccagaaacattcccagaaccagccttcaactaacaggtttcaatacctcaccttcaaaagcttctgggggccatcagctgctcgaacactgagcttgtgtaaaagttgaactagaagggggaaaaaagagttcagagctagatggagaccacagtccttctgtccagtcatcgaacaaggaaaaccccatggataagatgagttccctgtgtgctttatatctagactggactcctgaaatgttaggaacaaacagttgccaagcatatggctagctgtacagtgatgggttcagactccctctttcactcagccaggaagctactgcaagaacaggagtggagtttccacaaacatagaaaaataataacagtccttgtcctggtattaatcatgttgttctcccattttctcgcttaaaaatccacatttagttctcccttttcctcttcctcccttcttccctactgacaagttcattctaactttgttctaaggcttcttacccatgaggccacaaaagcggtcaaaggttctgggaattcgggtctggggattcacttcaatcagaacattcttctgtgtatggatataaacctgtagcaagccagctcggttcaggggactatccatcagcatcagcaaactctgagcaaagcagaaaccgagacatggttaaggctgaagagaggcagcactcagctgccaacccttccatacagaggctcaaagggttgtgagcactgtccctggagttacctggtgggtgatatctggccgcgcttccccagggtcccgtccattcttcaacaatatagacttgtgcttgtcacagttgagtagctcatatgtcttccctacctgaagaacagggaacatgacgagagaacagcataagcttctgttacctagccccgtggttcttcaagtgtggtccccaaactaccagcagcagctgcacctggaaacttgttaggcaaattctcaggcccaccctagacctactaaaccaggaacactgggggtggagcccagcaagcccttcgggggattactgtgcagccttatttgcactccccagtgaatggtctgagagggaaacaggaggaagggcacaacctgtgacttcacattatctactaatacactggatttaattaaaaaacctgtggctgttaggcaaggccaatgagacatcctggaactaggcaggagttagtagttagcaaggctgaatgctgtgtttattacaggagcagtaagtaggtactgtgcaaaatatcgagtcaccaccctcagtttgcgtacaccaaacatgcactaagtgaagagctgcaaatctgaacaagaaatgtgaaggccgggcgtggtggctcacgcctgtaatcccagcactttgggaggccgaggcgggcagatcacaaggtcaggagattgagaccatcgtggctaacacggtgaaaccccatctctactaaaaatataaaaaattagccgggcatggtggcaggcgcctgtagtcccagctacttgggaggcagaggcaggagaatggcatgaacccaggaggcggagcttgcagcgccactgcactccagcccgggcaacagagcgagactccatctcaaaaaaaagaaatgtgaaaactaatgatgcaggaggcagtttaatcaaagaaaactctcagaagtaaaaggaagaggggttattcccagttttaagacgggcatgggggcagatgcagtggctcacggctgtaatcccagcactctgggaggccaaggcaggcaaatcacttaaggtcaggagttcaagaccagcctgggcaacatggcgaaaccccatctctactaaaaatacaaaaattagctgggcatggtggcacatgcctgtagtcctagctacttgggaggctaaggtgggaggatggcttgagcccaggagacagagattgcagtgagccaagactgtaccactgcactccagcaagaccctgtctcaaaaaaaagaaaaaagaaagactggcatgagcaaaggtacagatggaatcaagacaaagtagccaggtgtggtggcttatgcctgtgatcccaacactttaggaggccgaggtggaaggatcacttgagcccaggaatttgagaccggcctgggcaacacggtgggaccctgtctcacaaaaaaaaaaaaaaaaattagccaggcgcagtgccatttgctggcagtcccagttactcaggaggatgaggtgggaggactgcttgagccagggaagtagaggctgcagtgaaccatcacaccactgcactctgttgcccaggcaacagagcaagaccctatctcaaaaaagaaacaaaaaagaaaaagtggaaacgaagaaaggaaattttgaggaaaattgggagctgagacactaaagggcagtgattatatatgaagctgctttgtaaaccacagaatcctaatgtatcaagcacaaagccaaaaataattctggagtaagcagggcaggatgggaatgactgacagacactatcctaacaactctctgtacactggaaaagacatcagaagtttgatgttaaagaagtggactacatctgtagcagctaaaagaaataattccaagttgcaatttggagtcccaaggagcattagggtggtcagtaaaaagtctaaaaacaaactgttatatacaaatacaagttttggaaggttaagtttttatgtatcactggaatgtatatgtctagcaacattcttgagatatatggctccaaaaagtctgcgaaaaaagggatgtagattttgaaattgaatagttgaagtaatgtcacagagagcacaaagaacaaatgaccaagaactaagtccatgagacacccttagttatagaagaaaaaaaccttcttgaatgaataatacagtttcaacccattagtaggatataatcatgttttctattcttttaatagattacaggcgcaggcctgtaatcccagctactctggaggctgaggcaggagaatcgattgaacccgggaggcggaggctgcagtgagccaagatcgtgccactgcactccagcctggtagagactgagactccatctcaaaaaaaaaaaaaaaaaaaagtgtatttagaacgaagattaaaatcctggcctgacttctaaaccaatgcgatttcttctgggcctattcaattagttctaacgggtaagagaaaggaggaggaagaacactgcccaaggctttaagatagagaactgctggttctattacatgtggggaaagagatgaatgatagataaaaatgcagatgtaaaagttttaaataataaccaggtctggacagtgtatcataggtggatattagagagaggtgactatggatactaatgaattgaaacacgaagcccttacaaaaagtgtgggcagactaggctacataactacgtttctcatctgcccagtaacttgtcttgggatgtggaatgacgcaaggaacgaaactttcctctgcttagactactataccacagaatcctggtaaaccaattggaagcaaggaggtgagggctagaatatcattcaaaaagagcaaaagaaaatgagtactaccggccgggcacagtggctcacgcctctaatcccaacactttgggaggccgaggcgggcggatcacttgaggtcaggagttcgagaccagcgtggccaacatggtgaaaccccatctgaactaaaaatacaaaaaaattagccgggcgtggtggcacctgcctgtagtcccagctactccagaggctgagtcaggagaactgtttgaaggcgggaggcagaagttgcagtgagccgaggtcgcgcaactgcactccagcctgggcgacagagcgagactccgtctcaaaaaaaaaaaaaaaaagaaagaaaaatgagtactaccatcccaggatgtcaaatcaacgcaaagccaaccaagccaccttccttcaaaagcatctttcacccctctctgctttctacatccactctgggccccttaccctcattccacggagtcccaacctatcgatttactacttctccacttcctgtcccaaactaccttgactgtctccagactggccccttccagcaccacaataagcctacggcctccgatcttgtttcctgcccctagtcggggccgcttgggtggcagagcatcccagtcctgtgcctgctccccaccgcttcgttcacgaggcttgaatccatcactgggcgcggccatcttgcaacaataccggaagttgcgctaacgctcttaaataagaacagcgcggcttctaatcacaaatttccttc

SEQ ID NO: 6653 - DNA, 5905 bp, Homo sapiens
gggaaccgcccaatcaggcgcgcagttggagaggacaggagaggagggcgtggcttcctgcatttggcggggtctttgtctctcgctggcgctggcacaggaacttgggatccgtctcctctttcgcctcctgcaccttgggagccccgggctactctcccacagcccctgttgccctgtgatctgtaggtccttggggacgcatagtcaaggtgccaggacatcctggaagctgggaaatggtgagtatacggggttcgccatcccgagaggggagaacagactgtgaaaccggcaggaccgtcctccccacggttagctccgagtctcccgcagcttggccctcagtcccctgtggctgcaagatggccgctgggccagcagcgagggccccacgtcccgtccggcccatccggtcctgtccctgggcagcgccctgctctgcgcccacagccatgagtatttcccagattgttcagggaggcctggtgggtcatcagggaaaaaccgcgactgggtgtttgcgtgggaggagctgcggcccgtggggtccccagtctctcttgttaaaaattaacgggagtctatgttaaacgttaaccagtttatctgaacaaagagtgattggtgaaatggaaagcacccagccatgatttctggtccaccagaggggcataaaggaaaggctttcataagatgcatgagaaagcagcccaaattcaagaattggttccagttatatggtagccttatttgaactatccagatggaaatgtcctggttacatattcagaggttaattgcatgtttgtcatgggttaaacctgcattttgcttcaggctaagatagtgttttataggaaatatatttgagttaggttttagatttttttttgtttgttttttgttttttacctatgaacacagggcactagagccactttagactaattttctgatctttaattattttaacactccagaggaggactggttttctcctgtgtttttttaatgtatggcaagtggaacctctaatcgaccaccctgtttttcatcctaactcaggcttgcagtaaaattatcagttcccactttctttgctgcattctcaaatgcaacacatgagaccagctttcccttgccaatttacaatgctgttaactatatgtcctttattatacatttcattaaagttttctattatttggtttctttctacttctccctacagttctggcaatatttgctttttatatttagaagcctcccttttgggtgcataaatatataaagctatattctcttgagaaattaacctctattattattctatggtaaactcatttcatgcttgtgagagacattgctagaaagtctattttgtctaatttaagcattaccgttgcactcctttggttattgtttgcatggaatatcattttctatcctttcacttttagcctatgctcttaattcataattgagtctcttgtaagcagcatattacgaggtttaaacgattaatttatccactctgtctgctttagtctcttttggctgctataactgaatatcacacactggtaattaataaagaatagaattttatttgacttatgattctggaggctgggaagccaaaacaacatgatactggtatatgttgaaggtctagttgctggataataacatagacaaagatgtgagggagagagagcttttttttttaatatataacagatccattcttgttataattagcccattcccataataagaacattaatccattcatgagggcagagttcttagagcttaattaatttttaaaggttccacctcttaattctaacatgttggctattaaattttatcctaaattttggagatgacattcagtgtacagcagtatctgtttagtagatactttaatctttttatttgtaaggtagtgataggtaaggagttactattgtaaatttgtagttttctgtccattttaagtttgcttcttttttttctggttctgtctttcctgtggtattgttcatttttgttgagacaaagttatgctttcttgctcagactgaagtgcagtggcatatcacagctcactgtagcttcaacctcctgggctcaaataatcctcccaccttagccacccaagtagcttggactacagacacgtaccacaacacccaaggagatttcatccttccaccttggcctcccaaagtgttggaattataagcaggagacaccatatccaatgtgtaatttttgttgtttgtgtatgctttaattactttctctttttctttactgcagtttttttttcctagtggttatcatgagacttaggtaaaacatcttgtattttaatagtctagtttaagatgataacaatttatagtattctgaaattcagtatgtatttaccattttagtgacatttatactttagtatttttcatattgttagttagcatttcatcatatcaatgtgaagatttcttccagaccatggctggagaaggaaagaaggtgtgttttgcctgactcagtgactatagagagaaccaagttctgcaggcctgtcacctaagtctcaggtgagtatgaattctcttgtgtttttcacagattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttatacattatgtaagctgttaataaaatttcttgtaggtgctacatatttgttaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaagctatattatagtcatatagttttattatagtatttgataagaagagcagcaacatattgagaacagataaaattctgctgtctttttaatgattatttattaaattcttctcattagagcctattattaatgattgtaatgtatttactgtataatttttctgcaatttattaaatgccaatgacttccaatgtctgcttttcatgactgcacacagtttaaagctgtagatatctaatgggttatttttcagcccggcatggtggctcacgcctgtaatcccagcactttgggaggccaaggtgggtggatcacgaggtcaggagatcaagaccatcctggctaccatggtgaaaccccgtctctactaaatatagaaaaaattagccgggcatagtggtgggtgcctgtattcccagctactcgagaggctgaggcaggagaatggcgtgaacccagtgggcggagcttgcagtgagccgagatggcaccactgcactacagcctgggcgacagggtgagactctgtctcaaaaaaaaaaaaaaaaaaaaaaagggcttatttttcattgtatatttatgttgtattcaggattttatgcatttaatctctcttcttatgttcaattctgtgttgttgtgtttcttttcttgggggggtatgttttctcagatcagttaattgtatttttgcttttaaagcttgatatcatgagttgaatgataattttttaactcggtacactttatgacaatgtgatatttaatttatatgtgaattagccgtgtttgttgcttatacatatatctatgtgtttttcacctatgtatgtcatttttttcatcttttttccttgtttttttttttaagtttcagatacgctttctttttcttttttttgtttttttcttttaaagagaattttaaaacagagtcaaatgaacaaaaatcagttatttgtcctcttgcagggcgggtagaccttccttccccacgggtttgaggctatggctaagtggtgagccttggggagatgcaggaaggatccatcccaggcacttggctagaggtaagtaaaaatagcctttggaccagaagacctgatagtttgggtactcgtctgaacataagtccccatcttcccagaaatgtcgtcttttgtctgcaacaactggctggagaaatatttcagaaagatgtgtgcctggaacacccaaagacgtacctttcctttctctttggcataggccttgtagcactgtagaaagaccaggtttgcaatggagccttcaatactcttcatccctatggatctcaggggctcatagggtgacaggagaggagacaagctagcttgggaagagtctttgtacttcagcttctcccctactgaaacactatatacttggggccacagttcatcacaaaacacacatgctctctttctttctctcacacccacatcttgggaacccaacaacttgatggcaggtagctctgggtatccttggtctggcattcacccactgggcatctaagctgtcctaaagctcttttcaatcacttctcactctttccaggcccatgtgggtaggtgttccagccttcactctttcaggctgatcatagaggcacagtgtgggaaaatcccctactgtgatggccattgctgggaagcagggaaggttaagggcccactgctgcccaaggctagtgcagaggccctctgctcctccactcatctcctcaaagaatgatatcaggtgcagcagctgctgtctggaatgttatcaaaccaggactgcacaggcactgcattctctgtgtggaagaggtaagaagcaggctagttgtccaggatgagttttcctcaggtccctccccagatggctgacgttcttgacatagcagccctggtgaaacaaacatgactcatgggtcaggcagccccaaaccatcccatacccgtccagctcacccgtcacaggatctgcctacttgttcaggctgggaagaagagagcaatgacgaaaacacatttaaacatttcctccattcatgtcaggaactcatccatataaggcctcatgagcacatggatctggtgcatggtcccctcaagctctacaggcactaggcagtcagcattgctgattggcttaaaggagctatgcacaagggtttcatccaggtcagtgaccatacagatccttccttgatttttctctgtcacctctgggagcaggcaggttcctgggatctgataaaactgatattggagacgctggagctgatccgacatagcaatggtgttgactccctccttatgtgtggattgctcagcgggggaacttgactgtccaacatgctgggtgcaagaacagcagaaaggggacttttaagatgtggcaaacatgaggcctcttcggagaggactttggaaaccaggccttgcttggtaaggaccagggcatcttccctccatgcctgggtgatgatggagccttgttccatctaacaatcctgagggctgggctggggggcatgggctggggcctgattcagttcccgagattctgacctccacagctgttcacataccccttctcctttccatactggtcgggaaggga

SEQ ID NO: 6654 - DNA, 3891 bp, Homo sapiens
gggaaccgcccaatcaggcgcgcggtggcagaggagaggaaaggagggcgtggcttcctgcatttggcgggatctgtgtctctcgctggtgctggcacaagagcttgggatccgtctcctctttcgcctcctgcaccttgggagccccgggctactctctcacagcccctgttgccctgtgatctgtaggtcttgggggacgcatagttaaggtgccaggacatcctggaagctgggaaatggtgagtatacggggttcgccatcccgagaggggagaacagactgtgaaaccggcaggaccggcctccccacggttagctccgagtctcccgcagcttggccctcagtcccctgtggctgcaagatggccgctgggccagcagcgagggcccccacgtcccgtccggcccatccggtcctgtccctgggcagcgccctgctctgcgcccacagccatgagtatttcccagattgttcagggaggcctggtgggtcatcagggaaaaaccgcgactgggtgtttgcgtgggaggagctgcggcccgtggggtccccagtctctcttgttaaaaattaacgggagtctatgttaaaaggttcatcagtttatctgaacaaagagtgattggtgaaatggaaagcacccagccatgatttctggtccaccagaggggcataaaggaaaggcttttataagatgcatgagaaagcaacccaaattcaagaattggttccagttatatggtagccttatttgaactatccagatggaaatgtcctggttacatattcagaggttaattgcatgtttgtcatgggttaaacctgcattttgcttcaggctaagatagtgttttataggaaatatatttgagttaggttttagatttttttttgtttgttttttgctttttacctatgaacacagggcactagagccactttagactaattttctgatctttaattattttaacactccagaggaggactggttttctcctgtgtttttttaatgtatggcaagtggaacctctaatcgaccaccctgtttttcatcctaactcaggcttgcagtaaaattatcagttcccactttctttgctgcattctcaaatgcaacacatgagaccagctttcccttgccaatttacaatgctgttaactatatgtcctttattatacatttcattaaagttttctattatttggtttctttctacttctccctacagttctggcaatatttgctttttatatttagaagcctcccttttgggtgcataaatatataaagctatattctcttgagaaattaacctctattattattgtatggtaaactcatttcatgcttgtgagagacattgctagaaagtctattttgtctaatttaagcattaccgttgcactcctttggttattgtttgcatggaatatcattttctatcctttcacttttagcctatgctcttaattcataattgagtctcttgtaagcagcatattacgaggtttaaaagattaatttatccactctgtctgctttagtctcttttggctgctataactgaatatcacacactggtaattaataaagaatcgaattttatttgacttatgattctggaggctgggaagccaaaacaacatgatactggtatatgttgaaggtctagttgctggataataacatagacaaagatgtgagggagagagagctttttttttttaatatataacagatccattcttgttaaaattagcccattcccataataagaacattaatccattcatgagggcagagttcttagagcttaattaatttttaaaggttccacctcttaattctaacatgttggctattaaattttatcctaaattttggagatgacattcagtgtacagcagtatctgtttagtagatactttaatctttttatttgtaaggtagtgataggtaaggagttactattgtaaatttgtagttttctgtccattttaagtttgcttcttttttttctggttctgtctttcctgtggtattgttcatttttgttgagacaaagttatgctttcttgctcagactgaagtgtagtggcatatcacagctcactgtagcttcaacctcctgggctcaaataatcctcccaccttagccacccaagtagcttggactacagacacgtaccgcaacacccaaggagatttcatccttccaccttggcctcccaaagtgttggaattataagcaggagacaccatatccaatgtgtaatttttgttgtttgtgtatgctttaattactttctctttttctttactgcagtttttttttcctagtggttatcatgagacttaggtaaaacatcttgtattttaatagtctagtttaagatgataacaatttatagtattctgaaattcagtatgtatttaccattttagtgacatttatactttagtatttttcatattgttagttagcatttcatcatatcaatgtgaagatttcttccagaccatggctggagaaggaaagaaggtgtgttttgcctgactcagtgactatagagagaaccaagttctgcaggcctgtcacctaagtctcaggtgagtatgaattctcttgtgtttttcacagattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggatttcaaggctttcatgaatgcacttacgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttatacattatgtaagctgttaataaaatttcttgtaggtgctacatatttgttaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaagctatattatagtcatatagttttattatagtatttgataagaagagcagcaacatattgagaacagataaaattctgctgtctttttaatgattatttattaaattcttctcattagagcctattattaatgattgtaatgtatttactgtataatttttctgcaatttattaaatgccaatgacttccaatgtctgcttttcatgactgcacacagtttaaagctgtagatatctaaagggttatttttcagcccggcatggtggctcacgcctgtaatcccagcactttgggaggccaaggtgggtggatcacgaggtcaggagatcaagaccatcctggctaccacggtgaaaccccgtctctactaaatatagaaaaaattagccgggcatagtggtgggtgcctgtattcccagctactcgagaggctgaggcaggagaatggcgtgaacccagtaggcggagcttgcagtgagccgagatggcaccactgcactccagcctgggcgacagggtgagactgtctcaaaaaaaaacaaaaagggcttatttttcattgtatatttatgttgtattcaggattttatgcattaaaatctctcttcttattttca

SEQ ID NO: 6655 - DNA, 5834 bp, Homo sapiens
tttggcgggatctgtgtctctcgctggtgctggccaggagcttgggatctgtctcctctttcgcctcctgcaccttgagagccctgggtactctgtcacagcccctgttgccctgcgatctgtaggtccttggggagcatagttaaggtgccaggacatcctggaagctgggaaatggtgagtatacggggttcgccatcccgagaggggagagcagactgtgaaaccggcaggaccggcctccccacggttagctccgagtctcccgcagcttggccttcagtcccctgtggctgcaagatggccgctgggccagcagcgaggacccccacatccggcctggccatccggtcctgtccctgggcagcgccctgctctgcgcccacagccatgagtatttcccagattgttcagggaggccagatgggtcatcagggaaaaaccgcgagtgggtgtttgcgtgggaggagctgcggcccgtggggtccccagtctctcttgttaaaaattaacgggagtctatgttaaaaggttcatcagtttatctgaacaaacagtgattggtgaaatggaaagcacccagccatgatttctgggccaccagaggggcataaaggaaaggcttttataagatgcatgagaaagcagcccaaattcaagaattggttccagttatatggtagccttatttgaactatccagatggaaatgtcctggttacatattcagaggttaattgcatgtttgtcatgggttaaacctgcattttgcttcaggctaagatagtgttttataggaaatgtatttgagttaggttttagatttttttttttttttttttttttttaacctatgaacacagggcactagagccactttagactaattttctgatctttaattattttaacactccagaggaggactggttttctcctgtgattttttaatgtatggcaagtggaacctctaatcgaccaccctgtttttcatcctaactcaggcttgcagtaaaattatcagttcccactttctttgctgcattctcaaacgcaacacatgagaccagctttcccttgccaatttacaatgctgttaactatatgtcctttattatacatttcattaaagttttctattattgggtttctttctacttctccctacagttctggcaatatttgctttttatatttagaagcctcccttttgggtgcataaatatataaagctatattctcttgagaaattaacctctattattgtatggtaaactcatttcattcttgtgagagacattgctagaaagtctattttgtctaatttaagcattaccatttcactcctttggttattatttgcatggaatatcattttctatcctttcacttttagcctatgctcttaattcataattgagtctcttgtaagcagcatattatgaggtttaaaagattaatttatccactctgtctgctttagtctcttttggctgctataacagaatatcacacactggtaattaataaagaatagaattttatttgactcatgattctggaggctgggaagccaaaacaacattatactggtatatgttgaaggtctagttgctggataataacatacacaaagatgtgagggagagagagctttttttttttaatatataacagatccattcttgttataattagcccattcccataataagaacgttaatccattcatgagggcagagtgcttatagcttaattaatttttaaaggttccacctcttaattctaacatgttggctattaaattttatcctaaattttggagatgacattcagtgtacagcagtatctgtttagtagatactttaatctttttatttgtaaggtagtgataggtaagcagttactattgtacatttgtagttttctgtccattttaagtttgcttcttttttttctggttctgtctttcctgtggtattgttcatttttgttgagacaaagttatgctttcttgctcagactgaagtgcagtggcatatcacagctcactgtagccttaacctcctgggctcaaataatcgtcccaccttagccacccaagtagcttggactgcagacatgtaccacaacacccaaggagatttgattcttccaccttgacctcccaaagtgttggaattataagcaggagacaccatatccaatgtgtaatttttgttgtttgtgtatgctttaattactttctctttttctttactattttttttttcctactggttatcatgagacttatgtaaaacatcttgtattttaatagtctagtttaagatgataacaatttatagtattctgaaattcagtatgtatttaccattttagtgacatttatactttagtatttttcatattgttagttagcatttcatcatatcaatgtgaagatttcttccagaccatggctggagaaggaaagaaggtgtgttttgcctgattcagggactatagagagaaccaagttctgcaggcctgtcacctaagtctcaggtgagtatgaattctcttgtgttttccacagactgttgcagtgtcaggaccaaggtcaaatgagttatagccaagtctacagtaagatgtggcagtattctgttttgaagcgaggaccatgattggcaagcttgccacttggtcaagtgcttaccctctaaagatgtcttccttggtctttgcctccagctgggtgtcacaaactctgaactggattccaaggctttcatgaatgcacttatgtttgctgtggcagctgcattatgtcgtgggggatgtggatgcagaacctcccattctgtcgtcttgcttatgttactctcctttatgtttcactttctcaaatgaatgacaagcaggtgattttcagattcaaaagttctaaaataaattgctcaaatttacacattatgtaagctgttaataaaatttcttgtaggtgctacatatttattaaaatttttggttgtaattttaagctcactgtaggcagaaaggaatcattaagatttctattcttttttagtctgtatctaaatgaccatatattttaattccaaatatttactttatacttcagtaatgctcattgtattttgcaaaatttatattgttcttttatttgaaaatataaggctttttttagctcctgaaatctatattatagtcatatagttttattatagtatttgataagaagagcagcaacatattgagaacagaataaaattctgctgtctttttaatgattatttattaaattcttctcattaaagcctattattaatgattgtaatgtatttactgtataattttactgcaatttattaaatgccaatgacttctaatgtctgcttttcatgactgcacacagtttaaagctgtagatatctaaagggttatttttcagcccggcacggtggctcatgcctgtaatcccagcactttgggaggccaaggtgggtggatcacgaggtcaggagatcaagaccatcctggctaacacggtgaaacccagtctctactaaatatagaaaaaattagccgggcatagtggcgggtgcctgtattcccagctactcgagaggctgaggcaggagaatggcgtgaacccagtaggcggagcttgcagtgagccgagatggcaccactgcactccagcctgggcgacagggtgagactgtctcaaaaaaaaacaaaaagggcttatttttcattgtatatttatgttgtattcaggattttatgcattaaaatctctcttcttattttcagttctgtgttgttgtgtttcttttctgggggggtatgttttctcagagcagttaattgtatttttgcttttaaagcttgatatcatgagttgaatgataattttttaactcggtacacattatgacaatgtgatatttaatttatatttgaattagctgtgtttgttgcttatagatatatctatgtgtttttcacctatgtaagtatgtcatgtttttcatcttttttccttgtttttttttttttaagtttcagatatgctttctttttcttttttttgtttttttttttttaaagagaattttaaaacagagtcaaatgaacaaaaatcagttatttgtcctcttgcagggcggggagaccttccttccccacgggtttgaggctatggctaagtggtgagccttggtgagacgcagaaaggatccatcccaggcacttggctagaggtaagtaaaaatagcctttgggccagaagacctgatagtttgggtactcgtctggacataagtccccatcttcccagaaatgtcgtcttttgtctgcaacaactggctggagaaatatttcagaaagatgtgtgcctggaacacccaaaggcatacctttcctttctccttggcataggccttgcagcactgaagaaagaccaggtttgcaacggagccttcaatactcttcatccctatggatctcaggggctcatagggtgacaggagaggagacaagctagcttgggaagagtctttgtccttcagcttctcctctactgaaacactatatacttggggccacagttcatagcaaaacacacatgctgtctttctttctctcacacccccatctcgggaacccaacaacttgatggcaggtagctctgggtatccttggtctggcattcacccactgggcatctaagctgtcctaaagctcttttcaatcacttctcactgtttccaggcccatgtgggtaggtgttccagccttcactctttcaggctgttcataaaggcacagtgtgggaaaatcccctactgtgatggccattgctgggaagcagggaaggttaagggcccactgctgcccaaggctagtgtagacaccctctgctcctccactcatctcctcaaataatgatatcaggtgcagcagctgctgtctggaatgttatcaaaccaggactgcacaggcactgcattctctgtgtggaagatgtaagaagcaggcgagttgtccaggatgagttttcctcaggtccctccccagatggctgacgtccttgacatagcagccctggtgaaacaaacatgactcatgggacaggcagccccagaccatcccatacccgtccagctcacccgtcacaggatctgcctacttgttcaggctgggaagaagagagcaatgacgaaaacacatttaaacatttcctccattcatgtcaggaactcatccatataaggcctcatgagcacatggatctggtgcatggtcccctcaagctctacaggcactaggcagtcagcattgctgattggcttaaaggagctatgcacaagggtttcatccaggtcagtgaccatacagatccttccttgatttttctctgtcacctctgggagcaggcaggttcctgggatctgataaaactgatattggagacgctggagctgatccgacatagcaatggtgttgactccctccttatgtgtggattgctcagcgggggaacttgactgtccaacatgctgggtgcaagaacagcagaaaggggacttttaagatgtggcaaacatgaggcctcttcggagaggactttggaaaccaggccttgcttggtaaggaccagggcatcttccctccatgcctgggtgatgatggagccttgttccatctaacaatcctgagggctgggctggggggcatgggctggggcctgattcagttcccgagattctgacctccacagctgttcacataccccttctcctttccatactggccgggaaggga

SEQ ID NO: 6656 - DNA, 5775 bp, Homo sapiens
cgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccggtgagcaacctccgcctgctcgccggacgcttccagtccctcccccaaaccccttgccctgtccccgcgcccctccacgggcctagcatttcctctgagcagcggcctggcctgatcaccacccatctccccacagtggaaggcgggcacagagccatcttcttcaatcggatcggtggagtgcagcaggacactatcctggccgagggccttcacttcaggtaatggcgggcagagcctgctgaccctgacctttcacccttgacgccgacccagcagtggctatagtcggacgtgcaacaggattcaacgctgctcttttcccaccctcctcatccctgcccctaggatagtgggtgctgcgagaacctccagcagcatacaaactgttgttttccagagggacaagagaatctctccttgtctgtggtcgtggagaggagcaggccaaaaaacgcgtggtgaggggaaaccgggcaaggctagtgaaactgcggccttttctttttttttttttggagagggagtcttgctctgtcgcccaggctggagtgcagtggcgcgatctcggctcactgcaacctccgcctcctgatttcaagcgattctcctgcctcagcctcacgagtagctgggattacaggcgcccgccaccacgcccggctaatttttgtattttagtagagacggggtttcactatgtagatcaagctggtctcgaactcctgacctcaaatgatccgcccgcctcggcctcccaaagtgctgggattacaggcgtgagccaccgcgcccggccgaaactgtggcctcttaatacctatccctgtcctctccaggatcccttggttccagtaccccattatctatgacattcgggccagacctcgaaaaatctcctcccctacaggctccaaaggtaggtctgagcacttggtaatcacatggcaggtgggatgatcaaggtagctggcaagaaaccccaggggaatatggtagtgtcaggcctttaggcctctttccacatctgcaagagctgtaacaaaaatacctgcctcctggggtcaaagcagcaaattctgaacacactgtgtttgcgtgctttttactgtctcctccctgacgtgtattcaataagagtattgtttgtccctcgtcttgttcactgcctagatcaaagctttgttttaaagccttttttttctaactgcttgacttactatatctacagttacatccactagtacactctgttctggagaagtttgtccctaagcttgactagttcacctgttctctccttctagaccatacataaaagccgtgcctttgagttccccagacctcttcctcctccccacccacgcacacatatacaccctgggtcaggtagctcacctgtaacctgtaatgtacttctttgtgctatacctagtgcaggtcgcttattcatttactagactgggccctgggaataaaagattcattaaacacaattcttgtcccccaagtccttacaggagacatgattacggtacagcacgaaagcgcccacgttagaggttgcacagagtacagagggggaaagagtagtcagctctgctggtgacggggtttgcagttcaaggcttcacagtgggtgagggtgcatttcagctgtgctgcgtcttgtcttccttgtcagcctgattaactctcctccccccagggtagtgccaggctgtacaccattgcacagggcatacagggaggaacatgaaggagaaaatgcttgggaaagggtgtttggccttgaccagccactgctgacctcaatctcagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtctgactcccaccaccatctgcgtggtgtcagcctttccttcctaggcccagagtattgggaattaggaaaggcagcttattagaaaagcattgtcaccctagtgccatttccacctaaaagctgtgctaattgccactgtgaaataaggagagccagcattagaactcgatagcactcggtgttaggaagcacagaggaaaatggccaagtcttggcttttcctgcacctcttcgagcagagaggcttatgttacaggtttgcctgacaggaagctaaggcagtgcatgttgtattgagagtgaagggttaggggtcgcaaccttcctttcagctccccagtcccctcaaaccacccctcccttcccctcttcacccctgccctcaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgatatccttctgctggagagatctcagcccagcccctagggcacctgagttccccattctccttcatgggcaggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgacagcccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacggtgagtgtgtcagcccagcgtctctgatggggctgccttgagaaagtgctttcagttaaggcacattgaggtgagggaattcgaaccttgcttgttccggtttctactcagattggcttctctggccggcgcggtggctcacgcatgtaatccccgcactttgggaggccaaggtgggtggatcacctgaggtcaggagttcgagaccagcctggccaacatggtgaaaccccatctctactaaaaatacaaaagataatgagcccgctgtggtggcgtttagctatattcccagctacgcaggaggctgaggcaggagaatcacttgaacccaggaggcggaagttgcagtgagctgagatcatgccactgcactccagcctgagcaacagagcaagactccgtctcaaaaataaataaataaaaaattggcttctccgatactcctcctgtcaagaatgattcctctgggttccctgaccttttgttctaatcatagctgctgctcagcgctctggatccctaagtgcgagcagaaaccatgtgttactcattgctgcacccctgccctaatctgcatgtgttccatgttaagtagctgctgaattgcaggggtcggaattgaggtctttgcttaatgcaagcatctgtcttatttcctgccctgtagatcgccacatcacagaatcgtatctatctcacagctgacaaccttgtgctgaacctacaggatgaaagtttcaccaggtgagagatgtggccacactgtggggtatcaccaagaacgtgggacctgagtctggttgtttgggctctggagcctgctacagctattcatatggctcagagacattgaaccaaaattagaaaagggggtggttgacagtttctatcttgcatctcataggattgattttatgagatcaaataggattattcacataaaaagcactttaattataaagttttcatctaaccaaaaagtgatgaaagatgatactcagttttcttactcaagagccctcaaactcctctggtgaatggagggatgttaggaaaggagatgagaaatagcagtggccatgagaacatgcctcctcctttcatgagcctgagattcctggctgtcaaccctgtttatcttttctcttgggagcaaaggagggttcaaagctgagtggggcctgaagctgtcaattaacatgtgcatttctcttctctgtttcttgttcatctggcgatctggcaccacaggggaaggtaagctgttgttgcttctgtggggtcctgcaggccaccttctccagtacccgcctcctaccctaccccctttcccacctccccgaagacaaaccctcaatcagggtaggagggtcgtagagggaatggcctagagtgtcctgcctctcacatttatgtcccctaataatgtcattatctatcttttttttcctacagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaagtcaaggcttcacgtgttcatgaactgggtaactggcagcaagcatgcgcacgttcacatgtgcgctcctgggtctgtctttgtgtgtgccagcagggggcgcaaaagaatctggctggggcggctaaggggaagcaaggcctgggctccgaaacaggacccaagctgggaaggctggccctgagttctcgaggcccagctgtgctcttcacacaccctccatttctcccacatcacccatttttttaaggctggacagccatggctttgctgagccagattaaaaatctgatgaccccaacaggagctgcttccttggcagcagggttccttgtggctgtggggagcctgcctgtgcctgttgaggcacttctgtgcccagaagcccagtggatcgcgtggc

SEQ ID NO: 6657 - DNA, 738 bp, Homo sapiens
ctggagcccggggtcctccgctcaactcaggacgttgaggctgcattgagccaagatcatacctctacactccagcatgggcaaaagagcaagattctgtctcaaaaataaataaataaattttgtttttaattagccaggcatgatggcatgcacctgtagtcccagctattcaggagaccaaggtgggaggatcatttgagcccaggaatttgagactgcagtgaactatgatgatgccactgcattccaacctagatgacagaaggagacctcatctctaaaaataaatatatatattttttccaaccactttttatctataccccaatgtcttacattccataaaacatcatgttttgaattccagtataactttatcgttaaacatgtttctttgcagaagcatgtataagttagggtccacaagattatttgcataagctaatttacaaaaaaaattatataatcactgacatgaaagcatgtctgggcagccatgggagctcatatgaggcgtccagttcagtcgccttttaaaaatgatatttgcattagctgggcatggtagcatgtgtctgtagtcccagctactcaggggactgaagtgagaggatgcaccagagccccagaagtcaaggctgcagtgagccatgatcacatcactgcaccagcctgggcaacaggagtgaggccttgtctcagtcagtcaatcaatcaatcaataatggtatttgg

SEQ ID NO: 6658 - DNA, 541 bp, Homo sapiens
ttttttcaagttttattttaagttcaggggtccatatgtgataaagtttatttttcaacttctattttaagtttaggggtccatgtgcagactatgcaggtctcttacatacataaatgcgtaccactgtggtttactgcacagatcatctcatcacccaggtaccaagcccagcatccgcagctattcttcctgatgctctccttcccctcccccatgccatgaaacaggtgtccagtgtgtgttgttcttcctgatgtgtccatgtgttctcattgatctgcttctgctaataagttagaataataataggcggtgtttggttttctgttcctgcattagtttgctgggagtaatggcttcaaattccaaccatgtccctgcaagggacatcatctcattatattttatggcttcatagtgttccatggtgtatgtgtaccacatttcctttatccagtgtatcattgatgggcatgtagattgattacatgatgttgctattgtaaatagtgctgcaatgagcatttgtatacatgta

SEQ ID NO: 6659 - DNA, 105 bp, Homo sapiens
ggaggctaaggcaggagaatcacttgaacctgggtggcagatgttgcagtgagccgagatacttccactgcactccagcctgggtgacagagcaagactccatct

SEQ ID NO: 6660 - DNA, 105 bp, Homo sapiens
ggagactaaggcaggagaatcacttgaacctgggtggcagatgttgcagtgagccgagatccttccactgcactccagcctgggtgacagagcatgactccatct

SEQ ID NO: 6661 - DNA, 564 bp, Homo sapiens
agagaatccaccagaaacacatttttttttcaagttttattttaagttcaggggtccatatgtgataaagtttatttttcaacttttattttaagtttaggggtccatgtgcagagtatgcaggtctcttacatacataaatgcgtaccactgtggtttactgcacagatcatctcatcacccaggtaccaagcccagcatccgcagctattcttcctgatgctctccttcccctcccccatgccatgaaacaggtgtccagtgtgtgttgttcttcctgatgtgtccatgtgttctcattgatctgcttctgctaataagttagaataataataggcggtgtttggttttctgttcctgcattagtttgctgggagtaatggcttcaaattccaagcgcatgcctgcaagggacatcatctcattacattttatggcttcatagtgttccatggtgtatggtaccacatttcctttatccagtgtatcattgatgggcatgtagattgattacatgatgttgctattgtaaatagtgctgcaatgaacatttgtatacatgta

SEQ ID NO: 6662 - DNA, 105 bp, Homo sapiens; identical to SEQ ID NO: 6660

SEQ ID NO: 6663 - DNA, 1996 bp, Homo sapiens
ccaacatgagccaccgcacccggccctctccatcttccttgaacgaccccattcacctactgctcctatttctaagactgtgaccaacagagcactggagcatgcagcagcacacagaccccccgcccagatgcctcgtcgtctgggtccccatgcttgccccaggtcccttgggccacgtactaatccccctctggagaccttgagggaggtaagattgggaattagcaatacctgaaatgtgttaattctctaggtcatgtttgactctactccagtcctcgtcgccctcttcctccaccccagacttggtgcaagctattccctctgcctacaacactcttcttctccatgtttacccacctcataaccactgatcctttaggcctcagcttttctcaacccccatgcagccattcaacagaatctggcctgtggcaggctctcttctaggtaacgaagctgcattccttgcagcatttagggacccagggtatcaagggctccgcaattaactttgacacatggcttccaagatcgccctgaccctgaatatcccaaggccagacaggagaagagcgaaattggagggctgtgtgagaggcattttggattgggactggaggtagggaacatccctttagccttcattccactgcctggatagctttcacatggccatgcctaatggccagggaggcttatgaccatggtcagaaagtcagctgtgtttccagggtgacaaaggaacaggtttgtgaatcatcatggtctgaagttcctggtacacgggatccatttcactcatcttgcctcatagagaaccctcattctcacctcccacaagggagaaaatgcaaagtttcatgcagtcactgcacagagtcttccagtgatgtgcatttctggacatcaagcctgaaagcggtacatcatagtttgtcaatgtaaaaactaaaataaaaccgtaacaattccccaccacacaccaaaaaatacctaacatcaggttaatgttacctccctccctgagtacagaaacaggatacgcacaaggaaaactgccattagaaagggaaggcttggaggcccatggcagttcctggtccacagcaattataaaactcttctgggcaggtactgtgaagtcctcatactcctgctggttcaaaccaaggacccaaggttgttttaaggcatgaacagttaaaggagtttggggtcctagcatgagctggttggtttcttgggcaatgcaagtttctcagaaatgtaataggttctgatgtacttgtttctagttatttccatgtatccatagccatgtccagagtttcttgttgtacataattccctaacttgatgaattatgctttctagttcatagacttctctctctctaatgatagagtttatgcaaaaccatcagacacaggtgggaagattacacctattattattacaccaattatttcatcttttctacagggctcagtcttaactggccacttaaaggatttttcatacttattttctattattgagctttaggtacaatcagctttttcaaccctgtgaaataccaaatttctgggtgatctgttctctatatcatttatatcatttataaactagcccttccttccctgagcctatttatctcctctaataagctttttaaaagcacaactaacaggccaggcacagtggctcacgcctataatcccagcactttgggaggccaaggcaggtgaatcacttgaggccaggagttcaagaccagtctggacaacatggtgaaaccccatctctagtaaaaatacaaaaattagctgggcgtggtggtgcacacctgtaatcctagctacttgggaggctgaggcacaagcattacctgaacctgggaggcagaggttgcagtgagccgagattgcaccactgcattccagcccgggagacagagcaagaccctgtctctgaaggaaaaaaaaaaaaa

SEQ ID NO: 6664 - DNA, 1997 bp, Homo sapiens
ccaacatgagccaccgcacccggccctctccatcttccttgaacgaccccattcacctactgctcctatttctaagactgtgaccaacagagcactggagcatgcagcagcacacagaccccccgcccagatgcctcgtcgtctgggtccccatgcttgccccaggtcccttgggccacgtactaatccccctctggagaccttgagggaggtaagattgggaattagcaatacctgaaatgtgttaattctctaggtcatgtttgactctactccagtcctcgtcgccctcttcctccaccccagacttggtgcaagctattccctctgcctacaacactcttcttctccatgtttacccacctcataaccactgatcctttaggcctcagcttttctcaacccccatgcagccattcaacagaatctggcctgtggcaggctctcttctaggtaacgaagctgcattccttgcagcatttagggacccagggtatcaagggctccgcaattaactttgacacatggcttccaagatcgccctgaccctgaatatcccaaggccagacaggagaagagcgaaattggagggctgtgtgagaggcattttggattgggactggaggtagggaacatccctttagccttcattccactgcctggatagctttcacatggccatgcctaatggccagggaggcttatgaccatggtcagaaagtcagctgtgtttccagggtgacaaaggaacaggtttgtgaatcatcatggtctgaagttcctggtacacgggatccatttcactcatcttgcctcatagagaaccctcattctcacctcccacaagggagaaaatgcaaagtttcatgcagtcactgcacagagtcttccagtgatgtgcatttctggacatcaagcctgaaagcggtgacatcatagtctgtcagtgtggaaactcaaataagaccgtaacaattccccaccacacaccaaaaaatacctaacatcaggttaatgttacctccctccctgagtacagaaacaggatacgcacaaggaaaactgccattagaaagggaaggcttggaggcccatggcagttcctggtccacagcaattataaaactcttctgggcaggtactgtgaagtcctcatactcctgctggttcaaaccaaggacccaaggttgttttaaggcatgaacagttaaaggagtttggggtcctagcatgagctggttggtttcttgggcaatgcaagtttctcagaaatgtaataggttctgatgtacttgtttctagttatttccatgtatccatagccatgtccagagtttcttgttgtacataattccctaacttgatgaattatgctttctagttcatagacttctctctctctaatgatagagtttatgcaaaaccatcagacacaggtgggaagattacacctattattattacaccaattatttcatcttttctacagggctcagtcttaactggccacttaaaggatttttcatacttattttctattattgagctttaggtacaatcagctttttcaaccctgtgaaataccaaatttctgggtgatctgttctctatatcatttatatcatttataaactagcccttccttccctgagcctatttatctcctctaataagctttttaaaagcacaactaacaggccaggcacagtggctcacgcctataatcccagcactttgggaggccaaggcaggtgaatcacttgaggccaggagttcaagaccagtctggacaacatggtgaaaccccatctctagtaaaaatacaaaaattagctgggcgtggtggtgcacacctgtaatcctagctacttgggaggctgaggcacaagcattacctgaacctgggaggcagaggttgcagtgagccgagattgcaccactgcattccagcccgggagacagagcaagaccctgtctctgaaggaaaaaaaaaaaaa

SEQ ID NO: 6665 - DNA, 3764 bp, Homo sapiens
tcagtgtgtgcggaacgcaagcagcagagagcggagaggcggcgctgtagttaactcctccgtgcccgccgcgccgaccctccccaggaacccccagggagccagcataaagcgagctcacccagagtacagctcctctgacagcgagctggacgagaccatcgaggtggagaaggagagtgcgcacgagaatgggtgagctggcggcggcggagcggagccgagccagagcgggaggcgagcgcacgcctgccgcggtgacagcgggctatgacccttggcgcgccggtgccctgcgctgacctccgcgcgtcgcaggctggcggcagcctgcggccagggaacccctaggtgccttccagcccaagtggcaaaaaaagtctgagtgcggggagggtgtgggggcgacctctcagatcacctctcctcgtttaacggcgatttcagtttttgtgttgttctttttctcttttcagaaacttgagttcggctctaggttccatgtccccaactacatcttcccagattttggccagaaaaagacggagaggagtgagtctctttacactctccttttatttttgttattgattaacggaaataaccacctttttttttgtctttgaaatttacagtcgtaatggtaatgccttcctttgttttgcttgccttctgcagataattgagaagcgccgacgagaccggatcaataacagtttgtctgagctgagaaggctggtacccagtgcttttgagaagcaggtaatggagcaagtaggtaaagctctcagcatagctatctgcaccttctgaatcttcccctcattaatctcatccgccttggaaaatagctgtgttgcttgtgcctagatgaattcgtacacagataccagcgtattttgtgaagacaactgattttgctttagtccatgctttacgatttacaaagcatgtatctttgtatatatgtttgcatattttaaattgttccccaaaggaacttgtgccaaatcaatcttttgccattctcatctttagggatctgctaagctagaaaaagccgagatcctgcagatgaccgtggatcacctgaaaatgctgcatacggcaggagggaaaggtacatctcctagacctagtgggggctctgaatggttggcaaagagtgagcagcggctgaaggccaggattggtgcagtagctgcctgatttttctttgggggtggggagagaacggtgtgtggtgtgtgcagttccctgtcagtacattttcgaatgcacatagaatcttctccagtgaattcaccaccccagctctctgcggattgagctagtgcatcttttggaaaaatacctattatttgtgaggtcttcaaaagttgtgacagccctgattcagatcaggtagctttcacatttgtccattgctattttgagaaaaagcatttaaaaacaatatgtggtcttatttttggtatacgggattttaaaaaaaaggtgctgccacatgcctcttgaggaaagaaatgtattctggttaagtaaaggaaacctaacgggagaccaaggtctgtgtgtatgtctctccagcaggaaaatgctttactgaggtccaagtgcctaaaagctccgcgatgataacttacatctgtgtgtctaatgaatttcactgctctgtggtttctctgcccttgatgtattttttgttgttgttgagggaaaacattaaaggaatgaacatagtttcatctgctggtagggtataattccaatttctgctctgcagcttctaattgggctttgaacttgcattagcaaacacattctgcttatgttgattaatgcaaagatttttgttgattccaaagactttcggaagaacccctgactgttgtgttttaagggatgcaggtatctgccaggaagggctgtctctgggacttaagaaatgagggaaacgggcaaagccctgagatttttcttttgttcttttgcttaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtattc

SEQ ID NO: 6666 - DNA, 3764 bp, Homo sapiens
tcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatgggtgagctggcggcggcggagcggagccgagccagagcgggaggcgagcgcaggcctgccgcggtgacagcgggctaggacccttggcgcgccggtgccctgcgctgacctccgcgcgtcgcaggctggcggcagcctgcggccagggaacccctaggtgccttccagcccaagtggcaaaaaaagtctgagtgcggggagggtgtgggggcgacctctcagatcacctctcctcgtttaacggcgatttcagtttttgtttgttctttttctcttttcagaaacttgagttcggctctaggttccatgtccccaactacatcttcccagattttggccagaaaaagacggagaggagtgagtctctttacactctccttttatttttgttattgattaacggaaataaccacctttttttttgtctttgaaatttacagtcgtaatggtaatgccttcctttgttttgcttgccttctgcagataattgagaagcgccgacgagaccggatcaataacagtttgtctgagctgagaaggctggtacccagtgcttttgagaagcaggtaatggagcaagtaggtaaagctctcagcatagctatctgcaccttctgaatcttcccctcattaatctcatccgccttggaaaatagctgtgttgcttgtgcctagatgaattcgtacacagataccagcgtattttgtgaagacaactgattttgctttagtccatgctttacgatttacaaagcatgtatctttgtatatatgtttgcatattttaaattgttccccaaaggaacttgtgccaaatcaatcttttgccattctcatctttagggatctgctaagctagaaaaagccgagatcctgcagatgaccgtggatcacctgaaaatgctgcatacggcaggagggaaaggtacatctcctagacctagttggggctctgaatggttggcaaagagtgagcagcggctgaaggccaggattggtgcagtagctgcctgatttttctttgggggtggggagagaacggtgtgtggtgtgtgcagttccctgtcagtacattttcgaatgcacatagaatcttctccagtgaattcaccaccccagctctctgcggattgagctagtgcatcttttggaaaaatacctattatttgtgaggtcttcaaaagttgtgacagccctgattcagatcaggtagctttcacatttgtccattgctattttgagaaaaagcatttaaaaacaatatgtggtcttatttttggtatacgggattttaaaaaaaaggtgctgccacatgcctcttgaggaaagaaatgtattctggttaagtaaaggaaacctaacgggagaccaaggtctgtgtgtatgtctctccagcaggaaaatgctttactgaggtccaagtgcctaaaagctccgcgatgataacttacatctgtgtgtctaatgaatttcactgctctgtggtttctctgcccttgatgtatttttttgttgttgttgagggaaaacattaaaggaatgaacatagtttcatctgctggtagggtataattccaatttctgctctgcagcttctaattgggctttgaacttgcattagcaaacacattctgcttatgttgattaatgcaaagatttttgttgattccaaagactttcggaagaacccctgactgttgtgttttaagggatgcaggtatctgccaggaagggctgtctctgggacttaagaaatgagggaaacgggcaaagccctgagatttttcttttgttcttttgcttaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttttcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaacctgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtattc

SEQ ID NO: 6667 - DNA, 423 bp, Homo sapiens
attttagcaaccgcgatttccaatgacattacagcattactgaacagcattgtacttcgactatctcttactgttacataggtttagatggctgctaatgtggtaagaagtgaagcctctcatttgctggctctgctgaaagagctgtggaactgtaaaacatgtagcatgttccacttgtctcatcagtgatcgctatatctggttagcgggaggcgtggcagttcatttccagattacatacttttccatggaaatattctggtttcttttcaagccctttcaaggtgaaaagtatctgaggatggtgcaggtggagtgtgagcttcctaggaagcaggatggagtatgactatgtaccaatagtgtatagaaaaattaattcaggaaaactcccatttctattctgttgatgcaattagg

SEQ ID NO: 6668 - DNA, 423 bp, Homo sapiens; identical to SEQ ID NO: 6667

SEQ ID NO: 6669 - DNA, 206 bp, Homo sapiens
cctggccaacatggtgaaacctcgtctctactaaaaataccaaaaacaattagctgagcatggtggcgcgcgtctgtaatcccagcttctggggaggccgaggcaggagaattgcttcaacccgggaggcggaggttgcagtgagccgagatcgcgccactgcactccagcctgggcgacagagtgagacaccatctcaaaaaaaa

SEQ ID NO: 6670 - DNA, 1463 bp, Homo sapiens
gtcatgcctaacagtctggggagagtctcttggggcatgagatatctccccacgagaacactttgtgaccacattgatcacagactttgtcggggagtggcccaccccgcctcagatcacagctaccatgaatcattgccactcgggcccgctgccaaaacatctcgtgttgggctagaccagtcgctcatttatcacttcaagagatacttattgtgtgcctactctgtgccagacactggattagacagtggagaacaagacacataagacagctacaaaacccctgttctagtggaggaaggcagacagtaaagaagcagaacaatagagaatgtaagagccaagtcacaatgaatgctattattattaagtaaaatcaagataagggggaggaaggacaaatctcctctacagaagaatgccaaataatttatggagatacgcgaagacgtttcagaacctaatgtcccattctctaagtgtggcctgtgtttactgactttcttccacagagtatggtatggaaggaggaggaaaagtgacttcacagtggcgaaagctgatgaacattagcttggccaagtattggagattaacatcaacagttataagtcatattgatagtatgtgccctgataggatgtgatgagaagggtacttcccctctgtggtcctcctcctcaaaacctgtaaccccagtctaaatagcagaaagacattgcacaaacccagagtgagggactctcaagaatgcctgaccagtactcctcaaaatgtccaggtcatcacaagcaaggacagtctgagaaacgtcacatccagaggaacctaagaatgaggactcaatgtaaaagggatcctggaacagaaaaaagacattgggaaaaactaatgaaatctgcccaaagtgtagagtttagtttagttaataacaatttttaaagaggtattaaaaaaaaaaaaaaaaaggcaggtgaaggccggtgtggtggctcacgcctataatcccagcactttgggaggccaaggtgggaggatcatttgagctcagaagtttgagaccagcctgggcaacatagtgagaccccatctctacaaatactaaaaaattagccgggtgtgctggcatgtacctgtgttcctagctactcgggagcccaggtggtcaaggctacagtgagccatgatcacaccactgcactctaggctgggtgtcagagcaagaccctgtctcaaaaaagaaaaaaaaaaaaaaaacaggtgaagagggcgtccaggaagatgtctccgtggaggcgacatgtgaactgagccttgaatgatgcaccccagtcacacctggctaggagagacctggtgtgagagccttccaggcagaggaaattactgtgtaaagatccttggatagaaacaagcttgggccaggcgcggtagctcacgcctgtaatcccagcactttg

SEQ ID NO: 6671 - DNA, 1439 bp, Homo sapiens
aaacccctgttttagtgaaggaggccagccggtaaagaaccaggccaatagagaatgtaagagcaaagtcccaagaatgcttttatatttaggaaaatccagataggcggaggaaagccaaatctccttaccagaagaatgcaaaataatttatggagatacgcgaagacgtttcagaacctaatgtcccattctctaagtgtggcctgtgtttactgactttcttccacagagtatggtatggaaggaggaggaaaagtgacttcacagtggcgaaagctgatgaacattagcttggccaagtattggagattaacatcaacagttataagtcatattgatagtatgtgccctgataggatgtgatgagaagggtacttcccctctgtggtcctcctcctcaaaacctgtaaccccagtctaaatagcagaaagacattgcacaaacccagagtgagggactctcaagaatgcctgaccagtactcctcaaaatgtccaggtcatcacaagcaaggacagtctgagaaacgtcacatccagaggaacctaagaatgaggactcaatgtaaaagggatcctggaacaaaaaaaagacattgggaaaaactaatgaaatctgcccaaagtgtagagtttagtttagttaaataacaatttttaaagaggtattaaaaaaaaaaaaaaaaaggcaggtgaaggccggtgtggtggctcacgcctataattccagcactttgggaaggccaaggtgggcagatcacttgatctcagtagttcgagaccaacctgggcaacatagtgagaccccatctctacaaatactaaaaaattagccgggtgtgctggcatgtacctgtgttcctagctactcgggagcccaggtggtcaaggctacagtgagccatgatcacaccactgcactctaggctgggtgtcagagcaagaccctgtctcaaaaaagaaaaaaaaaaaaaaaacaggtgaagagggcgtccaggaagatgtctccgtggaggcgacatgtgaactgagccttgaatgatgcaccccagtcacacctggctaggagagacctggtgtgagagccttccaggcagaggaaattactgtgtaaagatccttggatagaaacaagcttgggccaggcgcggtagctcacgcctgtaatcccagcactttgggaggccgagacaggcagatcatgaggtcaggagatggagaccatcctggccaacacggtgaaaccctgtctgtaataaaaatacaaaagattagctgggtgtggtggcgggtgcctgtagtcccagctactcaggaggctgaggcaggagaatggtgtgaacctgggaggcggagcttgcagtgagccgagatcatgctactgcactccagcctgggcgacagagcgagactccatctcaaaaaaaaaaaaaaaaa

SEQ ID NO: 6672 - DNA, 205 bp, Homo sapiens
aacacggtgaaaccctgtctgtaataaaaatacaaaagattagctgggtgtggtggcgggtgcctgtagtcccagctactcaggaggctgaggcaggagaatggtgtgaacctgggaggcggagcttgcagtgagccgagatcatgctactgcactccagcctgggcgacagagcgagactccatctcaaaaaaaaaaaaaaaaa

SEQ ID NO: 6673 - DNA, 509 bp, Homo sapiens
cttttttttttttgaaacagagtctcactctgtcacccaggctggagtgcagtggcccaatcttggctcactgcaacccccaccccctgggttcaagcgattctcatgcctcagcctccccagtagttgggattacaggcgcccgccaccacacccagctaatgtttgtgataggtttcaccatgttggccaggctgatctcaaactcttgacctcaagggatcctcttgcctcagcctcccaaaatgctaggattacaggcatgagcctccacgcccagcccacattccagctcttggccatatctgtgtactgtttgctctgctgtttactggatagctttctttgaattgactcacttgtttttttcccaaaatttagccttattctaagcactaatatccacagaaggctttctgtgcagctagaattttcttccaatgcacaatgaaataagtacaaaactatgcaaacaaagcatttgtccacacaccacttagaaagcactg

SEQ ID NO: 6674 - DNA, 1625 bp, Homo sapiens
gaagctctctgggtagtgtgagcagttctcaacgtgcaccttggaaagcgcccgttttgaggtttagctgtggccaagatagatgacttcattttgttgctttttgttcttaacatggggagatatttagaaaacatgtttggctcttgctggggaagcagtgctgttccgtacagtgttttacaagccgtgtttccttaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaataca

SEQ ID NO: 6675 - DNA, 764 bp, Homo sapiens
ctggggcgagtcctgagtgtgggcagggcctcaggcccccaagagggctgtgagcaggcaccttcctgtgaggcacgatgccaccatgtgaagttgtgtgggtctttggagagttctggcaggttgagggcctgtgcgtgtgggacccaggcctgccctgcctgctgccggccatgttccctctgcccagtcatgttgacaattgtggccaaattcaacatcgggcctgtttcctgcacccacgttggcacacactgagttcaagacagtttctgcagaaatgaatccagaggtgtttatttctggcacgttggatcagacgttcagagggtgggcgtctttctccatgcacttcagctggatcagtcagtgtcagccattgactttagcaacagggaaatgaaagactttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggtgggcacacctttgcgcaggcccagtgtgcgttctgaaggagagcccagggtggggttccgggactgaggtgcagccgtgtccagggtgggcttctagctctgccgctgggcggaactggggtaggtcccagggtggggttccaggactgaggtgcagccgtgcccagggtgggcttctagctctgccgctgggcagaactggg

SEQ ID NO: 6676 - DNA, 259 bp, Homo sapiens
cgagactccgtctcaaaaaaaaaaggccgggcacggtggctcacgcctgtaatcccagcactttgggaggccgaggcgggtggatcacgaggtcaggagatccagaccatcctggctaacacggtgaaaccccgtctctactaaaaaatacaaaaaattagccgggcgtggtggcgggtgcctgtagtcccagctccttgggaggctgaggcaggagaatggcgtgaacccgggaggcagagctttcaatgagtccaga

SEQ ID NO: 6677 - DNA, 737 bp, Homo sapiens
aaattctgttttgtgcctataatcccacctgactgacaaaaaaaagagcaatcctttatgcctctgtcctcccccagttattctaggttctggtcccttacacctggccaagctgtcaggtattattatggcatcttgttcagctaattaagcagtacaactgagacaattgccaccccatttgtcatgtgtggtgccttccaagatagcccccagtgattctcacctcctgatattcacacccttgtgttgtgtcctcccatgtcataccaaggttggtctttgtgataaaattcagggaagtgatggtgtgtgacttgtgacactagatccgaaaagacacggtgatgtctgacttgttctcttggatgtctctccctgagtgaagccagctacttttcatgaggatactcaagcattcctatggagagatccacatggtgagaaactgaagcctcctaccaagagccagcaccaacttgccagctatgtgaatgagccatcttagaagtgggttctctagccctagtcaggccttcatatgactgcagccagggctgatattttgactacaacctcatgagagactgagccacaacaacctagctaagaagctcctgaattccctaccaacagaaactatgtgagataatgtttgttgttttaactaagttttcaagtggtaatttgttatacagaatatgtaactaataaagcatggctcctttaggtctaaa

SEQ ID NO: 6678 - DNA, 1403 bp, Homo sapiens
gatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaacatcctgtccttttttaaaatctttgcttagtcagtcatatttttgtctgtatgattagaagtttttacgtccttccttttttgtacaaatctgtattgtattaatttctggatgcaatttttcaaatattaaaattatacagtcagtcaggcttcagtttattttttgaacacttgggcaattaattaaagccatatgtttaaaata

SEQ ID NO: 6679 - DNA, 8965 bp, Homo sapiens
attttctcttaacagggtattgcattactaaaccagaagtgatctttaagatcgagcaaggagaagagccctggatattagaaaaaggattcccaagccagtgccacccaggtgagttagtgatttctggcagatgaaagccagaggaaattagaacttaggtaattggtttaggatttgtcacctttggaatatttttcacaaatgtctctttttagccccagacctttggaaatgatcaaaaacaattggcccacatccctgttaccttaatcactcctccatatgttattctcactcataaatgcttttcttggctgggtgcggtggctcacgcctgtaatcccagcactttgggaggctgaggcaggcggatgacgaggtcaagagatcgagactgttctggccaacatggtgaaaccccgtctctactaaaaatatgaaaaattagctggatgtggtggtagctgcctgtagtcccagctgcttgggaggctgagacaggagaaccatgtgaacctgggaggtggaggttgcagtgagccgagattgtgccactgtactccagcctggtgacagagtgagactcagtctcaaaacaaacaaacaaacaaaaaaaaacaaacacttttttttttttttacattttaaagtattttacttatacctataatccaaaccagttggcttcattttagatatgttttcttggttagtttgtctttatcttttaaaattgtttgccttccttccgttgtcttagacaccttttgttagctgacaggtattcatgcaatccttctatatattcatttaacaacatatgatgagcactcactatgtctgttatgttttaggtaattaacagaataatgtccctggtatcttagtgtgtgtattaaaataaaggacaaaaaaatgcgtgtgtgtgtgtgtgtgtgtgtgtgtgtgtgtgtacatgtctgtgtgtttgtatatatgtacacacccatgtgcatatgtgtgtgtatataggtacacacacactgtgttgggtcatggtaagtgctgtgaagagaattcacacaggaaaggaggacgaagaatgacggtatagtctgtttggcagtaggttagagaaaacctttttgaggagttcccacattagagatgaggctttaatatgaaagtgtgagctatgtggattcagtgtagtccaggcagagagaacatcaggtaccaaacctcttagacaggtgtgttcttagaatgtttgaacagtgtcagggaaatcactgtggttggaagctagcgggcatggtggagactggtaggagataatgtcaggagaagaaacatgagctatggtagatacataaattttacttttggtgctatgagaaactgttttgagtaaatgtaaatcagcttaagtcatcagatttgatttacagtttaaaaggatctctctgacatctatgcagtgtatatactgtggtgggtggttgtgggtggtatgagtagggatagggtaccattatgtgcttcagaggagagaggatagtggctgagactgttggaagtgccagaggtactgagaagtggtaggtttgtacaaatattttgaagatggagccaagaacatttgctttcagattgggtatgagagaagggagaatcaagtgtgatcccaataatttgtctcaagcagctagatagattaggttatcatttactgagacagagaaaaattagagaggagacatataagggagttatcacagatttaattttgaacaccagaagttggagataactcttataatcgagtctgtttttgactaagagattggatatgtgtaagtacatggttgaggtcagaactagaagtatccatttgaaaggcatcaacttaagatgatgttaaaggaatgaggcagaatgagatcttcaagagcagaagtcaacagactttttttgtaaatgaccagatagtaaatgtttgaggcttggcaggccacatatggtcgtggttgcagctgctcctcctcatcttctttcttttccttattccttctcgttctcctcttgctctttctctctcctctcttttcctcttccctcttctgtactgcctcatccagctttttcccttcaaaaacttaaaaaacatacttagctcaagggccattgccgtgcagttatatgccaaccccttttctagagtgtgattgtatgtaggtgagagtagtcttgggacaataatgcttttagtaagtattaaattcatcccttagaggatattgaggaataacaatctgagctacacaaaaaccagagagcctggtttcctgtagtcaaatgaggtacattcttccatgttactgctatcttgaatggcaaccatggcatcaccgtactaataaacctgttaatatttcccaccagtctctttgttcctattgttatttttcatttaaagctatcttctacatacctttatattctcacttttcactgatataactcaaaagcaaaactatgtgttctcattcctgactcagtctaattgttagttgtctaatttctaattcctagttggttcttttctctttttttttagcctaaattattcaatttatcttcctttagcttaacaaactaacctaaagttgctgcttattaataaattaaatttccctttcttttcttttctttttttagttttaaacctttgtgtcaagggctgactttcaatagattgcagcaagggagctgctcagtaaatttccctttcaatgactataatagtgtagcccttgctacctgtcttaaatttctttgtttctgctccctaaaatttatgtcaaatcccgtcctattctatatcttaaattttatttgcaaatgttttctcatttactggaaaacttccgttcttgtttgccttgccttttttcaggtaattcatactgtgtttgtaaagtgtttagaaattgaatagtaatggcttattatttcacttgttttaagttagaacttgattttttgctgaaacttaaatagcccagattttatgacattaactcaccagtggctgtatgccaaaaacttagacctgttcatatggcttagggttgcttagggtttctttttgcattgagatttttgttctccaaaagagaagggcctctcttactaatttgggtattttgataattactttgttgattatctgtgtagccagatttaggagagatcattcattttcatacattctgaaagtattctatgatactcttcctaaatacatattcccatattttgtcttcgtgtattatagctgatcaggtgcaggttggaaataattcagtgcacgttgctttataagaataatgtacagttacattatagtaacacctgccaagttctggactctggtcacaataggggcgatagcattgagcaagggatttattttatgttacaatgaattatataaacagtaacttctaaaagatggagcaagtggagccttaaaatggtagagatgttatagagatttttgctatcattattttattattattactattattagtttttgtttttaagttaaagtagcagttcactgagggatatccaggatctaaggagagataaggataaaatgtttctagttgagtggaaggtatgttattagggatgagcaatttctgagagtctaatctctagccaaactgcacagaaatattttcaatagatttgcatgatgttgagaagatgagggtgtaaaccatgctttacctctgccaaacctaattcttatgtttctcactaccactcactctatttcctttttaaaaaaacaactcccttgaactcattctctgtgcatttcctgctctttgaaagaacagctctcagaatatctccatctcctgtttatcatgtcttgagtttatttcaccttccctagtatgcttttcctacagcattaaaaaaaactatttcttctcaataaaacttaaagaaaacactggctcttgggctatataggactgttcttttgaatccaaggaagttgatgttttcagaatgttaattttcttgctgattcaaagatagaaagaagcatgtactctggtgggaattctaccccagtaaactgtgtgtgaggggattaggaccaagctctgttttgtctccaccaaacctaatgcatcctctgaaaccccttgtctgctaatcttcaccatcactttattcagtgttcattgtctctgttgggttcaccccattttctccgagtttttctatttctgaatcagccactctggttccctgtgctgtgaattttatttcaccttttcttttcagttttgaaggttatatttataaagtgttaaatatcattgccaatttcttctccctgtttccactgaagcatgttttatgttttccacctaaaccttggagggtaaagaaaatgtacacttgaactcagttcacaccaggaaactgaatttaaaacaaaagaattgactgtatgatagtgcatttgtgtaaaagtctgattccatcagaaatgtattaaggttcataagatgtggttatttttctcatttctagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgca

SEQ ID NO: 6680 - DNA, 8960 bp, Homo sapiens
attttctcttagcagggtattgcattactaaaccagaagtgatctttaagatcgagcaaggagaagagccctggatattagaaaaaggattcccaagccagtgccacccaggtgagttagtgatttctggcagatgaaagccagaggaaattagaacttaggtaattggtttaggatttgtcacctttggaatatttttcacaaatgtctctttttagccccagacctttggaaatgatcaaaaacaattggcccacatccctgttaccttaatcactcctccatatgttattctcactcataaatgcttttcttggctgggtgcggtggctcacgcctgtaatcccagcactttgggaggctgaggcaggcggatgacgaggtcaagagatcgagactgttctggccaacatggtgaaaccccgtctctactaaaaatatgaaaaattagctggatgtggtggtagctgcctgtagtcccagctacttgggaggctgagacaggagaaccatgtgaacctgggaggtggaggttgcagtgagccgagattgtgccactgtactccagcctggtgacagagtgagactcagtctcaaaacaaacaaacaaacaaaaaaaaacaaacacttttttttttttttacattttaaagtattttacttatacctataatccaaaccagttggcttcattttagatatgttttcttggttagtttgtctttatcttttaaaattgtttgccttccttccgttgtcttagacaccttttgttagctgacaggtattcatgcaatccttctatatattcatttaacaacatatgatgagcactcactatgtctgttatgttttaggtaattaacagaataatgtccctggtatcttagtgtgtgtattaaaataaaggacaaaaaaatgcgtgtgtgtgtgtgtgtgtgtgtgtgtgtacatgtctgtgtgtttgtatatatgtacacacccatgtgcatatgtgtgtgtatataggtacacacacactgtgttgggtcatggtaagtgctgtgaagagaattcacacaggaaaggaggacgaagaatgacggtatagtctgtttggcagtaggttagagaaaacctttttgaggagttcccacattagagatgaggctttaatatgaaagtgtgagctatgtggattcagtgtagtccaggcagagagaacatcaggtaccaaacctcttagacaggtgtgttcttagaatgtttgaacagtgtcagggaaatcactgtggttggaagctagcgggcatggtggagactggtaggagataatgtcaggagaagaaacatgagctatggtagatacataaattttacttttggtgctatgagaaactgttttgagtaaatgtaaatcagcttaagtcatcagatttgatttacagtttaaaaggatctctctgacatctatgcagtgtatatactgtggtgggtggttgtgggtggtatgagtagggatagggtaccattatgtgcttcagaggagagaggatagtggctgagactgttggaagtgccagaggtactgagaagtggtaggtttgtacaaatattttgaagatggagccaagaacatttgctttcagattgggtatgagagaagggagaatcaagtgtgatcccaataatttgtctcaagcagctagatagattaggttatcatttactgagacagagaaaaattagagaggagacatataagggagttatcacagatttaattttgaacaccagaagttggagataactcttataatcgagtctgtttttgactaagagattggatatgtgtaagtacatggttgaggtcagaactagaagtatccatttgaaaggcatcaacttaagatgatgttaaaggaatgaggcagaatgagatcttcaagagcagaagtcaacagactttttttgtaaatgaccagatagtaaatgtttgaggcttggcaggccacatatggtcgtggttgcagctgctcctcctcatcttctttcttttccttattccttctcgttctcctcttgctctttctctctcctctcttttcctcttccctcttctgtactgcctcatccagctttttcccttcaaaaacttaaaaaacatacttagctcaagggccattgccgtgcagttatatgccaaccccttttctagagtgtgattgtatgtaggtgagagtagtcttgggacaataatgcttttagtaagtattaaattcatcccttagaggatattgaggaataacaatctgagctacacaaaaaccagagagcctggtttcctgtagtcaaatgaggtacattcttccatgttactgctatcttgaatggcaaccatggcatcaccgtactaataaacctgttaatatttcccaccggtctctttgttcctattgttatttttcatttaaagctatcttctacatacctttatattctcacttttcactgatataactcaaaagcaaaactatgtgttctcattcctgactcagtctaattgttagttgtctaatttctaattcctagttggttcttttctctttttttttagcctaaattattcaatttatcttcctttagcttaacaaactaacctaaagttgctgcttattaataaattaaatttccctttcttttcttttctttttttagttttaaacctttgtgtcaagggctgactttcaatagattgcagcaagggagctgctcagtaaatttccctttcaatgactataatagtgtagcccttgctacctgtcttaaatttctttgtttctgctccctaaaatttatgtcaaatcccgtcctattctatatcttaaattttatttgcaaatgttttctcatttactggaaaacttccgttcttgtttgccttgccttttttcaggtaattcatactgtgtttgtaaagtgtttagaaattgaatagtaatggcttattatttcacttgttttaagttagaacttgattttttgctgaaacttaaatagcccagattttatgacattaactcaccagtggctgtatgccaaaaacttagacctgttcatatggcttagggttgcttagggtttctttttgcattgagatttttgttctccaaaagagaagggcctctcttactaatttgggtattttgataattactttgttgattatctgtgtagccagatttaggagagatcattcattttcatacattctgaaagtattctatgatactcttcctaaatacatattcccatattttgtcttcgtgtattatagctgatcaggtgcaggttggaaataattcagtgcacgttgctttataagaataatgtacagttacattatagtaacacctgccaagttctggactctggtcacaataggggcgatagcattgagcaagggatttattttatgttacaatgaattatataaacagtaacttctaaaagatggagcaagtggagccttaaaatggtagagatgttatagagatttttgctatcattattttattattattactattattagtttttgtttttaagttaaagtagcagttcactgagggatatccaggatctaaggagagataaggataaaatgtttctagttgagtggaaggtatgttattagggatgagcaatttctgagagtctaatctctagccaaactgcacagaaatattttcaatagatttgcatgatgttgagaagatgagggtgtaaaccatgctttacctctgccaaacctaattcttatgtttctcactaccactcactctatttcctttttaaaaaaacaactcccttgaactcattctctgtgcatttcctgctctttgaaagaacagctctcggtatatctccatctcttgtttatcatgtgttgagtttatttcaccttccctagtatgcttttcctacagcattaaaaaaaactatttcttctctaataaaacttaaagaaacccctcggctcttgggctatataggtctgttcttttgaatccaaggaagttgatgttttcagaatgttaattttcttgctgattcaaagatagaaagaagcatgtcctctggtgggaattctaccccagtaagctgtgtgtgaggggattaggaccaagctctgttttgtctccaccaaacctaatgcatcctctgaaaccccttgtctgctaatcttcaccatcactttattcagtgttcattgtctctgttgggttcaccccattttctccgagtttttctatttctgaatcagccactctggttccctgtgctgtgaattttatttcaccttttcttttcagttttgaaggttatatttataaagtgttaaatatcattgccaatttcttctccctgtttccactgaagcatgttttatgttttccacctaaaccttggagggtaaagaaaatgtacacttgaactcagttcacaccaggaaactgaatttaaaacaaaagaattgactgtatgatagtgcatttgtgtaaaagtctgattccatcagaaatgtattaaggttcataagatgtggttatttttctcatttctagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttggtattaggcatgagaaaatccctattggagagaagtcttataaatatgatcaaaaaaggaatggcattaattatcaccaggatctcagtcagccaagttttggccaatcttttgagtatagtaaaaatggacaagggttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgc

SEQ ID NO: 6681 - DNA, 4357 bp, Homo sapiens
agaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagcaagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgcgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataaatgtaatgaatgtgggaaaaccttctgtgaaaaatcagctctcactaaacatcagaggactcacacaggggagaagccatatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttattgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaattattttgctacatttcactattacctttgctgttttacttatttaatctgtatgatgaaaatactgtataatagtgtgcactgcacatctgtctcttcccagctccacattcagtgctgtcttggtagcttggacttagtgggagtgtttacaccatggaaattgacaaactataaatcagggttttaattttctcagagaacctgctgtcaaatatttacagcacatcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaagccccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagcttgacacagaggaatatttttctaagtgttaatgttctatatggtaattagggggaagaattatttcttttcacaagttaatatagggatgggtgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggatggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgca

SEQ ID NO: 6682 - DNA, 242 bp, Homo sapiens
gtggcatttaccccaatcctggctctgcagagtactgtgtcttcatgtcctccacatttgtattgatccagaaatgatagtttgttgtaaaataggccagtgacaagccctcctagaatatttttattgggaggtcactgtagaccagagagtttgtgtccttattgcttccagcagtcatattgagaaagtacatttgctctgtaatctattgaaagtcagtccacaacacaaaaatgaaa

SEQ ID NO: 6683 - DNA, 242 bp, Homo sapiens; identical to SEQ ID NO: 6682

SEQ ID NO: 6684 - DNA, 242 bp, Homo sapiens; identical to SEQ ID NO: 6682

SEQ ID NO: 6685 - DNA, 101 bp, Homo sapiens
cagagcttgcagtgagccgagatcgcgccactgcactccagcctgggcgatagagcgagactctgtctcaaaaaaaaaaaaaaaaaaaaaaaaaaaagagt

SEQ ID NO: 6686 - DNA, 1419 bp, Homo sapiens
gaacatttcaagtagcctccctctatgttcctttcctttttaaatatattgataatcctactgcagggaatttgggagccatacttggtcttcgcatgcaacgtaattagatataactatactatgtgaatatgactaaagaaatgaaaatgaaaacagtatcttgtgctctgtaacgattgttattaaatatatcatagaaatgagaagagtaggctcaggagctgaactgcctagttcaaaaggccaaatttactactttttgttccgtgaatttgttgtgctcctgtttccttagttgtaaaacagagataacaataggacgtgcccataagcttttcatgaggattaaatgagttaatgtgtttggtggggaccaggtggacatggtactggtagggccctatttgacattggctttaagtatcactggctttaagtgcatcagtagatatatgatgacaataattgtattatcatggtgatatggatttcttataaatacttgtattatgttagtcacttctagaaaagaatacatctatacagtagaatataattcaaaaaataatgtcatatttttgtaaagaaattttttgtaaaacttttcagtcttcaaagagtttcatagactttattccatttatattgagagcctactttgtgttaagcattttgctgaacattgtcctcactcttatgttacttaccatctattgggaagagaaagaagtaaacaaataattacatgtagagtagtagtgtcaatggtagaggcatgaacacaacacagatttaacactagagaaagagtgatcacaaaagaaatgatgtttcagttgagttttaaatggcagctggagttcatctgaatgattaggtgtctaggacaggtttaaaggttagggagtaaggaagataatattcaaaataaaaagaacctgaggatattcacagaggacatttgcagaggcctgaaatagcattggtacattcctagaaccataaatagtttgatggtaatgtaaattacagtatgttttgaaaaatcatggaagatttataccacgataagaaacttcaactttattctaaagttgatgagcatttgacagattttaagcaagaaacaaatattaaatttatattttagaaagaattctagatacataaaaagcacttattataatccagtatccattcatgataactctcagctaactggaaataaaagggaacttccttggtctaaggaagaacatctacataaattctacaaccagccacatacttaatggtgaaataatgaatgtttttctcctaagatcaggaaaaagaaaaagatgtctcctcttacttctattcaggatggtactggtagttcaggccagtacagctatgcaagaaaaagaaataaaa

SEQ ID NO: 6687 - DNA, 1419 bp, Homo sapiens
gaacatttcaagtagcctccctctatgttcctttcctttttaaatatattgataatcctactgcagggaatttgggagccatacttggtcttcgcatgcaacgtaattagatataactatactatgtgaatatgactaaagaaatgaaaatgaaaacagtatcttgtgctctgtaacgattgttattaaatatatcatagaaatgagaagagtaggctcaggagctgaactgcctagttcaaaaggccaaatttactactttttgttccgtgaatttgttgtgctcctgtttccttagttgtaaaacagagataacaataggacgtgcccataagcttttcatgaggattaaatgagttaatgtgtttggtggggaccaggtggacatggtactggtagggccctatttgacattggctttaagtatcactggttttaagtgcatcagtagatatatgatgacaataattgtattatcatggtgatatggatttcttataaatacttgtattatgttagtcacttctagaaaagaatacatctatacagtagaatataattcaaaaaataatgtcatatttttgtaaagaaattttttgtaaaacttttcagtcttcaaagagtttcatagactttattccatttatattgagagcctactttgtgttaagcattttgctgaacattgtcctcactcttatgttacttaccatctattgggaagagaaagaagtaaacaaataattacatgtagagtagtagtgtcaatggtagaggcatgaacacaacacagatttaacactagagaaagagtgatcacaaaagaaatgatgtttcagttgagttttaaatggcagctggagttcatctgaatgattaggtgtctaggacaggtttaaaggttagggagtaaggaagataatattcaaaataaaaagaacctgaggatattcacagaggacatttgcagaggcctgaaatagcattggtacattcctagaaccataaatagtttgatggtaatgtaaattacagtatgttttgaaaaatcatggaagatttataccacgataagaaacttcaactttattctaaagttgatgagcatttgacagattttaagcaagaaacaaatattaaatttatattttagaaagaattctagatacataaaaagcacttattataatccagtatccattcatgataactctcagctaactggaaataaaagggaacttccttggtctaaggaagaacatctacataaattctacaaccagccacatacttaatggtgaaataatgaatgtttttctcctaagatcaggaaaaagaaaaagatgtctcctcttacttctattcaggatggtactggtagttcaggccagtacagctatgcaagaaaaagaaataaaa

SEQ ID NO: 6688 - DNA, 560 bp, Homo sapiens
aagtagtctggcaggataattgtgttaaaattgatagcaaattagaatagatggaagcagttacatttagctgggacaaacatatacagtgtttagcaaaggcatatcaacctgaaaatacagacctacaatgaaaatgcatcaactctaattgctatagagttgttatggtagcactataattatagtatatgtgcaagtggtctggataaaaaaaattaggacaatcaaaatatttatactgttccgtagaggaacgggtatgacattgcagtaggcaactttgaattgcctattattgttgcctttacttttggttttgtttatatcagcaagggaaaattactaattctaaatttagtttagaaggaaaaagtatcaaatatttcatgattttgagtaaagaaacataactttcttaaaatggctgtattttaatttttattatatactttattcttttgtctaattgtagataaccaagacacaagttcattagctgatgctgtagagaaagttgcaaagcaacaacaatcacaagcatcagagatagaaaaaaa

SEQ ID NO: 6689 - DNA, 560 bp, Homo sapiens; identical to SEQ ID NO: 6688

SEQ ID NO: 6690 - DNA, 17570 bp, Homo sapiens
gcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtgtaagcggcgagcccgggcctggtcggggggcgcttaactgggaagggaatggagccgaggagcgagatgggtctcagggcgggagccagaggacccacccagaggggcctcccgggggtgtcccccggggctcctaagggccgtgaaagctgccggggcgctcttctgtcccgccccgctcactcctaagtatcccgttcctccgcccgtcttagcggggcagctgctgtctgttgagcgcctgcgatgttccaggcggcctgtcagtctccttcccacacgtgatagtggactcgtgccctgcggggactttaggctccgaagtccgcccttggagagccgacgtttcctttctagtccacgtcgctcttaaagcataggacatttggcgtcgtgtctagctgtggcgagttattctactgtgcactaaagtcgggagaaacgctgaactagactaaaacaacaaaagggaagtctttatggggatctggccagtttgcccttagctgtgaaaggggggtgggagttggcagatgggattgttagcattctacttcctgtgtaggaggtttgtttctttcagttttcaattaagccttcatgacctgaatattgtgaatagagtggttataatgattaaagcagatatgtgtataaatgtccagtccaggtcctgggctgtggccggggctttcgaggttggtcaggttggtcgatttgaatctaagccttgttccatcagacgcacaaacacatctgagttgaaagaattgtagacaacgtggccacctgcttcttgcctcagaattggcttttcctctggcccctctcagtgcttatcgtgggatcaccttggcattggtcttggcagcgggcacagtagccattgcactccatgggcattattctatagccaccctgcagcgggggagggttggcagccattttacaggtgaatacactgagggtccgaggctctcttagggaagggtcaccgtggcctagctcttcccagatgtactgcaggtgaccatttcagtagtccagagaacagtgcttggcacctagctggctgctttttgcttcatcatgttgctttaggctattcatctttgcaattcggttagcctggaactcttccccccacccctcccttttcaggcttcaagtcccaggttaagttacctcaccaaataccatccccatctaaattacttcccccacttcctttctgggacttaacttccttctccttgcttgcacagagcaaaacttaacagctcatgacggagtggccatatctttattgcccctgaactgactggaatggcctctgtgtgccagattttggggtagactctgccttcagagtttacagtccagtgaattgattataaataagtaccaatgactggtcaaactattgtaaaaattcattctgcaagtgggagggtatttcagggatcacacctctgtgcgtggggtgagtgatcaggtaatggttgaatgaactaataagtcgtgtaagcaagcttcacgagagttgaagtggtctttagctttttcattgaatccacttatccttggatcagatttacctgattttggattaattcagtggatttcatttactattaacatttgtaaaaaggctagacccagcacagtttgctaaatgaagagcagcaaaatttgagattttcttgagcttggtgaacctttcctaggtcagagggcaaggaacagtactggttttcaaaccttggctcttctctatcctcgctgtcctagccccacgtgatcagcagttcagtgcaaattgaagacagatggaagcacctctgtgagggcagcccaaatccccgctagctccaaccgactgctttctcctgtgcctagttgatttttaccttttgtgcttggaaagttgagcatcactgcaactctggctggggcattggatttttataaaactttatttcaagccctgaatgactgtgttctccaatctggtagaatacagctggagaaaggcagctggctgggtgcccaagagaagggaatttcttcctagcactgtgacggagtggagcatcggaaggctgaactagaaaagggcgcataagtaggaaatagaaactgaaaagccatcccaggatatttgagttgttcaaaagcaggctggtagtttgggcatgtctcaggcacaaagtgactcgtgaacatttgatagatgagctgtacctgtgtgtgtgcttgagaagagacttcgagctgcttttatctgcatgctgggtttggttccattatactcactggaccctctgtgctctcttgggttcctcttgtcatctgcctttgtgaacaggcaacacaagtgatggccacaggccctgcctgtctctactgcctcatcacttgcccttctcaccatggtctaccgcatcatggcccccaaggtctgcctgccttcctttccagtcctcatttgtgtgtggcgtgatcttggtgtggagctctgcacccagatctgtgtggctgtcctcgtaatcaggtcccacccagctcaaatgccaactcctcagaagcagctttctatgatcaccccagctggtctgtttgccatatttccttcatatttttaatcactatctgaaattaacatttgtgtttcccttcactctagaatgtaagcatcatgagaacagggctttgtcaagtttccattgccctcagtggtgaatgaatagactccctcaccttctctgtacctggtctggaattttgcctaacagcattaacatctaacttaatgacaaggaggaaggagattcttagaggcagtagaaaatggtcaagtgttcagaagatggcctttcattatatatctttagttctttctggcagatttggttatactgtcttaatctatcaggttgggtaagtagcccagggtgtcttctccattctttctgtatgccttatctcagcattaccatcttcctaggcttcaggataggaactcggtcatctttgacttcttttcttcaaagtcagtaagttatcaagtcctcctgattctacctttctgtgaatggtttcctgaattcatcccctgctgcttcagtcagaccctcacaatcctctgcctttagccatctgtttggtttctactttgtctcttctcaccttctcacctaaaaaaaaaaaaaactatagggctgggctcagtggctcacacctgtaatcccagcactttgggaggccaagacgggtggatcaccagaggtcaggagttcgagaccagcctggctaacgtggtgaaaccccgtctctactaaaaatataaaattagctgggtgtggtcatgcgcgcctgtaaccccagccacttgggagtctgaagcaggagaatcgcttggaccggggaggcagattttgcagtgagccgagattgcaccattgcacttcagcctgggcaacagagcacgactctgtctcaaaaaaaaaaaaaaaaaaaaaagtaacaaaactttgttttccatgatagcacagagatatttttctgaaacctggatttggccttgttttgttaataccttccttttaaactcctggctccctactgtttatgaggaaaagtctgttagatttttatttcctcagatacatatcaattttaagcctaaattaggcctagaatagtcttcccttcctctgctagctgacctctttttttaaaatgccagaggggtaatgggccaacatctgtaacaaggttcgagggtggcacatctcacacatgcacatgaacacccagtcctcaggttcatgaactacaaaaggatccatctgaacccttttttttttttttttgagacggagtctcgctctgtctcccaggctggatggagtgcagtggcgcgatcttggctcactgcaagctctgcgtcctgggttcatgccattctcctgcctaagcctcccgagtagctgggactacaggcacccgccaccactcccagctaatttttgtatttttagtagagacggggtttcactgtgttagccaggatggtctcgatctcctgaccttgtgatctgcccgcctcggcctcccaaagtgctgggattacaggcatgagccaccgcgcctggctgagctgaacccttttaaggctgatcagagatgccgtctctgcagtcttcccctccaccccccccttgagacagagtcgcactctgttgcccaggctggagtgtgcagccacctctgcctcccaggttcaagcaattctcctgcctcagcctcccgagtagctgggattacaggcatctgccaccatgcctggctaattttggtatttttagtagagacgggtttcaccatgttggtaaggctggtctcaaactcctgacctcgtgatctgcctgccttggcctcccaaagtgctgggattacgggcgtgagccaccgctcccagccttcactgcagtcttaccagccctttccttctcaggtcactagttgattttccctttatgttcctgtagcgctttgccttcacctgtaatgatagcagctcccgtttgtggtgcgttttgtaagggctggacactctgccaggggtctgctatacaaactgtatcctcccagcagtcctagaggtaggtactactctctccatttcacaaaggaaaaaatggagattcaagaaaccccactgagatccttcagtggcagggcctaaggcttgaagcctcaaccttaacaccttcactgtgtctatcacaggagtttgcatttgtttctgtagttgtgtgttctttgtagtccactcctatccctcattttttctggcttggaaggacttagtatttgaactgggaggagagagcaagttgttttttactccattatccattgatgtctttttaaaagttgatccatatttgtcgtcttgtctccatgatgcgtgacagaggttctctgtatgtcttgttctagcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatgtatgtggaagtgatgtggaagagtccatgtctttccatgataagttggggtaaaacgtacagctgccatgttgttgctgaagttagagcatgactaggtcactaacagcacgcgtgcatgccaattacctgtggtgatggctgggctggtttgttttcataaccttactggtttttgtttctttttttaagagttggttaagtatatattttaggtttgaaagccatagaaatcagttatcccagttttttcctataaaagatcaattatggccaggcgcggtggctcattcctgtaaccccagctctttgggagtccgaggcaagagcttgaggctaggagttaagagaccagcctggacaacatagtgagacctcatctttacaaaaaaataaaattagccgggtgtggtggtatgtacctgtaggcccagctactcaggaggcagaggccagaggatcacttgagcccaggagtttgggattacagtgatctatgatcatgccactgcactccagcctggctgacagcaagaccctgtctcttaaaaaaaagtcaatatgaaatcattggattgtaataacaatagctaacatttgaaatgcatccatgctcttgtataatcagagtcaagtatatttattttcatacctgttataactgctactggaaaggagaaatactgttgtcttattttccaagagatatacacagccttgttgattttagaatcattaaaatttttaaaattgcagaccatacaaaagtacacaataatgtaggcttgttcctcattccagagattacttcaaaattcgttcaacttaaggcctggcaaggtggttcatgcctgtaatcccaacactttgggaggccaaggtgggtggattgcttgagtccaggagttctagaccagcctggacaacatggtgaaacctcggctctactgaaaatacaaaaaactagcagggcatggtggtgtgtgcccgtagtctcaactgttcgggaggctgaggtgagaggatggcttgagcccaggaggcagaggttgcagtgagctgagttcgtgccactgcactccatcctgggtgatagagccggaccctgtctcaaggaaaaaaaaagtgatttaatttcgaaagctgcataacattttctgccctttgacaaacactgtagaatttttaccaaccaagttgtaggatttttgcaaaatgagattatactataatatatatatttcttcaacttttttcacttttttaaatgtacactcattcccaactttttttttccacttttcaggttttttttctcttacatattggacagccttgcatgtcagtttcattatttttaacacttcggtatggatgcccatagtaagaatataccttaccatctccttttcagcgtgatttagtattagggatgcatagtagggccatttcaatgctgaatagggctattttctgtgtcttaattgggggcttcactcttgaggctgggcatggtggctcatgcctatatcctatcatttggagaggccaaggcaagaggatcactgaccccaggagttcgaaatcagcctgggcaacatagtgggactctgtatataccaaaacaaaccaacaaacaaaaccagctgtgtgtagtggtgtatgcatgtagtcccagctccttgggaggctgaggtgggaagattgcttgagcccagaagtttgagagcagcctggggaatatagtggacccagtttctacaaaaaaaggaaaaaaaaattgaggattcctcagtttgtagcttaaagtcaagttcttgagctggaggtgagacaatcatcatggtaagctggagctcaaatattggagcatttttttccccctttgaagtttacttttagaaactcaaaatattgaaatacaattccctactgtcttctttttttttttttttttttttttttgagacggagtctcactctgttgcccaggctggagtacagtggcgtgatctcagctcactgcaggctccgcctgttgggttcacgccattctcctgcctcagcctcctgagtagctgggactacaggtgcccatcaccacgcccagctatatatatatacacacacacacacacacacacacatacatacacacagagatatatatatatatatatatatatatttgtatttttagtagagacagggtttcactgtgttagccaggatggtctcgatctcctgacctcgtgacccgcccgcctcagcctcccaaaatgctgggattataggcatgagccattgcacccggtctcttcatctttatttatgcatgcataatgtggtttttggttttgttttgttttttttctgagacagggtctggctttgttgcccgggctggagtgcaattgcgtggtctcagctcactgaaacctctgcctcccaggctcaaaccatcctcccacctcagcctctcaagtagctgggactacaggcatgtgtcaccacgcctgcctaatttttttgtattttcagtagagacgagttttgcatgttgcccatgctgatctcgaactcgggagcgtgaagtgatggcccacctcagcctccctcaggattacaggtgtgagccaccgtactccgcccatgatgggctttttgtttgttttactgtatgcttttgcttttctccattttcaagattagtgattgtactgttggcatgcctcagaaaatgtttttctttcctttatcttccctcttttcttcaattcttaaaactttctttctttttagaaaacctgtaatgaagcactattctctgggttttcttctctttctgttttactgttgcacagcctagattttatatgaaaggctgggccgggcgtggtagctcacgcctgtaaacccagcactttggcaggctgaggcaggcagatcacttgaggtcaggagttcgagaccagcctggctaacgtggtgaaactccatctctactaaaaatatgaaaattagctgggcctgatggcacacacctgtaatcccagctactcaggaggctgaggtgggagaatcacttgaacccgggaggcggaggttgcagtgagccgagatggtgccactgcacttcagtctgggcgacagagtgagtgagactctgtctcaaaaaaaaaaaaaaagagaatttagattttaaagattatttctcagaggctggtgatagatactttaaccagggttagtggcttttatatgttttacctaaaggatcacttttctctgctgcacataacagaatgtggtttttggcttgctgtaaggagactagtttaaatgctagtatagaaaacttttaaaaacatcctagatttggagcttgtctgtgagcagacagcctatcatgaataggagcaaacctctaggagagttattttagagtggaagtggatatcctgatttagtcgaataaaatagcagccttggtattaatgggaaatctgcaataatcagggtttcagccccatcagcgtagtcaggagtttggtgagattatttgccagggtggtgtaggtctagttttctttgtgcccttgtttgggactatattttgcctgttgcaaggtcctcactaacttatgggctctgattcttcctatttgagttcttcctgtccaagatccggtcccacgtggctacttgttccaaataccagaattacatcatggaaggtgtgaaggccaccattaaggatgcatctcttcagccaaggtaaatgactcagtctccccttaggtggaggtcatctcttgctattaatacaaagaggttgcatgcccaggggtttagttgtatgaattgttatgctggctaaagctgatacaagtattttgggaggagtatgcaagggaggactctggtgttcacttcagatgttagctgagctatattctttttttcttttttgagacagagtctcgctctgttgcccaggctggtgtgcagtggtgcaatctcagctcactgcaacctctgcctcccgggttcaagcgattctcctgcctcaacctcccaagtagctgggattacaggcacctgccaccatgcctggctaaattttgtattttttagtagagacagggtttgtcatgttggtcaggctggtcttgaactcctgatctcaggtgatccgcctgctttggcctcccaaagtgctgcgattacaggcgtaaaccaccacgcccggccagctgagctgttattttcacaacacttgacctgagtctgaagtgatcatcagcatccttatcattacacatttggtgagctttgctcctttttggagtgtactgtggttgaagtttaatggaaaggtactcacagaaaagttttcttttttcctgtgtttcaccttccaggaatgttccaaaccgttacacctttccttgtccttactgtcctgagaagaactttgatcaggaaggacttgtggaacactgcaaattattccatagcacggataccaaatctgtggtgagtaacctttttttttttttttaaacttcattaagggaaaggatcaagcttggagaaaaatgacgggattagtagaatgaactcctgtgtgcccttcacctagattgacagattgttaacattttaccatatttgcttaaccatgctctatagtacacattttttgctgaccacttgggaataagctacagataccatgaccatttttgcaccctgaatacttcgcaccctgatacaggagtgtgtatgtcttaagaacaagaatgttttcttggaaaattatatttttgtgtgtataattaatcatattcaagaaatttaacattgattcaatctaatgtctaatgtgaaattcatgttttaattttaacaattgtaatgtctttcatagcaatttccccctccccccaaggcagaggcagggatggtacacgagttctctgtcctctgggtgctacattaagtcatgtgatgtctgttgttggtaacattaacttggttcccttggtgtccaccaaatttctccatgaagctgccattttatttttggaagtagcttcttcatagttgtggggaaagaggatttaggtgaaattattaggaaaaggcttatcaatccttggacattttactcagatattacctactggcatgtgtagtctcctttaaaaaaaaaaaaatgtaggctgggcacggtggctcacacctgtaatcccagcactttgggaggccaaggcgggtggatcagttgaggtcaggagttcaagatcagcctggctaacatggtgaaaccccatctctactaaaaatacaaaaattagccaggcatggtggcgggcgcctttaatcccagctacttgggaggctgaggcatgagaattgcttgaacctgggaggcagaagttgcagtgaactgagatcctgccactgcactctagtctgggcagcagaacaaaactgcccccccccccccccccccccccaaaaaagtatttgttccatcttagcaatgtgttacctttctctctcaatgtgattgacagaccaggtctttttttatagttaggtgtatacttcctctatagttttaatttttccatttatctcatactgcttctcttgaactacatactctgttgtatgggcagccttcagctccattgctgtaaacagtggtgcagaaattttagaattttaatgagcttttgtgagagtactagggcagctatcaatgctcatcttaagatggaactggccattttgagaaacatatctttgcctgtatctatgtatgtttataagctaaagtcttagatacagattgacttggttaaatgttacttgcactcataattttgttggatactgttattgctgaacttttctggtatggcagcctaattttctgtctttttcccctcctttggcttctgaaatccctctgattatgttgtctatgttgaggccttctcttcagcctttggccctctgttctgtcttcctctccctctgcaagttttttttttttttttttttttttttttttttttttttttgaggcggagtttcgctctgtcgcccaggctggagtgcagtggcgcgatctcgactcactgcaagctccgcctcccgggttcacgccattctcctgcctcagcctcccgtgtagctgggactacaggtgcgcgccaccatgcccggctaatttttgtatttatggtagagacggggtttcaccgtgttagccaggatggtctcgatctcctgacctcgtgatccgcccgtctcggcctcccaaagtgctgggattacaggcgtgagccaccgcgcccggccctctgcaagttcttaactctgcgtttctcccttccctttagaagccatctccttttcagtctctagtcccaccctatgttctagctccccagctacagctgcctgcccaccttttccactcagtcttctaccattccagatttctctcttgtcaatcccctttatcactgtatcttccttgctgtggggtagggttccacctttaagtgggggcacttaggtcttctctctccctggcatgagttttctgcactcactggtctggttgtttacatgtgttgacagtaactgccgccttctggccttttctccgtgctgctgcctctcttctggagcacaatttttttttttttttttttaagacagagtctcactctgtcacccaggctggaggctggagtgcagtggcacaatcttggctcactgcaacctccacttccagggttcaagcgattctcatgcctcagcctctcaggtagctgggactacaggcgtgtgccaccatgcaaggctaatttttgtatttttagtagagaagatgtttcactatgttggccaggctggtctcaaactcctgacctcaggtgatctaccgctttggcctcccaaagtgctgggattacaagtgtgagccactgtgcccggcctggagcactctttcatgtcctctttgcctttccaaatacttcccaatcttcaaaaaccaaatcaaccttttgtgtgagggcttttcagcctgatccccctcttctgagcatttcctttgttaagatgcatgtaaggctgtgttttacttccctgggacattgctcatcggcttattttcttagttttcctcatgcttttggattgtcttgtgtgctggattggaaggccagtctaggccccccaccaggctgactcacttctctgcttacagtagggaatgagaaagggtggtatcatgatttgaactttacccagtcccacgtgtcatttgacttgagctggaaatttgcagtgtttttttgggctgctgatgtgcacaggaaggagttactggccctggacagtatgtcaggaaagctgtcctggaagaaaggaggccagacacaggccacagagggctggtgcaagcttggaaattgggtgcctaagaccttgcttttgtgttgaaaggtttgtccgatatgtgcctcgatgccctggggagaccccaactaccgcagcgccaacttcagagagcacatccagcgccggcaccggttttcttatgacacttttgtggtaagtctggagcctgggctctgatccctcccctgggggagtggcacggctacttcactcttctcaaaaggggaaatggggatccccagtgttgaactttgtcgctgttgtgatgggcttccagtctgtatactggatacagtgataaaggggattgacaagagagaaaagaagactgagtggaagaggcgggcaggcagctgtagctggggagctagatgggcttccagtctgtatactgtagctactatacagtttctattcatgggccaggcaggtggccagagtgacatttatttacttacatgagatggagtcttgctctgtcgcccaggctggaatgcagtggcgtgatctcagctcactgcagcctccacctcccgggttcaagtgattctcctgcctcagcctcctgagtagctgggactacaggcgcatgccaccatgccccattactttttgtactttcagtagagacaggctttcactatgttggccaggctggtctcgaactcctgacctcgtgatctgcccaccttggcctcccaaagtgttgggattacaggcgtgagccaccacgcccggcccagagtgacatttaagaagatgatctgggctgggcgcagtggctcacacctgtaatcccagcactttgggaggccgaggtgggcggatcctgaggtcgggggttcgagaccagcctagccaacatagtgaaatcccgtctttactaaaaatacaaaaaaattagccaggtgtggtggtgggcacctgtaatcctagctacttgggaggctgaggcaggagaatcgcttgaacctgggaggcaaggttgcagtgagccaatatcgtgccactgcactccagcctgggcaacagagcaagactgtctcaaaacaaacaagaagatgatctggtcagtctttgagacagagacagtgatacttgctctttccatctcctagccctgccaccaaatttttgtctacttttcttgtggtttatataatttctgcctgttatagaacttggtttggggacaggtgcggtgcagtggttcatacctacaatcctagcatttttgggaggctgaggcaggtggatcgcttgagctcaggagttcgagaccagcctgggcaacatgggaaaaccttgtctctgcaaaaaatacaaaaagtaaccaggtgtggtggctcctacctgtagtcctagctactttgagggagctgggacaggaggatctcttgagcccaagagacggaggttgcagcaagctgagatcatgccactgcactccagcctgggcaacagaatgagaccctgtctcaaaaaaaaaaaaaaaaaacaaaacacacacacacaacaacaatttggacttgggaggctcaatctcgcatgtccatggggaccataattgaaatgatcctcctgaggatttccaagccaggtggtgcctgactcgttatgctgccatcaccttgttttcctatggaaatgcaggcgcagcattgcctagcttctccaccccccatgcccaagcaggacaggaaaatttcacaggaggtttcacaggttttaattatcttcaaaaatacttcaggtcaaatagcatatatccactagccaaatacggctgtcaggtttatattctttccctagagctggatggtttcaaaggggcacactgttgtcttgccattatagtagtaggtaactttggccaactatatcaagtaaacctcttacttacatatatagatgtcaagttaggattttagagtggtattcggtcttgatggctgaatttcagtatctaagaaagaaagctctctgctaaattgtcataaagaatattttttctcagtctgacagtgtctgaaactcagacttcagaataactgccctttttgttaatgtgacacagatgaattacattcatctgtgtcacattaacaaaaatgactcattaaaaatgagtcctaaaaatgactcattaaagagggctagttgcgctatagtttctgctgtattgtatggctctaaaaatctgattctgtactgtgcactgattccacctctcagaaacaactcttcagctcagtgcatctgcgtgctctgttccgacagacttacaaatgttctgagcacttggtctgtgccagcctccattcgtgtgctgtctgggtttctcaatctccatttaagggaggcatccttaacttcatttaagaatcaggcagcagactgggtgcagtggctcatgcctgtaatctcagcactttgggaggccaaggcgggtggatcacgaggtcaagagattgagaccatcctggccaacatggtgaaaccctgtctctactaaaaacataaaaattagctgggcatggtggcgcacgcctgttagtcccagctactcgggaggctgaggcaggagaatcacttgaacctgggaggcagaggttgcagtgagccaagactgtgccactgcactccagcctggcaacagagcgagactccatcaaataaaaaaaaagagaaggcagcagagacagattaattttcccaaagttacatacctagcatcacaaacagttgcactggggatccggtccctggcaacctgctccggatccagttgctaggctgtcctgcttctactgaaagccagtctttgcatctagaaacagttgctgaggctgcatgtctctttttgcccttaggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaagctatggttcttgttttcattcaacacatttgccatagcatgggcttggggagtctccagaagatgg

SEQ ID NO: 6691 - DNA, 182 bp, Homo sapiens
gcgctgtcgcccagactggagtgcagtggcaagatcttggctcactgcaagctccgcctcccaggttcaagccattctcctgcctcagcctcccgagtagctgggactacaggcgcccgccaccacgcccggctaattttttgtatttttagtagagacagggtttcaccgtgttagccagg

SEQ ID NO: 6692 - DNA, 113 bp, Homo sapiens
ggagttcaagaccagcctgaccaacatggagaaaccccatctctactaaaaatacaaaattagccaggcgtggtggtgcatgcctgtaatcccagcgactctggaggctgagg

SEQ ID NO: 6693 - DNA, 7057 bp, Homo sapiens
gtcaaatgatttcagttcgtgaagccaaagccattccaaggcctgatggtattgaatggagaaataaatacatctgtgtagaaggtagttttctgtttaccatctacgtatcatcatggtactaagagaattacttgagtaatttcagctgtgtttcagttaaaagtaatacatttatgtctgaagtgatttgtaagtcttttagtttaaaatttttaattttaaaaagtcatttaaaattttttaggtatgagaaataataaacataaactttaggcattcaccctttctagttggtaagattcgagctgtctttatccctcttacttgtggttgatggataatttcatgacttacagatggaagaaaatagaatctttatatgtgattcttatattgacataaaatgagttatattcttttatacttaaaatattagtgcaagttggacttttattaatagaaattgatgttgctttaaaaattaaatgatctgaagaaattttcttctctaaaattaatttacatgtagttgaatatatccttgagacactttgagtgagtagaaaactgacttcaagggacaaaattattctcatagatgctaaattgaaggcctttgtaaatctggaggttaaaaagtataaatagttgagaatcagcatttgtagaaaacatcagattttggatgttttaatcttgaattatatgcagtattttaagagtttgtgaatatgaaattaaatctcctgctttggtgtgctaataaatggcactgggtgggcattattttagttacttgtgttcagttgaatactaaaccctgttctaaagtgctatgatgatgcaattcagtataatttggcatatgaccttattctgttaaggaaaagaaccccacgatactgtgatggtaaactgctttttaacatagcctttctaagcactaaaaaataagcaagaggagtatttaaaattatgggcctgtgtagattatatgacaaatctaaaagttttgacctttccatcagactccctattcttccgtactttttctaggtctttcccctcggttacctttcctcttaccaacaacttcattctttctgcctccagtctttcgctttcagctttaagacatacataggtcttctcattcttgaaaaatactctttatttggtcctactggttcttctgtgcatttttcctcctttttccatgctaaaattcttaatttctagtaatgtttacctactgctggcattatttaagacatttcatctcattcctgatgcctttagttatccttgtcttctcattattatcttcagtttcctcgtactcttctggtttcttcctgtctctctatatggattcttcacttttgtgggtgaaaggtgagtgggatggtggtgtgaacatggaaagtatatatattggagacacacatacataaaaactgttcctttgtttttttcctgtcttctgtttgcttttctctttttctgttttctttttctgccaaatttctcatgcaagttacttcttttttcttttctttgattttttttttttttttttttttttttttgagatggagtctctctctttcgccaggctggagtgcagtggcgtgatctcggctcactgcaacctctacctcccaggttcaagtgattcccctgcctcagcctcccgagtagctgggactacaggcgcgcaccaccatgcccagctaatttttgtatttttagtagaggtggggtttcaccatgttggccaggatggtctcgatctcttgaccttgtgatccacccacctcaggctcccaaagtgctgggattacaggcgtgagccactgtgtctggccagacttcactgtatctttttctaaaccatccacttgggccataactccctgcattgtcttccattttctccagtattgaacctctaccttcaaaggacaaatcagcttttaagttaaaattaaagttacctttctgtgatatttaacattaactgcctctcttcgatataatgctttcttctttttgatgactttttattattttcctaagggtaggtctttgaccctctgtaatttttcagaaaccttatccacatttatgatttagacttaacacacctatgctgatgactttcatttttgatcaccctctcccttgaattctatctaccttattaggcagttcatagtatatcaagcttttctgtatacataaatctaataaagatattaggctgacccatctgaaattgcaatttttgtaggttaaaaactgttaacatattgacagtatcaaacctaaaaaagaaactgtagctctcattttaataatttttcctttacatttgcatttaacattgcagaaccttttgatggaacaaatacagccagagcagtgcacgaaaagcagaaatttgatatgatcaaggatcaatttttaaaggtaaacaatgcattagatcaaccctagaaacattagtagactagtatgctttaaacaggaaaaaatacgtgtgtagtaggacagaatggtttctcttctgtgaatccattaatatagcatgatagagaacttattatttgaatttagttaaacttttccttcaaagagatctggctctgtttttattcacattgctttcactttcatagaaataagcattttctcttttctttttgagacggagtttcactcttgttgcccaggctggagtgtagtggcacagtctcagctcactgcatccttcacctcccaggttcaagggattctcctgcctcagcctcccagatagcttggattacagacgagtgccaccacacccagctaatttttttttttttttttttgtagagacagggtttcaccatgttggtcaggctggtctcaaactcctgacttcaggtgattcacccccgtcttcctcccaaagtgctggtattacaggcatgagccaccatgccctaccgaaataagcattttcgtagtgagcttattaaatttccaaaataagtgaataaaacctaatggactcttttccttccttagtgtattggggaatttattgtggccttagaaggaagctgatgtctgatccatgctttttctaatgtataccccactgtcacaggaattagagtgctgttttatctttgtttatatttaggaaagttaaaatttatgtatatgtctgtgtttatagtatgaatttattcatcagtgatgttgctagatgtggtcttaatcttcagggacttcacaacacattgtagaaatgccttgatatatgtattgagacatggaggggagggaaagctttgtagaagaaaaagatgagagaaccgcaaagatcattttagaggcatactttttcattatctagacattcaagtggactttattttaatgataatttaaaatgcaagtattgaggcatgagtatcactggaaccaggagttcgaggctgcagtgggctattatcaagttgctgcacttcaagcctagacaacagagtgagagactccacctctaaaaaaaaaatgaataaaaataatggccaggtgcaatggttcacacctgtaatccaaacactttgtgaggccaaggcaggaggattgcttgaggccaggagtttaagaccagcctgggcaacgcatagcaagacatagttcacacacacacatgcacgcacatgctcacacacacacacacacacacacacacaccccacctcacctcaccccacccctgggtgtagtggtatgcacctgtgtcttagctactggggaggctgagtggagagaaaagccttgagcccaggaggttgagggtgcagtgagctgtgattgtgccaccgcactccagcctgagcatgagtaatagagtgataccttgtttcaaataaataaataaatagataaaatataagtattctattacaagctgtcgttcaaatgagactttcttaatttggcaaccagaatagaaaatttgtcttatagaaattctttaattttggccgggcgcggtggctcacgcctgtaatcccagcactttgggaggccgaggcgggcggatcacgaggtcaggagatcgagaccatcccggctaaaacggtgaaaccccgtttctactaaaaaaaaaatacaaaaaattagccgggtgtagtggcgggcgcctgtagtcccagctacttgggaggctgagggaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaattctttaattttaaaacaaatattcaagagagaatatttttgtttatcagattaaattgagaactcaaaattagcaatgctacattggtgttcttattgatgagtgagctttcatttaggattgtttagttgtaaaaccaatacttttagacaatcgaataactgacatgagactagaatacaaagatctgcagtcaccaagtagtgagacagatttttagcttgtgaacaagtttcttttcttctccttatcaattcaaatcaccatttgaattttccagaggcatacataaagtgccttattgtaaatttactctctccttcataaatactatatatttttttgagacagggtcttgctctgttacccagactcaggcagcctcaatctcctgcgctcaatgatcctcccacctcagcctcctgagtgctgggactataggcgtgtgccaccatacccagccaatttttgtattttttgtacagacagggtttcaccatgttgcccaggctggccttcagctcctgagctcaagtgatctgcccacctcagcctcccagaattctggaattataggcatgagacactatacccagtctcataattattgtttttaatgcaaaaagctagtaaagatgtaagacagtcaatcaaataattgaaataatcctctcttctcaaatccaaaggttttgtcttaattaccttgctacttttagattgaattaatccgtgaataaatattaatattgtcagttgtatctttcagtaccacctatgtgcccatttctttattaatgaattggaaccataaaaatatggagtttttaaataacattttcttttctgatgacagaaacaatacttacactgtgttaaaaacttggaaaataaaaacttagccagcctgggcaatacaatgagaccttgtctctacaaaaaaatttaaaaatagctgagcgtgatggcatacgcctgtagtcccagctactcaggaggcagaggtgggaggatctcttgagcctggaaagcggaggttgtagtgagccgagattgcaccactgcactccagcttgggtggcagagtgagaccttatctcaaaaaaagaaaaaatttgaaggaaaaaattattcaaaatttatcacctagagagaaccaactattaacattcttttaaactctcagtcttttgttctgcataaattttaggttttaagaatgatttttctttctctcccagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggaca

SEQ ID NO: 6694 - DNA, 4682 bp, Homo sapiens
catttaacattgcagaaccttttgatggaacaaatacagccagagcagtgcacgaaaagcagaaatttgatatgatcaaggatcaatttttaaaggtaaacaatgcattagatcaaccctagaaacattagtagactagtatgctttaaacaggaaaaaatacgtgtgtagtaggacagaatggtttctcttctgtgaatccattaatatagcatgatagagaacttattatttgaatttagttaaacttttccttcaaagagatctggctctgtttttattcacattgctttcactttcatagaaataagcattttctcttttctttttgagacggagtttcactcttgttgcccaggctggagtgtagtggcacagtctcagctcactgcatccttcacctcccaggttcaagggattctcctgcctcagcctcccagatagcttggattacagacgagtgccaccacacccagctaatttttttttttttttttttgtagagacagggtttcaccatgttggtcaggctggtctcaaactcctgacttcaggtgattcacccccgtcttcctcccaaagtgctggtattacaggcatgagccaccatgccctaccgaaataagcattttcgtagtgagcttattaaatttccaaaataagtgaataaaacctaatggactcttttccttccttagtgtattggggaatttattgtggccttagaaggaagctgatgtctgatccatgctttttctaatgtataccccactgtcacaggaattagagtgctgttttatctttgtttatatttaggaaagttaaaatttatgtatatgtctgtgtttatagtatgaatttattcatcagtgatgttgctagatgtggtcttaatcttcagggacttcacaacacattgtagaaatgccttgatatatgtattgagacatggaggggagggaaagctttgtagaagaaaaagatgagagaaccgcaaagatcattttagaggcatactttttcattatctagacattcaagtggactttattttaatgataatttaaaatgcaagtattgaggcatgagtatcactggaaccaggagttcgaggctgcagtgggctattatcaagttgctgcacttcaagcctagacaacagagtgagagactccacctctaaaaaaaaaatgaataaaaataatggccaggtgcaatggttcacacctgtaatccaaacactttgtgaggccaaggcaggaggattgcttgaggccaggagtttaagaccagcctgggctacgcatagcaagacatagttcacacacacacatgcacgcacatgctcacacacacacacacacacacacacacaccccacctcacctcaccccacccctgggtgtagtggtatgcacctgtgtcttagctactggggaggctgagtggagagaaaagccttgagcccaggaggttgagggtgcagtgagctgtgattgtgccaccgcactccagcctgagcatgagtaatagagtgataccttgtttcaaataaataaataaatagataaaatataagtattctattacaagctgtcgttcaaatgagactttcttaatttggcaaccagaatagaaaatttgtcttatagaaattctttaattttggccgggcgcggtggctcacgcctgtaatcccagcactttgggaggccgaggcgggcggatcacgaggtcaggagatcgagaccatcccggctaaaacggtgaaaccccgtttctactaaaaaaaaaatacaaaaaattagccgggtgtagtggcgggcgcctgtagtcccagctacttgggaggctgagggaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaattctttaattttaaaacaaatattcaagagagaatatttttgtttatcagattaaattgagaactcaaaattagcaatgctacattggtgttcttattgatgagtgagctttcatttaggattgtttagttgtaaaaccaatacttttagacaatcgaataactgacatgagactagaatacaaagatctgcagtcaccaagtagtgagacagatttttagcttgtgaacaagtttcttttcttctccttatcaattcaaatcaccatttgaattttccagaggcatacataaagtgccttattgtaaatttactctctccttcataaatactatatatttttttgagacagggtcttgctctgttacccagactcaggcagcctcaatctcctgcgctcaatgatcctcccacctcagcctcctgagtgctgggactataggcgtgtgccaccatacccagccaatttttgtattttttgtacagacagggtttcaccatgttgcccaggctggccttcagctcctgagctcaagtgatctgcccacctcagcctcccagaattctggaattataggcatgagacactatacccagtctcataattattgtttttaatgcaaaaagctagtaaagatgtaagacagtcaatcaaataattgaaataatcctctcttctcaaatccaaaggttttgtcttaattaccttgctacttttagattgaattaatccgtgaataaatattaatattgtcagttgtatctttcagtaccacctatgtgcccatttctttattaatgaattggaaccataaaaatatggagtttttaaataacattttcttttctgatgacagaaacaatacttacactgtgttaaaaacttggaaaataaaaacttagccagcctgggcaatacaatgagaccttgtctctacaaaaaaatttaaaaatagctgagcgtgatggcatacgcctgtagtcccagctactcaggaggcagaggtgggaggatctcttgagcctggaaagcggaggttgtagtgagccgagattgcaccactgcactccagcttgggtggcagagtgagaccttatctcaaaaaaagaaaaaatttgaaggaaaaaattattcaaaatttatcacctagagagaaccaactattaacattcttttaaactctcagtcttttgttctgcataaattttaggttttaagaatgatttttctttctctcccagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgtt

SEQ ID NO: 6695 - DNA, 651 bp, Homo sapiens
gaaattatgcacacataactggccaaatatcagataagtgaactgttaatatatgagagaattttctggacttttaagttattaatctcaattatttgtgtggtgagtactaaattattttctgtttgtgttgatctgtccatttctgtatatagttgtccctcagtatattgagggattgattccaggtcaaccccgtcctcttcagataccaaaatccacagatactcaagtcccttatataaaatggtgtagtgtttgcatatatcctacacacattctcttgatactttaaatcatctctaaattacctgatacgtaatacaatgtaaatgctatgtaaatagttgttatactgtattgtttagggaataataatgacaagacaaaaagtctatacctgttcggtacagatgcaaccattctgcctcctccctaccccctcccaaatatttttcatcctggttgaattcacaaatcctacatggttacggagggttgactgtatttgcatatgttgttaaagtggtgtttaaaatgtgcaatctgtactacaattctaaattttggattgatttgaactaggatctttgcaaataaatctcatagacattaatgtttgtaagaaatttttaattaaatgatggaagg

SEQ ID NO: 6696 - DNA, 807 bp, Homo sapiens
gaaattatgcacacataactggccaaatatcagataagtgaactgttaatatatgagagaattttctggacttttaagttattaatctcaattatttgtgtggtgagtactaaattattttctgtttgtgttgatctgtccatttctgtatatagttgtccctcagtatattgagggattgattccaggtcaaccccgtcctcttcagataccaaaatccacagatactcaagtcccttatataaaatggtgtagtgtttgcatatatcctacacacattctcttgatactttaaatcatctctaaattacctgatacgtaatacaatgtaaatgctatgtaaatagttgttatactgtattgtttagggaataataatgacaagacaaaaagtctatacctgttcggtacagatgcaaccattctgcctcctccctaccccctcccaaatatttttcatcctggttgaattcacaaatcctacatggttacggagggttgactgtatttgcatatgttgttaaagtggtgtttaaaatgtgcaatctgtactacaattctaaattttggattgatttgaactaggatctttgcaaataaatctcatagacattaatgtttgtaagaaatttttaattaaatgatggaaggaacatagaatggctacctgtgattttgattagtgtttaacagattgccacagctgtgattgaattccttttgtactggatgagcatggtcatttgggattactgatggtgaagtctagctggtgttaagagaataaatattgctgatgctaaacct

SEQ ID NO: 6697 - DNA, 12604 bp, Homo sapiens
agtttgaacaactgactcttgatggacacaaccttccttctctcgtctgtgtgataacaggtaccgcctaggaccctgggtgtctgattggttgggggatggcggagggggaggggcacgcagcctttaccctgtgcttcccacgatcttgtctccttaatcttcactgcagctctctgccatagggtcttatactgcttgacatgggggaaactgaggctcagaggatttcacagcagggcagggagcccagatttgaatctgtagataccaaactttctactttttcagtagtttccaagcatcttttttttgttgttgttacatcattggtgtcttttttcttttttttttttgagacagagtctctgtcgcccaggctggggtgcactggtgtgatctgggctcactgcaacctccgcctctcacattcaagcaattctcatgccttagcctcccgagtagctgggactacaggggcccaccacacccagctaatttttgtatttttagtacaaacagggtttcatcatgttggccaggctggtcttgaactcctgacctcaggtgatccacccaccttggcctcccaatatgctcgaattataggcacgaaccactgtgcctggccatgtcattggtgccttaaccaagcctcttttaatttttcaaacggaagaacccctgtcccacagttactgctgctgagccctttcaaggtgactctgaggacggagaaaagcggaagtggtgtgggaagaggcggggtctgggccagctgctggtcctgctctcctccctcctctggccactaggctcccaggagtggtttggagcccacgccatgtgctctgggggctgtggcagggcaggggcggtttggaacctgcgccatgtgctctgggggctgtggcagggcagggggagtcctcgtgtcccctgtgcacaacacagacagaaggctgggtccacccagtgggcggtcgactgccaggccagtgcttaccccgccatgtttgcagcccgaggccagctggctgcaaatgcagggctgtgcgtcaggggtcagagtgcacacacccctgcaggtctaggggctcctgcgttgcttctggaagggcctggatgggacctgactggagcggccgaggggtggagcttctgggaaagggatccctcctcggggggagtgtcttgggcctgaggccaattggcagggacagagacgagtccatggcagtatctgctcttctctgtgaaggcaaagggcctccgagggagtattacagccgcctcatccaccagaagcatttccagcacatccaggtctgcaccccttggctggaggccgaggactacccccgcttctaggtgagaggccagcaggaggctcagggaggaggcggggccttaagcagggggaacaggggtgggcgggatgtactttttctgaaaatgtggctctggaggccacttggggacaggacctgggctctggctgaactcccgggaggaggctacttcctggtgtgccagcccctccctgccaggtggccccagaggccctttaccaaggggtttgaggaggccacgtcctttcagccttccgcgccctccattcagtcctcttccttcctgcaggagggctgggcctggggttggggccactgttgcccaggtgtgggagggcagtggctttgggaggtacagggacgatgtgtgaaacagcgtcgcctctcccagtgagatggttctcctttgcctccgtctctttccccgttgacttctccaagtggggagtcgtggcttggtcctgatgcgtctctagagccacatcttccagcttcgagtgagcagagcagttggaggctgagggccttttcctggcaggactctccagttagtctttgttttagacagtctcgctccgttgcctaggctggagtgcacgatctcagttcatgcaacctccgcctcctgggttcaagcgattctcccacctcagcctcccgagtagattacgggattacaggagcccgccacaacacctggtttatttttgtatttttagtagaaacagggtttcaccgtgttggccaggctggtcttgaactcctgacttcaagtgatcctcctgccttggcctccctaagtgctgggattccaggcgtgacccatcacgcctggccccagctagtctttagaaatgttaagctgtttcactttattttcacactgacagctggtttgtagtgggtgtgctgtggttttttattattattattattattattattattattttgagacagagtttcgctcttgtagcccaggctggggtgcaatggcacgatcttggctcactgcaacctccgccttcccaggttcaagcaattctcctgcctcagcctcctgagtagctgggattacaggcacctgccacgatgcttcgctaattttgtattttttttagtagagatggggtttcaccatgttggccaggctggtcttgaactcctgacctcaggtgttccacccaccttggcctcacaaaatgctgggcttacatgcgggaggtgaacctgggaggtggaggttgcagtgagctgagattgtgccactgcactccagcctgggtgacggagtgagactctgtctcaaaacaaaacaaaacaacaacaaaaaaaccaaattgtggttacgtagaaaaagtgtcaacttacattttcagatgtcccagccaggccatgtggctgcttggccagcttaagccacttgtgcttggggctgtcgggggacttatccgattttcactcccctcgggggatgttgcctcactgtgctgggaggatttgtgttcccagggcagagaccagcgctctgaccgcacccctcttgcccagcagggtcggtggatctgggtgtctgtctgcacacgtcctgcagtggcctggacctgcccatgaaggtggtggacatgttcgggtgctgtttgcctgtgtgtgccgtgaacttcaagtggcaggagcagaacccgaatctttctggggatagcttcacagatccaccgctgaggaggaaacagtgcagagcgagctgcccacagtgaggccctgctcctgggtcagtccagcacacactggaggccacgaggaggagcctgcggttactgtgtctgggctgagcctcactgaagtagttgcttccatttagagctcatgttatatttaggttgatacaaaagtaatcacggtttttgccattaaagatggcaattacttttgcaccaacctaatatgaaaaaaaagcatcttaaatactggaactccactcggggcttttgctcctagagtagaattggcgggaattgcctgcaggcttacatggttttctttgtttctttctctcccaccatgtcctgtttggccaagctcacgtgctgggtttgaatgagttaaatgagtgtcgtgctgtggcctcactgcacccagcgtagacgggcatttggaagggcggtgttagaggagattctagaagcagtagccccagcacaagctgagcccttggcccctgctcaggagccggctcctggatgggagtcagggatgtgagcccctcgtgtgagctgagctcagggaatgtcgggatcaaacctggtgccctagaaaagtcatcttttatgtgctgagccagtccccagggtgttgcctttacttgttccatggccatggaattaagcaaaacatgcaaaaataattcttcagtccttgaagagcatccagcacagaaggtagaaaccctccttaaggctccctcctcaaatcggtttggccatttcgatgtgcacccccccaggcctttatacccttcagatgccaaatctaagaaccagctcccagaaaccacaccccctgttccaacccccagcctggcttgagcatgggttgttggggggagcccaggtgggcaccccaggggtctggtgtcttctccaggcagctctcaggctcccttggttctctctgcagtttacatgagctggtgaaacatgaagaaaatggcctggtctttgaggactcagaggaactggcagctcagctgcaggtagccacatctgccaccacgccagggtggggagggttctggaggctggcaccgagccacgctccctgatccctgcttcccacagccagggtgggaccatgtggggtctggcggaaaagctagggagggagcagaggtcacagagtccggcccactctgctgtcccgtttcggtacagtaagctcgggaaagttaggacacacccccacctgccctctggatttatggagctgacattccacaaatgatgctggagccgggtgggccgggctgcagtttaggaagtgatcagggtcaggtaggtgcgtgggcaaagggagcttctgggaccagccttgaaagatgggtggaattctgcaaaggttacttgtttcttattgctaaaagtaatacatcattcttgccaacagaatgattggcaggattttcagtaaaggtccaggtcagaagtcatttagactgggtcccccagtctctgtcagaaccatggtactctgttgtggtgtgaaagtagccacagatcatctgtcgattaaggggtgtggctttgttcgaataaaactttatttacaaacacaggctgtgggctggatttggcctgcaggctgtagtttgtgatccttgattcagacagtttagcaaggctgaaaagaacaccgacacccccttgttacccacagatgggtgggacttggccggaggccaagaggagggtgctcgcaggggaacatacagcatgtagaggccaggaggtgctccagggcaccaagtgtgggaaagtgggacatacggggaagtttccagaaagcatgatgtcaagttggaggcagagcgctgctggggcatgaagagtctcgagtccaagtgagggagttaggaacttgggaggggttgttgttgggtaggggacctggggtcagccaggtggtgacatgggatggggtggggacaggcaatgaggtaagctctgctctttatttttttgcaggtgcttttctcaaactttcctgatcctgcgggcaagctaaaccagttccggaagaacctgcgggagtcgcagcagctccgatgggattagagctgggtgcagactgtgctccctttggttatggacacataactcctgggccagaggctaaaaccccgggacccctgctgtccttcccacagcttcttctcagagtctcagggcaaatcctttcgagcagcgcctcccagtggccagaagctgaaatgatggcagtagtgccacctggtgaatgaattggttctgtgacccgggaagctgtgcttggctctgatttcttttctggaggctcggaaacacttcctctcttcttctgttcttcacgccccatgcccctgctagcgtattactgttctgtgacttccctgtgacctctgcagtactcctcatcctgcgtttggtctccaggtgtcacctttctgccgtgttcctaacattttgattcctgtcttgaaaaaagcacctgctgcaccataagcccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtgacagctgcagcgggcttggctttgtgaagaaccgagtgtgtccaccgatgtggcagctgcagcgggcttggctttgtgaggaaccgagtgtgtccagggatgtggcagctgcagcgggcttggctttgtgaggaaccgagtgtgtccagggatgtggcagctgcagcgggcttggctttgtgaagaaccgagtgtgtccagggatgtggcagctgcagcgggcttggctttgtgaagaaccgagtgtgtccagggatgtggcagctgcagtgggcttggctttgtgaggaatcgagtgtgtccaccgatgtggcagctgcagcgggcttggctttgtgaagaaccgagtgtgtccaccgatgtggcagctgcagcgggcttggctttgtgaggaaccgagtgtgtccagggatgtggcagctgcagtgggcttggctttgtgaggaaccgagtgtgtccagggatgtggcagctgcagcgggcttggctttgtgaggaaccgagtgtgtccaccgatgtggcagctgcagcgggcttggctttgtgaggaaccgagtgtgtccacagatgtggcagctgcagcgggcttggctttgtgaggaaccgagtgtgtccacgttggggggaacatcatacttgatacacacgtttttatttgcacaaagaaaatgctatttttggagccagagttttcatgtctgattgatggcgattttcttaagaaccagaactgctggcagaaagggagcacccacaagcttagatagccgatgtcttatcagagggcagtttgtggttcctgatttggaaattaacattctccaaacattccagtccaatgaaagttttatccgctttcccatataaaaactcttcccacgagagtgacttgattctcacaatcccgttggagtcgtgtgtgagtcctacagtgtgaggttcagcattgccatctccaagtgctcttcgtagggaaacagtttctggtcatgacgaggttccacttcccatctgatcccggcccggcctggaaacagaggacatgtgtttgaagatggcagtgtttggggacaggacatgagcgtattgtgtggggctgctaggacaggcctggcggggtgggggcgtgtacaagtcagtttacttggttcacaggttctcaggcccacccaggtgcctagaattggcctccaggatgggaccagaaatctggttttgcatagaaatggctagcagcaggcaccgtgccgctgtccagtctctgcccgcgtctgcccagcacttggcacagcgggacagacgcagagatctgaacccacacttacctggctgctcagtcaactcactcttcacaaagcttagaaagcggccaggcacagtggttcacgcctgtaatcccaacactttgggaggccggccaaggcgggtggatcacttgagatcaggagttcgagaccagcctggccaacatggtgaaaccccatctctacaaaaatacaaaaattaggcaggcacaatggcgggtgcctgtaatcccagctacttgggaggctgaggcaggagaattgcttgaacccaggaggcagaggttgcagtgagcagagattgcgccactgcactcgagcctgagtgacagagtgagactccatctcaaaaaaaaaaaacaaaatcacacacacacacacacacacacacacacacacacacacacagcttagaaggggctggtgttctcataagcaaagatgtctgaagagccgttagccagaatgattcttttcttttttttttttttttgagatacgatcttgttctgtcactcaggctggagtgcagtggcacagtcattgctcactacagcctcgactcctgggctctagcaatcctcccacttcctgagtagctgggatgacaggtgcatgccaccatgctagtaatttttttattttgtagagatggggtcctgaatgcatggcctcaagtgatgctcctgcctcagactcttttattattttttttttagacagagttttactctgttcccaaggctggagtgcagtggtgcaatctcagctcactgcaatgcatcccaggttcaagtgattctcctgcctcagtctcccgagtagctgggattataggcgtgcaccgccacgcgtggctaatttttgtgtttttagtagagatggggtttcaccgtgttggccaggctggtcttgaactcttgacctcaagtgatccgctcacctcagcctcccaaatcctctgcctcttacagtgttgggattacaggcgtgagacactgtgacacgggatgattttcaatcacagtttttagttacgagtggaaaatgtgtatttataaaaataaagtagtacagacatgaacgtgtagaagtctctataatcctgccatccaaggatggcacctgttaatgtgtatatcagggatgtccaatcttttggcctccctgcaccacattggaagaagaagaatcgccttgggccacacataaaatacactaatgctcgcaatagctgatgagctaaaagaaaaaaaaatcacaaaaaaacctcgtactgttttaagaaagtttacagatttgtgttgggccacagattggacgagcctgctacatatatattctaggttttccccaataggtatacttatgtgaaaatgattattgtgatactttttttttgagatgaagtcttgctatgttgctcaagggggccacaaactcctgggcttaagccatcctcctgcctcagcctcccgagtagctgggactacaggtgtgcgcaaccatgcccggctagtttctgaatgttttgtggagatggggtcccactatgttgcccaggttggtcttgaaatcgtggtgtcaagaagtccccctgccttagcctcctaaagtgctgggttgacaggcctgagccccgcgcccggccagcctcctgtgcgaggttgtgcaggactttgtcgtggaacccagtatgccttcgtgtgctggcttgtttgttggctctgtagttaacgcgctgccccacgtggacaggcattggacccacgtctctgtgtgcaggcagaggctgctgcgcgtgcatctgtgcacatggctgccaggaggggctgtgctcagggtgatctggggcaaaggctggtggcaatggggggcttgggtgtagtgtggaggcacgagagccaggtggccgagctgcagtctgtgggagctcaggggttgcttggcctctgtgtgtcctagtgtctttgtcggtgagatgggacaatgatagcacactctcacaggtgctgggggctgacaaatgtcaggtctgaggacagtggctggcccactacggggacaattccccttctctatagtcaccctgctcgtcttccatcaactgggtgctcaggacagtggcgtggtggatccgcctgtacagcctgtgctccagcgtcctgcaggccacagctgtgtccagccctgaccccgactgcccctcccaccacctccattttatagatgaggaaaccgacgcccaagggcttagggaaccctgctctgaagcacacagtagggctgctgggctcagatcctccctccctgtgctgagctgccctcctcctgccgcaagctcccacgccccaggcccaccctgctcaccggcctctgccctagttccccgcatggtgtgggagtgtggggcatcctagcttttcctcggcccccagttctttcacttccactggagtcccgcagggacagctcggggaccatgcaggcccgggtgggcgtgtgggctcacatagctcggtggtgaacagctggcacgtctctgggttgcggacgataagggccacgtagacttgaggagcccgctggtgctcccggtaggcagccagcctccgcaggaccgcgaccagcgacacgatggattctgggcaatacagcacgtctacggtgaaagcttcaggttactgaaagggaccagcggacagttccaggtcatgctgacctcagcagcagggcgaggccagagaggcagcagtcatatgagactagtagatgccatttgaccatttgggccattagatggaaaggcaattgcttgggtgaaaaaggagaacccttagtagagaaagctgcaaaagaccgaagcaaaagaaaaaaatctccagactcactggtgttccttaaaaaatgagctctggttctcggcctatctagagggctgtgaatgacacaaagcctgaccctgccatgaacttcgtgtttcaggtgtctgccgatttgtctgctggcttgcaggggtgggcctgtgtccctggccaccgctggacctgtgggtttcagggctgggacccaggaccacaggcagagctctgttcaaccagagaggagaccgagtgtgctggcaggggcgaggggttttcggtggcccagccaaacaccaccttctctcaagggccctgtcctcatcccagaagtggttgttttcctcctgtggtctctgaaagacagaggcatggctctgggacagagccatgtggtgatgactgtaatgggagtatgcctgtctccaacaagagggctgtggctggaaggtcaccttaagaggcacccctgtcctttgatgtcaccctggaggcccagagtaactcttctggaagccccatcatgtccatgcccgacagcgtccattgttcccttttcccagagcccagagctgggtagagctgcaaggacaccgcctgcacagagtgcccggggctgggcattgcctgctgcaatgacaacatctggctggatggcagagagctgatggaccgtcgcgacgtcccagtccagctgggccactgtcaccctggggctgtctaagttggcagagatgtctgcctctaatgagaggccattgagaaggacattccctcggagcttctcgaggacctggctgtgacagtcgctgaagatgtatgcctggaggcggcacatcttgcagatggccaggcctgtgaggctggcgccactgccaagctctaggacagtcctggcgggaggaaaggggaccatgtctgtaactgcaccagggtgagcctgcctcggtgtcctgccgtgcgccccgaggtcacctatgagagaaggctgccgggttctcgatggcccattctgccaggtagagggcagcatctcatgtgaccaggcctgtgatgccatgggagatgatggctgtgctctcggagagtgtgactgagcctcccgagggctgcaccaagagagggcgagagagtcagtccagcaatcagaaggcaagtggcttagaagacaagtagccatccaccacatggctgaataaaccatgacaggaccaatcgccactcagcaatgagaagcagctaactgttgacatgccaacagcttgcacgggcctcaagggtgtcacgtggcatgaaagacactcatctcaggccacacaggattccattcatcgaacattcctgagacaacggaattctggtgatggagcacaggtcagtggtggccaggggccaggtgtggctatgaaggggtggctgccttgtgatgattcaatatgctatgtttttcctttgtggttttctgtatctatgttttatcttattttcttttgagctctgtcacccaggctggagtcagtggcacaatcttggctcactgcaacctctgcctcctgggttcaagcaattctcctgcctcagctgcccaagtaggtgcaactacaggcatgtgccaccatgtgtggctaatttttccacttttttttgagacagagtttccctctcgttgcccaggcaggagtgcaatggcgtgatcttggctcactacaacctccacctcctgggttcaagagattctcctgcctcagcctcccgagtagctgggattagaggcacctactaccacacccgctaatttttgtatttttagtaaagacagagtttcaccatgttggccaggctggtctcaaactcctgacctcaggtcatccacctgcctcagcctcccaaagtgctgggattacaggcatgagccaccacgcccggcctgatttttgtatttttagtagagacagggtttcaccatattggccaggctgctcttgaactcctgacctcggatccacccacctcagcctcccaaagtgctgggattacaggtgtgaaccaccacaccaggacctgtcaagtattctttgaggactggacaccaggtccttgtgaagcaggtagagtgtgtcacctattggacaaatgcccaacaaccccatgagacatgctgttgttgttgaagtgcttgatttacagacagggaaactgaggctaaagaaggttgacggacctcatgtctaagactgcagaatgggtgagtcaggatttgaacccacacccacgttttcactttgtgcaggaagggtatctgggctgtgagggggaggagggtgcccttctcataccagcaaatagctcgggtggccctgggtggactccttggccatcagggtctctgccaggtcctcgtacagcttgtccaaaagctctgtgtggacagcctcgtgctggggtcagacagagtgagagcttgtttgctttcgttctaatctgtaaaaatggtcagatgattttcaccaagtttggaggggagatttgggatggaatggtgtaataccagccagctggcatgtaaaatattcacttcattgggcatggtggtgtgtgccgaatagtccc

SEQ ID NO: 6698 - DNA, 2977 bp, Homo sapiens
tttgccattaaaggtggcaattacttctgcaccaacctagtatgaaagaaaagcatcccaaatactagaactccactcggggcttttgctcctagagtagaattggcgggaattgcctgcaggcttacatggttttctttgtttctttctctcccaccatgtcccttttggccaagctcacctggtgggtttgaatcagttaaacgattgtcatgctgtggcctcactccacccagcatagatggctgtttggaagggcggcgttagaggagattctagaagcagtagccccagcacaagctgagcccttggcccctgctcaggagctggctcctggatgggattcagggatgtgagcccctcatgtgaactgagctcaggaaatgtcgggatcaaacctggtgccctagaaaagtcatcttttatgtgctgagccagtccccagggtgttgtctttacttgttccatggccatggaattaagaaaaacatgcaaaaataattcttcagtccttgaagagcatccagcacagaaggtacaaaccctccttaaggctccctcctcaaatcagtttgtccattttgatgtgcacccccccaggcctttatacccttcagatgccaagtctaagaaccagctcctggaaaccacaccccctgttccaacccccagactggcttgagcatgcggtggtggggggagcccaggtgggcaccccaggggtctggtgtcttctccaggcagctctcaggctcccttggttctctctgcagtttacatgagctggtgaaacatgaagaaaatggcctggtctttgaggactcagaggaactggcagctctgcaggtagccacatctgccaccacgccagggtggggagggttctggagactggcactgagccacactccctgatccctgcttcccacagccagggtgggaccatgtgggatctggcggaaaagctagggagggagcagaggtcacagaggccggcccactctgctgtcccgtttcggtacagtaggctcgggaaagttaggacacacccccacctgccctctggatttatggagctgagactccacaaatgatgctggagccaggtgggccgggctgcagtttaggaagtgatcaggatcaggtaggtgggcgggcaaagggagcttctgggaccagccttgaaagatgggtggaattctgcaaaggttacttgtttcttattgctaaaagtaatacatcattcttgccaacagaatgattggcaggattttcagtaaaggtccaggtcagaagtcatttagactgggtcccccagtctctgtcagaaccatggtactctgttgtggtgtgaaagtagccacagatcatctgtagattaaggggtgtggctttgttccaataaaactttatttacaaacacaggctgtgggctggatttggcctgcaggctgtagtttgtgatccttgattcagagagtttagcaaggctgaaaagaacaccgacacccccttgttacccacagatgggtgggacttggccagaggccaagaggagggtgctcgcaggggaacatacagcacgttagaggccgggaggtgctccagggcaccaagtgtgggaaagtgggacatacggggaagtttccagaaagcatgatgtcaagttggaggcggagcgctgctggggcgtgaagagtctcgagtccaagtgagagagttaggaacttgggaggggttgttgttgggtcggggacctggggtcagccaggtggtgacctgggatggggtggggacaggcaatgaggtaagctctgctctttatttttttgcagatgcttttctcaaactttcctgatcctgcaggcaagctaaaccagttttggaagaacctgcgggagtcgcagcagctccgatgggatgagagctgggtgcagactgtgctccctttggttatggacatacaactcctgggccagaggctaaaaccccgggacccctgctgtccttcccgcagcttcttctcggagtctcagggcaaacccttttgagcagcgcctcccagtggccagaagctgaaatgacggcagtggtgccgcctggtgaatgaattggttctgtgacccgggaagctgtgcttggctctgatttcttttccggaggctcggaaacacttcctctcttcttctgttcttcatgccccatgcccctgctagcgtattactgttctgtgacttccctgtgacctctgcagtactccttatcctgcgtttggtctccaggtgtcacctttctgccgtgttcctaacattttgattcctgtcttgaaaaaagcacctgctgcatcgtaagcccagggatgtggcagctgcagcgggcttggctttgtgaagaactgagtgtgtccgcggatgtggcagctgcagcagtcttggctttgtgaggaaccaagtgtgtccagggatgtggcagctgcagcaggcttggctttgtgaggaaccgagtgtgtccacatacttgatacacacgtttttatttgcacaaagaaaatgctatttttggagccagagttttcatgtctgagtgatggcgatttccttaagaaccagaactgttggcagaaagggagcacccacacgcttagatagccgatgtcttattagagggcagtttgtagttcctgatttggaaattaacattctccaaacattccagtccagtgaaagttttatcagctttcccatatgaaacctcttcccttgagagtgacttgattctcacaatcccattggagtcgtgtgtgagtcctacagtgtgaggttcagcattgccatctccaagtgctcttcatagggaaacagtttctggtcatgacgaggttccacttcccatctgatcctggcctggcctggaaacagagcacatgtgtttcaggatggcagtgtttggggacaggacatgagcgtattgtgtgggg

SEQ ID NO: 6699 - DNA, 14129 bp, Homo sapiens
gcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcagtgagtggccaagggtctgggagggacgatgctctctcagccgttgatcctcggttctaaccgccccggggagtcgaggcggaagtgctcctttagtcgccgcctttgggcagctctccgagattagacgagcggttctgccccagcctttcctgggtgggtctctaggtatagccggcgttaatcttgccacgtgtcagaagtgtgttaagtgaatccattgcgtggtctcacgtaattctcctagtaagtggaacccaggtgcgtggaactccagggctagtgctggtagctacgtccctgtgcagctacccttgtcaggctatgtctgagctgacaggatatttcattcctcatccctcaacgcagagctctgcagacagatgttttcatttgttcttcatgtccagcttttccccacagtgtgcagggcagcggtgtctgctccctcattattctccacgttggtatcttgagagggtagctcaaccccatctcaggaagaagtgggaacagcactagttgcctttaatccctgtttagaatctgctatcctagggtgatggggtagagtgggacttcctagggatggctctgtggtgggaaaattccactatccagacaatctagattagtttaattgagcacctactgtttgccaggcatcatgttaagtgaaggtaggtaagattcaggccctatctctgtgtgcctcctagagcaatctgaacaagaattggccgcattctctgttctggctagtgaggagcagagagaggttttgaaatatcttactttccaaaacactgtccgtgattcagcctgagttgggagattatctgactttagattgctgcttctggtacattaaagggatcattctcatttttcagactccaaaccccatgatgagctcttgcagaacaacagaattcagattgtggggttgacagaacttcagagtcttgcaggtaggatgccgtcaactccagaatcctctgaatccatgggctgggggcagggggtgttcgtttgaaaagccgtgcagattgccagacgctcctttggtagtcacaggtgttttctgacttgcagttgggccccgagttttccagtacggagtcaaagttgtacttcaggctatgtacttgctgtggaagttgatgtggagggagccaggtgcctatatctttctccaggtgtgtatcagcctctgcctccctctgtgagagccatgttagcagtttactttccagcacaaattggtactatattgcatattcatatgtgtgtgtgttgtgtgtatgggcgtttaaagacatgagtaggagcctatggtatgtgtctatttatggcacctatccatgctctctgtgtcattacagatagtcttacattgtactgactgtgtatcaagtgttttccatgtattaactcatttagtcctcacagttaccctaagaaatattgcatgtaggtaatacaagaacctgtttcttaaggttgttctcatttagatgagaaaacctagactgagaaaggctctgtaagtagcccatcgccatacagctaggaagtggtggaatcaggatttgaacgtaggtcgtcagtgtggttctatagtatacacacgcacgcatacgcgcgcacacacaaacacacatatatttttttgagacagagtttcgctcttgccgcccaggctggagtgcagtggcgtgatctcggctcactgcaacctctgcctgccgggttcaagtgattctcctgcctcagcctcctgagtagctgggattacaggtgcccgccaccacgcccagctaatttttgtatttttagtagaaatggggttacgccatgttggccaggctgttctcgaactcctgacctcaggtaatccgcccccctcggcgtcccaaagtgctgggattacaggcgtgcgccaccgcgcctggcctatcgttatacttttaatcccttcccttgatcactttttctttaaaaaatttttctttcttttctagctgaaggaagaatacttttttttttaaatcaatttttaatatatagaagcaccttcctcttttatttatttatttttatttttcctgagatggagtctctgttgctcaggctggagtgcagtggtgcgatcttggctcactgcaccttctacctcccgtgttcaagtgattttcctgcctcagcctcctgagtagctgggattacaggcatgtgccaccatgcctggctaatttttgtaattttttttagtagagatggggtttcgctatgctggccaggatggtcttgaactcctgacctcaggtgatccacctgcctcggcctcccagattgctgggattacaggcatgaaccatcgtgacccacaccttcctcttttaataggcagccttgaattccaatatgtgatgtactatactgcatgtatttagtctcatgttaatggatactcagattcttcctgattttgtttttacttttacaaatagtgtggctccaagcacagcgagcatatgccttttgtataagtccagtttctttcttagggtaacttcccagcagtggaattgtgtagtcaaagttgatgcattttaaaaatgtgtatgttactggatagctttagagtaaggttgggtcagtttggcccccgctgagtgggggtacctcttctcccccatgcttaccatcaccagctgttgttagacctttttagaatttgcattccaacaggtgaaaaatgccatctctttgttctgttttttgcctccttgattattgatgatcttggacttttcaggttggttctgtttgtttgtttggtttttgtttgtttgttttagaggcagagtctagctctgtcgcccaggctggagtgcagtggcacaatcatagcttaactgcagcctcatcctcctgggctcaagtgatcctacctcctcagcctcctgagtagctggggctgcaggtgtgtcccaccacacctggctaatttttaaattttttgtagagatgaggtctcactgtgtttcctaggccggccttgaactcctgggctcaaatgatcctcctgccttggcctcccaaagtgttgggattacaggcatcagccaccgcacctggcccattctgtttcttttatgactttttacatctattttggtggtggagagggtctttcttctgcttattatcaagagctctgtaaagataacagactcatcaccatgtgtgttgtgactatttttactgggtttattgcctagcatggtctgggtttcctccccttcaagtctctatctttcctagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtgagagtctaggaagagggtaaaataccgtcccctaaaccactcaaggatgagtgagaagaagggccatagtgggcctccggaagtcggttccttgtgggctctgcaggaggtggggtgaggctggtgaatcaggccgaatgctggttccaaatgatagaaacaggcctcagcaaaggaccacattttttggcccatgaaatggaagtgtctgtggaaatggttggtttcgagctcagcagtgtcactgggacccagctcacgtctgtctccacactcccttctggtggtggttcccggaactctcctagctcttgtcctcacgtaggctcattggggagggcagccctttctgattggctcatgtaggttacctgccttcctctgatctgcctgttgaggccagggggcaagtgctccagcagaagagctgggtctcaggagcatccatatctcatggacagagggtgggtgagggcagatccccaaattaaaacccagggctgctgttggtagctggagaagtgggccacagttgctgcagctgatgtgacagggagggaagaagggccagtggtagcagtgggacgtggagctgggaaggtcatctgctgtcctctgagcccaactataacatctctgttatactctgcacggccagccttcaggtgcacatccagcctccgtgtgcatgtccagctgctgcgtgtacttccggccttgggccattggctggctgtggccttcgccctgatagtttgttcactggcagtggtgacagcagcagcaaacagcttagttgagcaaatggagcagaatggtcaatggtgagcacctgctgcatgccagtcctccatccaagccctttttgtattttaccctgttcaatctctatgcacctcaggagggtgtaccttttacaagtcaggaaactgaggctgagaacgattatgcctcttgccacacagctaagtgtgaggaccaaaatatcccaggcaagcccatttccgagctttctctgcatcttgagaggaacaggcgatgataccctggcggtgataaataacccagaatcgcgcatgccgtgttccggctctaccctgcgatcagggctcagtctccgttaggagagaatgtgtacaatgctcactgaatccctttgccccacgttgagagcaagccgtgaccttacagcctttgcagtggtagcacagggtggctgagatcgctagtgaggccttcattgtatttcttccttttttttttttttttttttttgagacagtctcactctatgtcccagactggagtgcaatggcgccatctcggctcactgcagcctccgccttctgggttcaagcaattctcctgcctcagcctcctgagtagctgggattataggcacccaccaccacgcctggctaatttttgtgtttttagtagagacagggtttcaccacgttggccaggctggtctcgaactcctgacctcaaacgatccacctcccaaagtgctgggattacaggcatgagccaccgcgcctggcctgtatttcttccttttacagcaagagagaggatgttcactttggcagtgatacacagtgtccttctatttatttttttaaatttgtatttatttatttatttatttgagacggagtcttgctttgttgcccaggctggagtgcagtttccttttaaagtgattgtatttaagccaacaagtgacacaacataaaggagggtatatacagcataaagaaagaacactggcacagctggggctcagggagctcaaactctcccagctctgcggccttttctctgttgagggatgtcgagtcacgctgtggtggtagcggaggcctgtctagggctctgctgactgctgatctctcttttcaggtacgagaagttctttgggcgcctgtcccacctgaacctgtgtgttaccaatgctatgcgagaagacctggcggataactggcacatcaggtaccatggcctgggatgacggcggcctgggagaggcgcggggcccctgattggctgcagtgagagctgccttgcctgctgccgtcctgctgaggggcaatttgaaatactgagggcctgggaggtggtctttggtttggggaagctgggggaggagggggcagagtttctttcttagccagccagggggtccaggcagttttggtcctaggacgtctctctgtgcattcccaagtaattgcaaggcttcttcttgtcatcatctgagacttggattccccaagcgtccttcttttcctggagcctctgagtcctctgttcctgaggcctttcttcagccctcccaatagccccgtcatgatttcattgcagggctgtgaccgtctacgacaagcccgcatctttctttaaagagacacctctggacctgcagcaccggctcttcatgaagctgggcagcatgcactctccgttcagggcccggtaggcctcccatcctcagctgccttctctcctgctcgccactgccctggcctctccccttctcactgcagacctgggaacccactcatccaggggttggcaaactaaggctacaggccagtctgctgcttttgtaaatcaagtttcactgggacacaacacactcattgccttctgagttgtctacagccgcctttgagctgcaatagcagaatcgcgttttgcaacagagaacctgtggcccgcaaagcctgaagtatttactctctggccctttaagaaatgtttgtggacccctgcgctgtcttactctcctgccagtggcttcccaggcctgtggcaggatctgtggacctgtgtgtcccctggggtgtctcatggggctaaggaggggacctttgtgcaggtctacgcaccctgaggtgtgccctgggtaagctggggtggtgtgggagggcgtccctgcaccctcatcttgagtccaggggatgataagacagtaagtcccgtggagaaaaggaatgagtcagtcttgtttgctgttgtaaccttagcacccagcaacaatattagagaaagcaagcccaggcctcagatggcaggggtggcctggtgctgctgatgtggctgggcaccccaacctctgggagcctgcaggcctcgccacggcaggagatgcctctcctgggtcccgggcctgctctatggcctctcacaggctttttttctgctccttcagctcagaacctgaggacccagtcacggagcggtcggccttcacggagcgggatgctgggagcgggctggtgacgcgtctccgtgagcggccagccctgctggtcagcagcacgagctggacaggtctgcaggacccctggggcacttggggttggtgtgacgggcacctggccaacctgtgttctcctcacccctgccagtcctgcatgctcccaccctgccacggtctcaatgagaacgggagggcctgtgagctggaagaggggtgtctagaaacaggcccctgacattcaattctcttctcatagaggacgaagacttctccatcctgctggcagctttagaaagtaggtgtgtggctgcggtgaggagctctgggcttgtcgggggccactgagctgtaagctgcttgcctggcctgcagcatgttcctgtcccaggccactgggtggggcagcctggggacagcgggggtggtggaagtgggccgccctgaatccccagttgggtcattgagtgaccaggccctcaggctgaaatgccccctccaggagagtatctcacacaggctggtggcctccccgccagagcagtgctctttctccacctgaccaggtgactctggctattgtttatttaaaaatttttttctgaatgggcatggtggctcaaacctgtaatcctagaactctgggaggccgaggcaggcagatcatctgaggtcaggagttcgagaccaacctggccaacagggcgaaacctgtctctactaaaaatacaaaaattagctaggtatggtggtgggcgcctgtcatcccagctacttgggaggctgatgcacgagaattacttgaacccaggaggcagaggttgcagtgagctgagatcgcgccattgcattccagcctgggtgacagagtgagagtctgtcagaaaaaaaaaaaaattctatcagaaattccatgtagaattgtttctttttctaaacacagagtttgaacaactgactcttgatggacacaaccttccttctctcgtctgtgtgataacaggtactgcctgggaccctgggtgtctgtttggttgggggatggcggagggggaggggcacgcagcctttaccctgtgcttcccatgatcttgtctccttaatcctcactgcagctctgccatagggtcttatactgcttgacatgggggaaactgaggctcagaggcagggcagggagcccagatttgaatctgtagataccaagctttctactttttcagtagtttccaagcatcttttttttgttgttgttacgtcattggtgtcttttttttttttttttgagacagagtctctgtcgcccaggctggagtgcagtggtgcgatctcggctcactgcaacctccgcctcccacattcaagcaattctcatgccccagcctcccgagtggctgggactacaggtgcccaccacaactgcctaatttttgtatttttagtagagacagggtttcaccatgttggccaggctggtcttgaactcctgacctcaggtgatccacccgccttggcctcccaatatgctggaattacaggcacaaatcactgtgcccggccatgtcattggtgccttaaccaagcctcttaatttttcaaacggaagagcccctgtcccacagttactgctgctgagccctttcaaggtgactcagtgaggagggagaaaagcggaagcggtgtgggaagaggccgggtctgggccagctgctggtcctgctctcctccctcctctggcctctaggctcccaggagtggtttggaacccgcgccatatgctctgggggctgtgccagggcaggaggagtcctcgtgtcccctgtgcacaacacagacaaaaggctgggtccacccagtgggcggtcgggtgccaggccagtgcttaccccgccatgtttgcagcccgaggccagctggctgcaggtgaaaggctatgcgtcaggggtcagggtgcacacacccctgcaggtctcagggctcctgggttgcttctggaagggcccggatggggcctgactggagctgctgaggggtggagcttctgggaaagggatccctcctaggggggagtgtcttgggcctggggccacgtggcagggacagagatgggtccatggcagtgtctgctcttctctgtgaaggcaaagggcctctgagggagtattatagccgcctcatccaccagaagcacttccagcacatccaggtctgcaccccctggctggaggccgaggactaccccctgcttctaggtgagaggccagcaggaggctcagggaggaggcggggggaacagggtgggcgggatgtactttttctgaaaaggtggctctggaggccactgggggacgggacctgggctctggctgaactcccaggaggaggctacttcctggtgtgccagcccctccctgccaggtggccccaggggccgtttaccaaggggtttgaggaggccacgtcctttcagcctgccacgccctccattcagtcctcttccttcctgcaggagggctgggcctggggttggggccactgttgcccaggtgtgggagggcagtggctttgggaggtacggggacgatgtgtcaaacagcgtcgcctctcccagtgagatggttctcctttgcctccgtctctttccccgttgatttctccaagtggggagtcgtgccttggtcctgatgcgtctctagagctgcatcttccagcttcgagtgagcagagcagttggaggctgaaggccttttcctggcaggactctccacctagtctttgttttagacagtctcgctccgttgcctaggctggagtgcatgatctcagttcatgcaacctctgcctcctgggttcaagcgattttcccacctcagcctcccgagtagattacgggattacaggagcccaccacaacacctggcttatttttgtatttttagtagagacagggtttcaccatgttggccaggctggtcttgaactcctgacctcaagtgatcctcctgccttggccttcctaagtgcttggattccaggtgtgacccatcacgcctggccccagctagtctttagaaatgttaagctatttggctttattttcacagtgacagctggtttgtggtgggtgtgctgtggtttattattattatcattttgagatggagtttcgctcttgtagaccaggctggagtgcaatggtgtgatcttggctcacgcaacctccgccttcccgggttcaagcgattctcctgcctcagcctcccgagtagctgtgactacaggcgcctgccacgatgcttggctaattttgtattttttttagtagagatggggtttcaccatgtgggccaggctggtcttgaactcctgacctcaggtgatctgcccgccttggcctcccaaaatgctgggattacaggcaggaggtgaacctgggaggtggaggttgcagtgagctgagattgtgccactgcactccagcctgggtgacagaatgagactctgtctcaaaacaaaacaacacaacaacaaaaaaaccaaattgtggttacgtataaaaagtgtcaacttacattttcagatgtcccagccaggctgtgtggctgcttggccagcttaagccacttgtgtttggggctgttgggggccttatctgattttcactctccttgggggatgctgcctcactgtgctgggaggatttgtgttcccagggcagagaccagtgctctgacccacccctcttgcctagcagggtcggcggacctgggtgtctgtctgcacacgtcctccagtggcctggacctgcccatgaaggtggtggacatgttcgggtgctgtttgcctgtgtgtgctgtgaacttcaagtggtaggagcagaacccaaatccttctggggatagctttgcagatccaccgctgagggggaagcagtgcagagggagctgcccacagtgaggccctgcccctcggtcagtccggcacacactggaggccatgaggaggagccctgcggttactgtggctgggctgagcctcactgaagtagttgcttccatttagagctcatgttatatttaggttggtacaaaagtaatcatggtttttgccattaaaaatggcaactacttttgcaccaacccaatatgaaaacaaaaagcaccttaaataccagaactccactcggggcttttgctcctagggtagaattggtgggaattgcctgcaggcttacatggttttctttgtttttctctcccaccatgtcccttttggccaagctcacatggtcggtttgaatcagttaaatgagtgtcatgctgtggcctcactgcacccagcgtagacgggtgtttggaagggcagtgttagaggagattctagaagcagtagccccagcacaagttgagcccttggcccctgctcaggagccggcccctggatgggatttagggatgtgagcccctcgtgtgagctgagctcagggaatgtcgggatcaaacctggtgccctagaaaagtcatcttttatgtgctgagccagtccccagggcgttgcctttacttgttccatggccatggaattaagaaaaacatgcaaaaataattcttcagtccttgaagagcatccagcacagaaggtacaaaccccccttaaggctccctcctcaaatgggtgtggccattttgatgtgcacccccccaggcctttatacccttcagatgccaaatctaagaaccagctcccggaaaccacaccccctgttccaacccccagcctggcttgagcatggggtgtgtgggggagcccaggtgggcaccccaggggtctggtgtcttctacaggcagctctcaggctcccttggttctctctgcagtttacatgagctggtgaaacatgaagaaaatggcctggtctttgaggactcagaggaactggcagctcagctgcaggtagccacgtctgccaccacgccagggtggggagggttctggagactggcaccgagccaggctccctgatccctgcttcccacagccagggtgggaccatgtggggtctggcggaaaagctagggagggagcagaggtcacagaggctggcccactctgctgtcccgtttcggtacagtaggctcgggaaagttaagacacacccccacctgccctctggatttatggagctgacactccacaaatgatgctggagctgggtgggccgggctgcggttgaggaagtgatcaggatcacgtaggtgggcgggcaaagggagcttctgggaccagccttgaaagatgggtggaattctgcaaaggttacttgtttcttattgcaaaaagtaatacatcattcttgccaacagaatgattggcaggattttcagtaaaggtccaggtcggaagtcgtttagactgggttccccagtctctgtcagaaccatggtactctgttggggtgtgaaagtagccacagatcatctgtagattaaggggtgtggctttgttccaataaaactttatttacaaacacaggctgtgggctggatttggcctgcaggctgtagtttgtgatccttgattcagacagtttagcaaggctgcaaagaacaccgacacccccttgttacccacagatgggtgagactgcgttggccagaggccgagaggagggtgctcacaggggaatgggcagcacgtagaggccgggaggtgctccagggcaccaagtgtgggaaagtgggacatgcggggaagtttccagaaactgtgatgtcaagttggagtcggagtgctgctggggtgtgaagggtctcgagtccaagtgagggagttagggacttggaggggttgttgttgggtcgggaacctggggtcagccaggtggtgaccctggatggggtggggacaggcaatgaggtaagctctgctctttatttttttgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactc

SEQ ID NO: 6700 - DNA, 6480 bp, Homo sapiens
agtttgaacaactgactcttgacggacagaaccttccttctctcgtctgtgtgataacaggtactgcctgggaccctgggtgtctgtttggttgggggatggtggagggggaggggcacacagcctttaccctgtgcttcccacgatcttgtctccttaatcctcactgcagctctctgccatagggtcttacactgcttgacatgcgggaaactgaggctcagagggtttcacagcagggcagggagcccagatttgaatctgtagataccaagctttctactttttcagtagtttccaagcatcttttttttgttgttatgtcattggtgtcttttttttttttttgagacaaagactctgtcgcccaggctgggatgcagtggtgcgatctcagctcactgcaacctctgcctctcacattcaagcaattctcatgcctcagcctccagagtagctgggactaaaagtgcccaccacacccagcttatttttgtatttttagtagaaacagggcttcaccatgttggccaggctggtcttgaactcctgacctcaggtgatccacccgccttggcctcccaatatgctgaaattatagatatgaaccactgtgcccggccatgtcattggtgccttaaccaagcttcttttaatttttcaaacagaagagcccctgtcccagttactgctgctgagccctttcaagatgattcagtgaggagggagaaaagcggaagcggtgtgggaagaggcggggtctgggccagctgctggtcctgctctcctccctcctctggcctctaggctcccaggactggtttggaacccgcgccatgtgctctggaggctgtggcagggcaggtgcggcttggaacccgcgccatgtgctctgggggctgtggcagggcaggggcggcttggaacctgcgccctgtggtttgggggctgtgccagggcagagggagtcctcttgtcccctgtgcacaacacagacagaaggctgggcccacccagtgggtggtcgcgtgccaggccagtgcttaccccgccttgtttgcagcccgaggccagctggttgcaggtgcagggctatgcatcaggggtcagggtgcacatacccctgcaggtcttggggctcctgagttgcttctggaaaggcccagatagggcctgactgcagctgccgaggggtggagcttctgggaaaaggatccctcctaggggggagtgtcttgggcctggggctatgtggcagggacagagacgggttcatggcagtgtctgctcttctctgtgaaggcaaagggcctctgagggagtattacagccgcctcatccaccagaagcatttccagcacatccaggtctgcatcccctggctggagggccgaggactacccccgcttctaggtgagaggccagcaggaggctcagggaggaggcggggccttatgcagggggaacaggggtgggcggggtgtaccttttctgaaaaggtggctctggaggccacttggggacaggacctgggctctagctgaactcccgggagaaggctacttcctggtgtgccagcccctccctgccaggtggccccagaggccctttaccaaggggtttgaggaagccacgtcctttcagcctgccacgccctccattcagtcctcttccttcctgcaagagggctgggcctggggttggggccactgttgcccaggtgtgggagggcagtggctttgggaggtacagggacgatgagtcagacagcgtcgcctcaccagtgagatggttctcctttgcctccgtctctttccccattgatttctccaagtggggagtcgtggcttgttcctgatgcgtctctagagccacatcttccagcttcgagtgagcagagctgttggaggctgagggccttttcctggcaggattctccagctagtctttgttttagacagtcttgctccgttgcctaggttggagtgcatgatctcagttcatgcaacctctgcctcctgggttcaagcaattctcccacctcagcctcccgagtagattacaggattacaggagctctccacaacaccttgcttatttttgtatttttagtagagacagggtttcaccatgttggccaggctggtcttgaactcctgacctcaagtgatcctctcgccttggcctccctaagtgctgggattccaggtgtgacccatcatgcctggccccagctaatctttagaaatgtttagctatttggctttattttcacactgacagctggtttgtggtgggtgtgctgtggtttattattattattattattattattattattattttgagacggagtttcgctcctgtagcacaggctggagtgcaatggtgcgatcttggctcactgcaacctcttctttcccaggttcaagtgattctcctgcctcagcctcctgagtagcggggattacaggcacctgccatgacgcttcgctaattttacatttttttttttagtagagatggggtttcaccatgttgaccaggctggtcttgaactcctgacctcaggtgatccgcccgccttggcctcccaaaatgctgggattacaggtgggaggtgaacctgggaggtggaggttgcaatgagctgagattgtgccactgcactccagcctgggtgacagagtgagactctgtctcaaaacaaaacaacaaaaaaatcaaattgtggttacgtagaaaaagtgtcaacttacattttcagatgtcccagccaggccgtgtggctgcttggccagcttaagccacttgtggttggggatgtcgggggccttatccaattttcactcccctcggggggtgttgcctcactgtgctgggaggatttgtgttcccggggcagagaccagcgctctggccacacccctcttgcctagcagggtcggtggacctggatgtctgtctggacacgtcctccagtggcctggacctgcccatgaaggtggtggacatgttcaggtgctgtttgcctgcgtgtgccgtgaacttcaagtggtaggagcagaacccgaattttttctggtgatagcttcacagatccaccgctgagggggaagcagtgcagagtgagctgcccacagtgaggccctgcccctcggtcagtccagcacacaatggaggccacgaggaggagccctgcggttactgtgggtgggctgagcctcactgaagtagttgcttccatttagagctcatgttacatttaggttggtacaaaagtaatcacggtttttgccattaaaaatggcaattacttttgcaccaacccagtatgaaaaaaaaaaagcaccttaaataacagaacttcactcggggcttttgctcctagagtagaattggcgggaattgcctacaggcttacatggttttctttgtttctttctctcccaccatgtcccttttggccaagctcacgtggtgggtttgaatcagttaaatgagtgtcatgctgtggcctcactccacccagcatagacgggtgtttggaagggtggagttagaggagattctagaagcagtagccccagcaaaagttgagcccttggcccctgctcaggagccggcccctggatgggattcagggatgtgagcctctcgtgtgagctgagctgagggaatgtcgggatcaaatctggtgtcctagaaaagtcatcttttatgtgctgaaccagtccccagggggttgcctttacttgttccttggccatggaattaagaaaaacatgcaaaaataattcttcagtccttgaagagcatccagcacagaaggtacaaaccttccttaaggctctctcctcaaatcggtttgaccattttgatgtgcaccccccccaggcttttatacccttcagatgccaaatctaagaaccacctcccagaagccacacaccctgttccaacccccagcctggcttgagcgtggggtgggtgggagcccagctgggcaccccaggggtctagtgtcttctccaggaaactctcgggctccttttgttctctctgcagtttacatgagctggtgaaacatgaagaaaaccgcctggtctttgaggactcagaggaactggcagctcagctgcaggtagccatgtctgccaccacgccagggtggacagggttctggagactggcaccgagccatgctccctgatccctgtttcacacagccagggtgggaccatgcggggtctggcggaaaagctagggagggagcagaagtcacagaggctggcctactctgctgtcccatttcggtacagtaggctcggtaaagttaggacacaaccccacctgccctctagatttatggagctgagactccacaaatgatgctggagccgggtgggccaggctgcagtttaggaagtgatcaggatcaggtagtgcgtgggctaagggaacttctgggaccagccttgaaagatgggtggaattctgcaaaggttacttgtttcttattgcaaaaagtaatacatcattcttgtcaacagaatgattgggaggattttcagtaaaggtccaggtcagaagtcatttagactgggtcccccagtctctgtcagaaccatggtactctgttgtggtgtgaaagtagccacagatcatctgtagattaaggggtgtggctttgttccaataaagctttatttacaaacacaggctgtgggctggatttggcctgcaggctgtagtttgtgatccttgattcagacagtttagcaaggctgaaaagaacacccccttgttacccacagatgggtgggactgtgttggccagaggccgagaggagggtgctcacaggggaacgtacatcatgtagaggccggaaggtgctccagggcaccaagtgtgggaaagtgggacatacggggaagtttccagaaagcatgtcaaaatggaggcggagcgctgctggggtgtgaagggtctcaagtccaagtgagggagctagggacttgggaggggttgttgttgggtcggggagctggggtcatccaggtggtgacctgggatggggtggggacaggcaatgaggtaagctctgctcttcagtattttgcagatgcttttctcaaactttcctgatcctgaaggcaagctaaaccagttccggaagaacctgcgggagtcgcagcagctctgatgggatgagagctgggtgcagactgtgctccctttggttatggacacataactcctgggccagaggctaaaaccccagggcccctgctgtccttcccgcaggttttttttggagtctcagggcaaaccctttcaagcagcgcctcccagtggccagaagctgaaatgacggcagtggtgccacctggtgaatgacccggaagctgtggttggcccgatttcttctttggagtctcagaaatgcttcccgtcttcttctgttcttcacgccccatgtccctgctagcgtattactgttctgtgacttccctgtgacctctgcagtactcctcatcctgcatttggtctccaggtgtcacctttctgccatgttcctaacactttgattcctgtcttgagaaaagcacctgctgcaccataagcccagggatgtggcagctgcagcgggcttggctttgtgaggaaccgagtgtgtccagggatgtggcagctgccgcgggcttggctttgtgaggaaccgaatgtgtccagggatgtggcagctgcagcgagcttggctttgtgaggaaccgagtgtgtccagggatgtggcagctgcagcgggcttggctttgtgaggaaccgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacatgcttagatagccgatgtcttattagagggcagattgtggttcctgatttggaatttaacattctccaaacattccagtccaatgaaagttttatccgctttcccatataaaaattcttcccacgagagtgatttgattctaacaatcccgttggagtcgtgtatgagtcctacagtgtgaggttcagcattgccatctccaagtgctctccatagggaaacagtttctggtcatgatgagcttccgcttcccatctgatcccagcccagcctggaaacagagcacgtgtttgaggatggcggtgtttggggacaggacatgagcgtattgtgtggggctgctaggacaggcctggcggggtggggagtgtctaagtcagtttacttggttcacaggttcccaggcccacccaagtacctagaattggcctccaggaagggaccagaaatctggttttacatagaaatggctagcagcaggcaccatgcagctgtccactc

SEQ ID NO: 6701 - DNA, 931 bp, Homo sapiens
gcctgtagtcccagcttcttaggaggctaggcacgagagttgcttgaacccaggaggcagaggtttcagggagccgagactgtgccacggtaatccagcctgggcaacacagtgagactctgtctcaaaaaaataagtaaaaaataaaatccatcctgcatcagtcaggaaagagctcattccagcaggatcaatgcagagaattcaccagaggaactagttccaaaggtatggcaagagctaaaccttccaacaggggcccatggggcaacccagagacagacaagagcaggaaactccaaacccttcggcgggcaggacagagggtgtgggtgagggttccagtgctgtgggctggaccagcctggtaggaatgagaatccatatgctaggagctggggccccagagaagcagctgctgtggaaaccccaggaggcagagtgagggagagacactggcctccccttcttcctgccctgcactgtctcccatgggtcacacgtggctgcagccagttgcctggggaggcccctgtcatgctgctgtttgcaaagcaggcccagggcctgggaaggacaggggctccagcacgcaggtggctatgctgtctggctactgggcggacactccccataacggacctttttggtgagttctgagagaaagcaccgggcatacttgactgacagccggtgcttcacacacacaggatgcttcacagtctacggcaaaggacagaacgttggttgctcgagagcccgtcttaagtcccctatgagcttcaagccaacacagcagagggcaaactccaggctacccgatccctcagcaaagatgtagatggacacagcgttctggccccatgcatctgaagtttgtcttaagatataaaccgtttcctaaaaatgcttccactgcagtggcacaggc

SEQ ID NO: 6702 - DNA, 1510 bp, Homo sapiens
gtttgagcaaaaagtagcctccacgctggactaatgcttggcaacattatgggaaaatttggggaagctgggagaggagggggcagagtttctttcccagccagccagggggtccaggcaattttggtcctagaacatctctctgtgcattcccaagtaattgcaaggcttcttcttgtcatcgtctgagacttggattccccaagcatccttcttttcctggagcctctgagtcctctattcctgaggcctttcttcagccctcccaatagccctgccatgatttcattgcagggctgtgaccgtctatgacaagccagcatctttctttcaagagacctctggacctgcagcaccaactcttcatgaagctgggcggcacgcactctccgttcagggcctggtaggcctcccatcctcagctgccttctctcctgcttgccaatgccctgtcctctccccttctcactgcagacctgggaacccactcatccaggggttggcaaactaaggctacaggccagtctcctgcttttgtaaatcaagttccattggaacacaacacactcattaacttctgagttgtctacagctgcctttgagctacaacagcagaatcgtgttttgcaacagagaacctgtggcccgcaaagcctgaagtatttactctctggccctttaagaaatgtttgtggacccctgcgctgtcttactctcctgccagtgggttcccaggcctgtggcaggatctgtggacctgtgtgtcccctggggtgtctcacggggctaaggaggggaccttagtgcaggtccacacaccctgaggtgtgcccctgggtaagctggagtggtgtgggagggtgtccctgcaccctcatcttgagtccaggggatgataagacagtaagtcgcgtggagaaaaggaatgagtcagtcttgtttgctgttgtaaccttagcacccagcaacaatattagagaaagcaagcccaggcctcagatggcaggggtggcctggtgctgctgatgtggctgggcaccccaacctttgggagcctgcaggccttgccatggcaggagatgcccgtcctgggtcccgggcctgctctgtggcctctcacaggcttttttcctgctctttcatctcagaacctgaggacccagacacggagcggtcggccttcatggagcgggatgctgggagcgggctggtgatgcgcctccgcgagcggccagccctgctggtcagcagcacaggctggacaggtctgcacgacccctagaacacttgggcttggtgtgacgggcacctggccaacctgtgttctcctcacccctgccagtcctgcatgcccccaccccgccacagtctcaatgagaaggggagggcgtgtgagctggaagaggggtgtctagaaacaggcccctgacattcaattctcttctcatagaggacgaagacttctccatctgctggcagctttagaaagtaggtgtgtagctgcggtgag

SEQ ID NO: 6703 - DNA, 313 bp, Homo sapiens
ggctagcagcgggcaccatgccgctgtccactctctacccgcatctgccccagcacttggcacagcaggacagaagcagagatctgaacccacatctacctggctgctccgtcaacccactcttcacaaagcttagaaagcggccaggcacagtggctcacacctgtaatcccaacagtttgggaggccaaggcgggtggatcactttagttcaggagttcgagaccagcctggccaacatggtaaaacccatctctacaaaaatacaaaaattagctaggcacgatggcgggtgcctgtaattccagctact

SEQ ID NO: 6704 - DNA, 401 bp, Homo sapiens
gccctcaggctgaaatgccccctccaggagagtatctcacagaggctggtggcctccctgccagagcagtgcactttctccacctgaccaggggactctggctactgtttatttaaaaatttttttctgaatgggcatggtggctcacacctgtaatcctagaactctgggaggccgaggcaggcagatcacctgaggtcaggagtttgagatcaacctggccaacatggcgaaacctgtctctactaaaaatacaaaaattagctaggtatggtggtgggcgcctgtaatcccagctacttgggaggctgatgcacgagaattacttgaacctgggaggcagaggttgcagtgagctgagatcatgccattgcattccagcctgggtgacagagcgagag

SEQ ID NO: 6705 - DNA, 1039 bp, Homo sapiens
ctacgttccagggattacggcatgaacatactgttttcaggaccctatctagcccaccatggtaaggaaacacccaacaaacatcatgcttattaagtttccaggcaggtgcctctctatcccagcttcattgttgtgttcttttcttcacaagtattttcagagctgcccttggccatctggaagatgcatggtgaaagaaacggatgcttgctctcagcacacacttccttccctgacagtttgtcgcctagcagctattttggcttcccaagggaaatcttgtcctttgcccttgtggggcttactgcaaatcaactcatcatgaggaagattaatcagagaaaagacatacaattttttttttttaaactgtgagcatgaagagaatcacagagtgtatactcaatctcccaatgggggcaaaatacttctgtaacctcctttcaggtggcgagaggggacatgggaatgtaggtaattctgttgagcggtaataagtgatgactaggaagattgaatggatacttgggagaatgaatagggggaggaaacagagattgacttattaatggttccctttggaaattaaatactccttggagaccagtcattactttgtaaaaaagtctgtttgagcgggcttacatcttaacgttctttcctgtagtcaagaagaagatcccagggagggagggaaagtgaattgtaataatcccgacatgttcagggagggaccctgtgggaggtcattgaatgatggggggcaggtgcttcctgtgttgttcttatgatagtgattaagtctcacaggatctgatggttttataaagccaggttccgctgcacatgccctcttgcctgccgccatggaagatgtgctttttctcctcctttgccttccgccatgattgtgagtcttccccagccatgtggaactgtgagtccattaaacctgtttcctttatacattacctagtcttggatatgtcttcattagcagcgtgagaacagactaatacagaacggaaaaaaaaaa

SEQ ID NO: 6706 - DNA, 100 bp, Homo sapiens
caaaaaagaaaaagtaagtaaagaaataaagaatagctactccattgcagagcagccctgagggctgctggttggatatttttgtggttgtttcttgatg

SEQ ID NO: 6707 - DNA, 4478 bp, Homo sapiens
gcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgttctgaacagctgtaaccccaactcccccacacaatgtgtctgcctgggaggtaagtaagtccagactgggtgtccaggagctggaacccagagagcgtcctgtccctaaccagccactgcagccctccagctctggccctcagctgcttgacaggacggactgctgggagatggcagccggttggcagggcccttgccctcacaccccgctgcccaggagccaggtctgaacttctgtgcacaggcctggcccctcagactcactcctgccaagaggggccacttcttcagggtgagccccggctatcaggcagccgtgagctccagggcgggctgcagctcccatccccttgcgccatgtttggagtaaagggatcagtggaagtggaggagccacttgggttctcctaagaccagcccttccggaggggccggtcctggaagaaacccataatccctggagtgtgaaaaagggcaaaaagaaaaagctggcctggtttccttcctccctgattgattgattgataggcacttcctcttgctcagtgcaatacctaccagtgctgctaaaccagggactcgcccagacctcagcaggcccccagggcctctccgtgcaacactccgtagccatgacagcagctctctgctgcccgcccctgcccagagctggcagaagccctctgttgcctttcctccctcagagcagagaggccccaggggagccagggccgagtggatcctaggatggccacggagagccactcgctcccagaacaggcaccccttcccaaaccagcttttctgcagccaattgcctgttgcagctgtggccactgcctcccggcactgtggcagactccccccaaggagggatggggggggcaccagtgaggatgccccatcctgcctcaggtccagaactctgaaaggtagggtgcccaccccgtgcttacttccggcccctagaggttgggggtggtcgttatctctcaagtggcctccaataccccatccagccacaccacctctgccttccatctgaccaatccccaggcctctggtcagggccaggacacctgagactcacccttagcacagcacaacctccagtgcccaaggcctctcccacaccccagccatccacacatctggccccacctgctcagtactactcaacatttgaattcgtgtaaatatttatttttgtgtgtgaacaatactacaaagtaatcagtaagatcttttgcaaaaatgttaccccaggcaattatttgtgaaaatcttaatgttaaaacctggcagagacaatcgccaccctagaattcctggtatcagttacttaacgtgtcacttctcctcccagaggcagtacccaagctagacatgaaccgtttgcatttcttggcagacaggagtgagaaagactggggaaggggctccctccccctacccacacaaggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgatttttatataatttagtggtgctttagaaactttgtttttgttgtttctgagctaaacagctcaatcctttttcgcctgtatctacctaagaccaatgtgaacctttgtatttttgctcctaattttggactcagtgaaagtgtactgtttacatgtacagatgcccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaa

SEQ ID NO: 6708 - DNA, 5681 bp, Homo sapiens
gcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatggtgagtcccccctgcctggcccacactttccctcggtgccactactgacctcctgccacactcccaggatgcccgggccccttcacccagggtcttcccaggagccctggaagcaagtaccataatccctggtttgcaaatgagggaactaaggcccagaaagatcacacagctccatagactgaggcgctggagcccaaaccccaccctgtgccacccacccctggggcagggtctctgcacaagcccagggcccccacgggccccatgctagctccatccccgttctgcctgcagaccagacccacgccaccccatctgacctcggccatggcagaaaacatcctggcagctgcctgtgagagcgagacaagaaaggcagccaagcggatgcgtctagagatctaccagtcctcacaggtacctgccaccgcagccactacaggggccgctcctgggcagccagggagggcaggccttatatgggtgtggactgagggagctgtgatgggtacagtcgggagaagggcagagggggaacaggagggcaaagacaaggagaggaggtgggtggaggtcaggtgtgttgttctcagagctcctcagacctcatacggaagcctggacttcatctggagaccagagggccctgatcaaatacgctgacagggagatgagcagagttggggaaagcccccggggggaaggtggctgggggaggggacagacagaatcccacaggtcaaaccgcagcattgggtcccaggagtcctggggccgcagcatttatccaccttgtgtccagggatggtagttggggccagctgccccttggtttccccagcgcccccctctcccctctgcaggatgagcccatagccctggacaagcagcactcgcgggactccgcagccatcacccactccacctactcactgccagcctcctcctactcccaggaccctgtgtacgccaacggcggcctcaactacagttaccgcgggtacggggccttgagcagcaacctgcagccccctgcctccctccaaacaggaaaccacagtaatggtgagtcgggggaggcctgggctctggcttcccgaccagcacccagctgggtctgcagagcagccctgggcagcggaatggggagagggaagcagaggccagtgatggaaaggggctgcctcacagcatagggagcaggaggggcggctctggcacccttccacttcatcgtcttagctggtccttagattggaaggtgaaggagactcagttggttaaagcaaaaacctaccgcccccttctcaccgccagtgacgcttgctccaacacttcccaccttcactaccggcgcctctcactggttccactcccccagggtccctgtgggtgccgagtcccagccaagggcctgttcttggcctgagttgaatctccgcagccccgtctgtctcacccatagcgactgaggctcagtgagacagctgctggcctggcccagctgtggccccgctggcctgcagggcggctccctccccaggcctcagctcagggcctgccttgtgaggtgaaagctttcctcacctgggtgctgggcctccgttcttgcccctgcattcatggagcctacatctgagacacctggggtgatggtgcacacctgctccctcgctccgctcctgtagctgggtgattcagtaggtgcttttccggtaactccccaggctactctgcgcagatggggcacagaccattagaggagacagcccccgaagagacagaggcttcctcatggagtcaggtgctgccgtgagcacgaactggaatggggaacctcagacccctttactgtgaggccaagggaagcaggggaggagtggggtcagcctggtgggtcacaggacctcttgggccaggcactcgggttgtgttctgtgtgcaggaggagcccctgctaggttttaagcacagaagggccgtgaattgtgtggtctgtgtcattctgtctgcccctgtaagaaggtttgaatgggcagagcaagaggcagaagccatgtgctttgggggtcgttcagaagccagggaatgaagggaagaattgaggaacctgagtaggttggagaaaggtgccacctgtaagctggggaaccctggtgcaaggtcttggctaaacatgcctgaggattccctaagcccccatccttggctgcaggagacccctcactgttcctgggcagcaagggagggagctagtccccacccatggcaggaagcccaggctgcctccactcgccttgacccccgccaccccccagaaccaggaagtgtatgcaggtccctggaagattcctgcctgggcttaactcctcatcccttcctaatgcctcttaacctaaaataagaggccgcctggccctaatccctgaagctaaggccggagtggccagcacggtgagaggtggagtggctgtcctaggcgggctcctttcattccaggaagaaaagccctgccccccctacacatgggggtctggggctcagcaggtgaggtgagggtggtctggggcctgctccctcctagcagcaggcgatggtgacaagcctctacctggtgtccacccagcatgacctatttcagggctgcggctgccaagtccccctgaccctcctaagggcctctcatattagggctgagcctgcttcatgcctgcccgttcacacctgcccaagaggcacaaacagcagccagagaatgattcttccagggaggcagctggctctgcccttgtgcatcctggggtctcagtctcccatctgtgaataccctggttccttcatggtgggtggggaggccactgacgcagaaatctggtcatttacctccttgcctggggcagcccctgtccttgagcactagtacctcatttgaagaacattgtttaaatcctccagcagttgaaggaagacaacaggcagccacgtggttgcagggccacccagccccactggcctccccagcctcagcctttcaagtattgttcaatcagtttggtacctcagccgggcagccgtattaatggctcagagctcctcactttgctcattatgttgtcatctggagatgcaaatcagcttagatagaatcaggctcggcctgtcttgcctggggtgctgggtaactcatgctcactcctatccctctacccaccatacggcagtccctcggcaacctgagcatctggctgtaaccagagtctacacgggggtgtctccagatcagatcagctgcaggaaacagggaccttctcctttccaagcctcagctacagcccaggagagaagggaggaagctctgagcacaggcatgaacaggatagcacttggggagaggagaaaagaaaggaaccgggaccactgctcatgttgactatgccaggaggctctggccactcccaagcatgacgcagaggggaccagaaccaccctagagagaaccagaccctcttcccccgcatccctctgggtccatcccctgcaatatccagaagttagcagaggcactcctgttccaagcttctcagtcccgcattgtgacaacaccctgggagtcagtcacctgtttggctgctgtttccagacacagccccaaccccttccccctgtgtttgattttaacagactcaactgtttccttaactctcaattccaaggacgctatttagaaaatagttcctaggacctcctccttggtgtccacattctctggccggagaggaaataaccccatgtgacaaactgtcccatcttagactccagcttccttccccatttgggggctgcaccagcttccttttagcagcagtcaggtttccatagtttatcccaagatgttacttccagtctggatacctcccgtgacaagagcttgtccatctctcttcatagcagcataaaaactgccatggagatgcaatcatgagagaatgtgaccatcagaactttcagggtagctgggggagcctcacacccccgtggaagataaagctgtggggaagggactccagggggagggcagacaacagagaagctgacctggctgcatcagagaaggcttcccagggaagcggcagctctgcctgcacctgcccagattctctcttctttggctgtttcttgccgaacaccttgtagaatgcttttcaaattccaggagcttccaggtctcctgggagcccattcagaaagccctgaaacctctttggaagcccttccctattgggccagtctaggcagtcaggcctcctgtgggctgagaaggagcctcagcctgtgctgagtgtttcacagccggcatctcagcttctgctcgcaggagccgcctagttttggcagatgagggctctgaggcccagagaagttaaagaatttgccaatgaagtagcagagcaggacttgaatccacacttgcctgactccaaagccaggagcttcttgggaaaggccaagagaggacagggcctggcggtcccctccccaacacgcacacccctagtgtgttttgaaagatggcaggctccctctttgccatcatccgaggacaaagggcgggcagtttctccagaagcgagtctgagtcttgtcctgatggttccggcccacactccctcgtatcctagcagcatgaaccctccacctcactcaggcacaggactcctcccaggaggggggattcgaggtgcttgaggcttagcagaaagaggcttcacacacccagccccttcctccatccactggctgccatggtccctcctgggggtgcagttatggcctggccagtctggcctgtacctctccccccagacaaccagggcagctggcctctctccagctggacagaagcccctttcttgtctgggcacacagatgtttcttctcctggccttttgtggctcgactctcagctcctcctgggctttccccacacgcatctctcaggtgtgttgggcccctgcctacctgcagagtctcctgcacaccatctccccttccagcctcggtgtctgggctggggaagagcacacagatgggtgctgctcctttaggcacactggcagaggctttcttttagcacttgtcccacagttcctcaatggaagtagtatttcccattcccaagctctgctcaccacactgaggagaggcagatcttaggagttcctttgccccaaggccgcctcttcctcacctaaaaccggatccttgcaagatcaccctgaggattctctgagaaccctgtcgcccgcaggcccattctaagcactagggatagagccatcagggagatggaccagagccacggacttcagtgcccaactcacagtgggcactaggccataggttatgacagtgccaaggaaggtacacctcccagatgccaggcagggtggctgctcccttctcaccctacttccctctccacagggcccacggacctcagcatgaaaggcggggcctctaccacctccac

SEQ ID NO: 6709 - DNA, 275 bp, Homo sapiens
gcctgtaatggcttgactcttggaggtggagtctgcagtgagccgacgtcgtgctactgcactccagcctgggcaacagagcgagaccctgtcttttaagaaaatggtctttaagttcagtgtagcccttaaaagtgatgtacatggattaaggactggaagaaagtactgcaaagtgtttatatttgtatgcatggagagattacaggtagtatgctttgctcttgtccattttgtattttctgaatttcaaacagttaaaaaagaaaaaaaga

SEQ ID NO: 6710 - DNA, 122 bp, Homo sapiens
tcaggtggctgaggcaggagaatcacttgaaccctggaggcggatgttgtggtgagctgagatcgcaccattgcactccaacctgagcaacaagagtgaaactgtctcaaaaaaaaaggaaa

SEQ ID NO: 6711 - DNA, 377 bp, Homo sapiens
gtgtgtgtgtgcgttttctttcctgttgcttttgggataacttctaagctcctcctcatagcataggagacctttcatgttattttttttttaaagataaaataaatttttattttaaatttattattagttttagagatgagggtgttcactttgttgcccaggctggacttgaactcctggcctcaagcagtcccttcccccttgtgtagctggcactacaggcatatgccttcgcatgcccagctgtcttttgtgttttggtccagcttgcctctccagtccttactggcgctccatttcggctatactaaagtatttgtagttttgtgaatacccatcctatttttatagtttgtgcagtttctcagcatact

SEQ ID NO: 6712 - DNA, 12796 bp, Homo sapiens
ggacggatgaaatggttcaaattgccattttatgtgggagcccagttcttgggagcctttgtgggggctgcaaccgtctttggcatttactatggtgagtaaagtccctgagtcctaaggttaggaagagctgggcataatttgaaagtcagaattacttggtaggcacaggcgagaaaaagcaaggacgggaagcattctacaagtgacagcaagttctaaatttgagaaaatgaggccatattaccattccagcaaattcgtgaatcctgttaatgaaaatggtcatatcttaaatggggagcagaacttaaaggaagcctgtctttgtgccaagccagcactgcaacatacacatccatacaacaagcagtaggccagtggcttccccactgctgtctctgatttggctgggaaaagaggtgttttctggtgacaaaggtgtgaccagtaagtattgagagaaggactctgggaagatgtctttgaaggaagagacacagcagagatgtgggctgggtgggagcctcattgcccttctatcaaacagccagggcttccactctgcaacagtccttgggaaaaacacagtattggtcatagaagaccagactttagctctagctgttcagtaaatacctgtgcaacttaaataagtcatctgatctgactagcctcagtttcctcctctggaaaatgagggaattgaatcagatgactctcgaggcctttcaaactaaaacaccttggtgttcccatgaaatcaactgttaaagcagctccttccttctaacccaaggtaagccttaatacattatgacttacccaaactgaagaccttaggaagtagaatttatgaaccaggccttatagaaatgggtcatggagggctgggtgtgtggtggctcatgcctgtaatcccaacactttgggaggcataagtgggaggatcgtttgagcccagtagttcaagaccagcctgggcaacatagggatacctcgtctcttcagaaaaaaaaattaaaaataagccaggtgtggtaactcacatctgtagtcccagctactcaggaggctgataagaggattgcttcagcccagatcaaggctgcagtgagccaggatcatgccattgcactccagcctgggcagcagagcaagaccctgtctccaaagaagaaaaaaaagaaaaaaaaaaaggaaaagaaataggttatggaaagggacttttccccatagagtgtctctctgagaattagagtctaaaagggctaaaatggaattcaagaacacacaggaaattcagagcccgctgctgtggcaagaatggcctggggtcagtgctagctgtggcagtggctgcaatacccctggctctaagggcatcttcagtatactgcaacaccctcaaattctggagtggtattaggggttactgagagccctctgggaattataaattattcctagagcaagaccaagccccactttggcttacagttgacctcgaaaactccaagaattcccccaaaagagaactcattcccaggaccctatcgaagaataatttgtccaagtttgcagtgggccattcagagaggccaaaggccttcttcctttgaccctccatcctgggattcacctgggcatctctaaaactatcattcctcggaagtagagagagacaaatgacatggctatgccaagctcaatctgagtgactggttgtttagcacaaggcttggcacaggcctccttcaactcttcccagggaacactaatgtgccagagctttctctttcatagatggacttatgtcctttgctggtggaaaactgctgatcgtgggagaaaatgcaacagcacacatttttgcaacatacccagctccgtatctatctctggcgaacgcatttgcagatcaagtaagtgtagattcaacaaagacttaactttggtgaaaagatatgctctcataaggggaatgcattggagaattagagaccaatcagaaaggagagattatatttccaaaggcagaggttgctgggcataacccaagctttcttgataatcgttttacctttacaaggagctgataccaccagaaaagttttctccttcctctttaatacatacacttgtttaacattagttgagatccagaaaagagtgaatgactaaacatttcaatccctgtagacacaaatggagttcacttcactattgactcttttgaacaagtggtctaagtgtggaggccacaagagaagatatttctatttcaaatcaaagactgtgaagggtggtagttgagcctaggggatcatcaatcctctctgtctcaccatgtgcataggtttatttatttaaactctcaaggtggccagaagtatctctgcttattgacctttaaacaagcttctagcacccaagcatactgtggtgtaaccaatagcacacctatttggtcagcttatggcaggactaacattgtcaactcaaaagactcttcttcccttactgtgtcccaagaaggctgctggttatcttggtcagggcagtggaaggaaggctatatttttcagtatctctaagttcttcctctatgatcaggacttatacagcagatcagaatgggcatgtgtatcaaatggatcttccagttcatcagctatgcccacctccattcaatgtatggatgaaaaactatgccctcatgtcctcagcttttttactttccactttcatcaataaatcaaacaggcaacaagtgttcattaaaaactcactatgtgcttggccctttgtctggagcttgaaagactgacgagtaaatgtgagttgtaaagatccaagatgcagagtctgaatgcttgaattaaaatagctgttctgcctccaacttcctgcgtggcttcagcaaagtactgaactttttgggtcgcaagttattcacttgtaaaatggggataatatgagccttcatgaagttacttatgaggataaaaagaataatatgagaaaaacgcattgtaagcagtatctgcccagaaattttgaatctagttgaagagcattgaacaaggaaacaatgcaaaataagatataattagacagagctgggcacggtggttcacatcttactccctgcattttgggaggccaaggtggacaggtcacttgagcccaggagttcactaccagcctgggcaacatggcaaaaccctgcctctaccaaaaatacaaaaattagccatgcgtggtggtgcttgcatgtagtcccagcaacttgggaggctgaggtgggaggatagcttgcacccaggagttggaggctgcagtgagctatgattacaccaccacacctcagcctgggcaaaaaagaagaaaattagataggaaactggagtatagcgaccatattataatagaaatttgaagcagagagcatagaagagcgaggacaattttggttattttggtgtttttctctaagcttttttttttttttttaagactgagcctgttgccccaggctggagtgcagtgacgtgatctcagctcactgcaacctccacctcccaggttcaagcaattctcctgcctcagcctttggagtagctaggattcccagtgtgagccaccactcctggctaatttttgtatttttagtacagacggggtttcaccatgttggccagactggtctcgaactcctgacctcataatccgcctgcctaagcctcccaaagctgtatcttgatcaatgctgacctgcataccatatcctgagcttccttcattgtgtccttgtctcagagtgagttggcaatttctctaaggtctgtggtttctaagcccattattgtgtataaagtcaagtagaaaaagcgaatattagaaaaccctgaggctgtaaccgtcagcaaaccctgaatgctgtccgtattcttaggctttggagagagttccaaaaattgccaattatcagtcagtcaacacccaacagagctcttggccatcatgaccatattttggggtcaccttatttcaagattactaaattgtttagctgtaaatactcttcaagcatattccttggtttagttaataatcaatcatttatttacccaataactatttactgggcacctacttagccaagtacagctctatactcttccttcttcaaggagttcagagtctgaggctcaatctaacaagtaagtagatactcttttgcagagtgacaaggacactgatagaagtaaagtcagaatgtcatggaagcccagaggagggagcttttactctgcaagagagagttggagaaggcattccagagaagagtgctcttgggggaacatgtgtcttttaatattaattaaaaattattttaacattattattttggaaagcagatgaaatgataatgaacttaaactttaaaatcagttgcctggttcccatcctgattcttctgcttacaagtttgacattggacaagtgtcttaaccttgttttactcgagttttcttatctataaactgagaataatagcaggatttacctcacagcattactgtgaagatttaatgagataaagcatatgaagtacctggcacataataaatgttcaataaataatagctatcatttaactgttaaagtaaaacagtagtttggaaaactaataacatagaaaccagctataattggccaattcaaatacctattatcatttttgtttattgtcttaaaatttttcttttacgtatgtttttaagtagagtcaaccctacatatccatgaattctgcatccatggattcaaccaaccatggatcaaaaatatttttaaattgcatttgtattggacacgtacagacttttttcttgtcattattccctaaacaataccgtattcacattatatcagatattataataatctagagatgatttaaagtatacaggaggatgtgcataggttatatacaaataaaacacaattttatattggggacttgaacatccatggatttttggtacttgcaggaagtcctggaaccaatcccccacagacaccaagggacagctgtataaaacacaaaacaaaacacaaacacaaacaaaaaaatacaaatttttttcacttaatgttataagtatttttaaatattactacatagcttttatgtttatagtttttaatggctatacagtagactaaaaaaagagtaaaagcttccagtttttcagtactataaattttgctaaagtggacattttaaaatgatttttccacgttttagattatttccattgtgtaattctcaaacatccagcagcatcaaattgtataaataaatttatgtttttgaatgcatattgctaaattattgctgaatttccttttaaaagcatagtacttgtttagatctattagaaaagcctgaaataacgggtatctttttcctaacatttgatattgtttggatttattttattactaatgagtttttaccactgctttcctaattctgttttccttttttgaattttctgttcacttcctttgcacactcatctattgatatctcacattgcttttctcaccaatttgaacaagcctttcattcatttttccagcctgcagcttgccgttctacttagctgagtagtagcttagcaggatagtgtggtattaagataacagtctctggagccaaactctctggatccaaacctgactgccacctactaagtgggcagggtaaccaatctgtaaatgagaattatattggcttctcctctagaattgctgtagaaagaagagagactggcacaattattcacccagtacatgccagttattactaggcatattgtaatataagtaaaatagtaatattgtaatattgtaaaatagtaagaagggatgattttgagacatgcaggtgagcagaatgcaggctaaagccctggctcaacttctccctctccaggtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcaggtaagtaacagtggtggggaagagagagacagagtcatgctgcgcctcaccagtggggcggggctttgacatggagatccagggaagttcagatgacagcgccaacgttaactgcacactctggtcataagcatgagacatttcactggtattttgtggtatgatgtgtgtgtgtgtgtgtgtgtgtgtgtgaaagagagagagagacagagaaagagaggcggctctaggtaaattcaatagagataaaactgtcccacataataataatccctcaattgctatatgattttatgtgaacattttagctgtataacttgtctgcagattcattttgtgacaaagttgggctacaatttgcatcctatgatgccactacagggctcttcctcgtgaaccacgcaacctatgctgcacttattccacagatatttgttgggcattatctgtgctttagtcactgtgctaagcaaggaaatttcaaatcagcaaaagcactcaccttgagcgatataataagtgctctggcaacccctaaaagtgctgcaggaacacagataacgtgtgagtaactgccagggaagcagggaaagacatgactgcaaatgtgagagctgacttggttctggagatatgagtaagaacttccggacaggacagacgtaagattgagcctctgccccagaaatggcaagactccacactttctacttcagaatgtgctgaggaaatacgccaactgttggtacctatcttctaggacaaaatttgccccttcactacttcctggtttccctgcatgcagtcacagaggcgcatcctcatccacccatggcaacttcctatggggaaggagctcactttggttcatcaggaaacagggctctaccatggagaaaagtaggaaaaacatgtgtgagcaaattctactttaatgtttcctgtgagaacaaaggacgtgagtgttcccaaatgatgacctagacatagagtcatcagggtttggcctgcatttcaccagggtgaaaaataagttaaaataactggtaccattgagatcaccaccacagatagcactcagagcatctagagtgtaagtgccatgagtaccttgacagccttttcccctggtatatccacagtgcctagaacagggtgtagctcatagaaaggctcaataaaaaggtattgaataaaagaatgaatgaattctatgtgacggacacttcctaggagttgaaggatgcaaagcaactcagtcaacattccctgtcctcaagaaattgacaatccaataaatttcctagaacagcagttctcaaccagaggtgggcaactgttccccagggcatttttggttgtcacggctggacctgagggaaggggctgctactggcatctaatgggtagacgccaggaatgctgttaagcatcctacaatgcacacggcacacctcccacaacaaagaattattcagtccaaaatgttaataggtttgtggttgagaaattctctcctagaatgatcacaactagaacacgaaaatgtccgcaactaggatggatctcttgtatctttccaatggagcatcaaaaacatatgtcctaaggatctccttattcccagagcccagaattcgcccatgagtttcccttaattccaccatccagagtctcagtcttggagaccaagctcttcttccaccccctttgagacctccttggtgattcattcaaaagtcaaagagacatggtggttccaaaacagatggagatcttgcccaatgtccctttgctctgttaagtatatgttaggagaactcacgtgaaggaaaatgttggaatcacctaatgtcccatgtccttagctagcatcaggatcttttcccttccatggagtcatttattcattcatgcagctacttgatatcttactcaaggctctccactaaagatgataagacctagtttctgtccttcactgttgtgtttatattctacttaagaggttattccagaagctcttacacaaggtggaagcagtcaagtgccattaaagagatttgactaattaactccaggagtttagaggtctacagctccaaatttaagaattatgggagtggaagtgggaacatttatagtatttggatatgcttaaacaagcaacagaggggttatctcaggcagagagaaccgttattcaaagacacaatgttaaaatcacaagtgatctagtctagctggaagggtgcagaaagaaagttggaaagggccgttgtcagatcatagaggacctggactcccagaatgagaattttggcttttcttctgctccctgttttgtaggttatagggagtagcaaagtatttggggcagaagtttggcaggtttagaatgtcaatttagcaaaattaatctggcatcatcctataagactgattgaaaaaggagagagtggggaagtagaaacccattaggaaagagcagggttggctggtaatcctcaaccaaaaatttctccccaaaacctttgagggacaacaggcttccaaagtgttcttagagtgtctcatttcctcagagttctatattcaagggaaatccctcagtagatatcctagcttggacctacacctaaggtcttagaaaaaaaacaaggctaccttgttcccaggtccccatgtactcctgaacggcaagcagtggaatgatggcaggtacagcgagatgccagagggtttgatgagggcaagagtcaacagaccctggccaaagactcttggtttttcctttaaatgttaagatgtttcccatcaaatttctctccacttattcacattgttaatgacttaatcagtgaaagctctcaggagtattattaaatttttcaaatagttggcccaaagtattgaatccctaaagatggtcctttagacagttaacatacacatgttcctggcatctcccgaatcatagtgtgcaaatgatcactatttgtgtgcatataggactaggctaggcaggtaaccacatctgagcgcctccatttgtgacttgtgaacctgatacaacatgtccaatctgataaaataaaaagcatccagccagtgaagaggacgtgtaccctggctgatatcttggaccttcatctgctaaatgacaggaagaaatttgccataaaaggaaatgatggacccaacaggtagcttatactcccttcatgttttgacctctagagaagacttcaagtctttacagccaaacgggagaggcagccaccctccatgtgcctcccctagaaaaatccatctggatttggggcctggggaagggcactgtgagggcggccgagtacagcatcctcgctgccgtgtggtaagagtgacatctggtggctgccatgctcaggctcagtgctcttccatcaaccctgcaagggcaatggaggacttcggagaccacttaggtgccccaggtggaagggaccatgcagatgaaggaaatggagctcacgatggggaatgggggtttgatttgctcaaagaccttctagataatcttgagattagacttagtttcctggattctaggacagggttcttgtgtcctgcttatttcctttatcgttctttctaatcaaagtttgagatatacaaaaggccacatggaacatatgtgtagttattcagcataatgatgaaaagaaaagctatgggtccttctagaatccaactagaacactgaaattcttacatgcctctgggtactcctcttgtctcccatcccctctgcatttatcctgaagttttgtgttttccattcccctgctttttaaaaatacttttatcttaaatgtatatatccttaaacaatatactgtataatttgtttgctttcctgatcctttctaagaaattatttacatggattttctctctccaaagaagatggtgacaactcacaaagatacctgcttttccccagaactatagctttgctgtaatgtactaacattgaggatttctggaagagagagagccatggcatgacagccttatcagagggtagcctcaagctaagatcttaaaaaataagtactgatttaaattatatttagaaggcaattcacacatccaccttagattttttaaaaattcattcattcattgaaaaacatttcctgattgattagtttgattgtcctcatacactaatgatgcccaggaatctctccacattctgcttgtaatccacaggaatcattatttcaggatgagggaaaggcaattctgaataattgacctgaactttcttaggggccctcaatcttaacgatgggctcaggcactatattttataaaaagaaaataaataagacataatatctcacaaatattagtaggacaattaaatagatcatctgaaatcaggtgtagtggaaagtcaaggatggcagttgccatgctgcactgagccccccttatacttagctcttgctgagttaagagggaaccatgagtgtgagaaagactaacaagtgagtgaaaaaactagacagtaataccaggaggaaggccaagaaatgtatcactaatttcttgtttgatttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttgg

SEQ ID NO: 6713 - DNA, 12801 bp, Homo sapiens
ggacggatgaaatggttcaaattgccattttatgtgggagcccagttcttgggagcctttgtgggggctgcaaccgtctttggcatttactatggtgagtaaagtccctgagtcctaaggttaggaagagctgggcataatttgaaagtcagaattacttggtaggcacaggcgagaaaaagcaaggacgggaagcattctacaagtgacagcaagttctaaatttgagaaaatgaggccatattaccattccagcaaattcgtgaatcctgttaatgaaaatggtcatatcttaaatggggagcagaacttaaaggaagcctgtctttgtgccaagccagcactgcaacatacacatccatacaacaagcagtaggccagtggcttccccactgctgtctctgatttggctgggaaaagaggtgttttctggtgacaaaggtgtgaccagtaagtattgagagaaggactctgggaagatgtctttgaaggaagagacacagcagagatgtgggctgggtgggagcctcattgcccttctatcaaacagccagggcttccactctgcaacagtccttgggaaaaacacagtattggtcatagaagaccagactttagctctagctgttcagtaaatacctgtgcaacttaaataagtcatctgatctgactagcctcagtttcctcctctggaaaatgagggaattgaatcagatgactctcgaggcctttcaaactaaaacaccttggtgttcccatgaaatcaactgttaaagcagctccttccttctaacccaaggtaagccttaatacattatgacttacccaaactgaagaccttaggaagtagaatttatgaaccaggccttatagaaatgggtcatggagggctgggtgtgtggtggctcatgcctgtaatcccaacactttgggaggcataagtgggaggatcgtttgagcccagtagttcaagaccagcctgggcaacatagggatacctcgtctcttcagaaaaaaaaattaaaaataagccaggtgtggtaactcacatctgtagtcccagctactcaggaggctgataagaggattgcttcagcccagatcaaggctgcagtgagccaggatcatgccattgcactccagcctgggcagcagagcaagaccctgtctccaaagaagaaaaaaaagaaaaaaaaaaaggaaaagaaataggttatggaaagggacttttccccatagagtgtctctctgagaattagagtctaaaagggctaaaatggaattcaagaacacacaggaaattcagagcccgctgctgtggcaagaatggcctggggtcagtgctagctgtggcagtggctgcaatacccctggctctaagggcatcttcagtatactgcaacaccctcaaattctggagtggtattaggggttactgagagccctctgggaattataaattattcctagagcaagaccaagccccactttggcttacagttgacctcgaaaactccaagaattcccccaaaagagaactcattcccaggaccctatcgaagaataatttgtccaagtttgcagtgggccattcagagaggccaaaggccttcttcctttgaccctccatcctgggattcacctgggcatctctaaaactatcattcctcggaagtagagagagacaaatgacatggctatgccaagctcaatctgagtgactggttgtttagcacaaggcttggcacaggcctccttcaactcttcccagggaacactaatgtgccagagctttctctttcatagatggacttatgtcctttgctggtggaaaactgctgatcgtgggagaaaatgcaacagcacacatttttgcaacatacccagctccgtatctatctctggcgaacgcatttgcagatcaagtaagtgtagattcaacaaagacttaactttggtgaaaagatatgctctcataaggggaatgcattggagaattagagaccaatcagaaaggagagattatatttccaaaggcagaggttgctgggcataacccaagctttcttgataatcgttttacctttacaaggagctgataccaccagaaaagttttctccttcctctttaatacgtacacttgtttaacattagttgagatccagaaaagagtgaatgactaaacatttcaatccctgtagacacaaatggacttcacttcactattgactcttttgaacaagtggtctaagtgtggaggccacaagagaagatatttctatttcaaatcaaagactgtgaagggtggtagttgagcctaggggatcatcaatcctctctgtctcaccatgtgcataggtttatttatttaaactctcaaggtggctagaagtatctctgcttattgacctttaaacaagcttctagcacccaagcatactgtggtgtaaccaatagcacacctatttggtcagcttatggcaggactaacattgtcaactcaaaagactcttcttcccttactgtgtcccaagaaggctgctggttatcttggtcagggcagtggaaggaaggctatatttttcagtatctctaagttcttcctctatgatcaggacttatacagtggagcagatcagaatgggcatgtgtataaaatggatcttccagttcatcagctatgcccacctccattcaatgtatggatgaaaaactatgccctcatgtcctcagcttttttactttccactttcatcaataaatcaaacaggcaacaagtgttcattaaaaactcactatgtgcttggccctttgtctggagcttgaaagactgacgagtaaatgtgagttgtaaagatccaagatgcagagtctgaatgcttgaattaaaatagctgttctgcctccaacttcctgcgtggcttcagcaaagtactgaactttttgggtcgcaagttattcacttgtaaaatggggataatatgagccttcatgaagttacttatgaggataaaaagaataatatgagaaaaacgcattgtaagcagtatctgcccagaaattttgaatctagttgaagagcattgaacaaggaaacaatgcaaaataagatataattagacagagctgggcacggtggttcacatcttactccctgcattttgggaggccaaggtggacaggtcacttgagcccaggagttcactaccagcctgggcaacatggcaaaaccctgcctctaccaaaaatacaaaaattagccatgcgtggtggtgcttgcatgtagtcccagcaacttgggaggctgaggtgggaggatagcttgcacccaggagttggaggctgcagtgagctatgattacaccaccacacctcagcctgggcaaaaaagaagaaaattagataggaaactggagtatagcgaccatattataatagaaatttgaagcagagagcatagaagagcgaggacaattttggttattttggtgtttttctctaagctttttttttttttttttaagactgagcctgttgccccaggctggagtgcagtggcgtgatctcagctcactgcaacctccacctcccaggttcaagcaattctcctgcctcagcctttggagtagctaggattcccagtgtgagccaccactcctggctaatttttgtatttttagtagagacggggtttcaccatgttggccagactggtctcgaactcctgacctcataatccgcctgcctaagcctcccaaagctgtatcttgatcaatgctgacctgcataccatatcctgagcttccttcattgtgtccttgtctcagagtgagttggcaatttctctaaggtctgtggtttctaagcccattattgtgtataaagtcaagtagaaaaagcgaatattagaaaaccctgaggctgtaaccgtcagcaaaccctgaatgctgtccgtattcttaggctttggagagagttccaaaaattgccaattatcagtcagtcaacacccaacagagctcttggccatcatgaccatattttggggtcaccttatttcaagattactaaattgtttagctgtaaatactcttcaagcatattccttggtttagttaataatcaatcatttatttacccaataactatttactgggcacctacttagccaagtacagctctatactcttccttcttcaaggagttcagagtctgaggctcaatctaacaagtaagtagatactcttttgcagagtgacagggacactgatacaagtaaagtcagaatgtcatggaagcccagaggagggagcttttactctgcaagagagagttggagaaggcattccagagaagagtgctcttgggggaacatgtgtcttttaatattaattaaaaattattttaacattattattttggaaagcagatgaaatgataatgaacttaaactttaaaatcagttgcctggttcccatcctgattcttctgcttacaagtttgacattggacaagtgtcttaaccttgttttactcgagttttcttatctataaactgagaataatagcaggatttacctcacagcattactgtgaagttttaatgagataaagcatatgaagtacctggcacataataaatgttcaataaataatagctatcatttaactgttaaagtaaaacagtagtttggaaaactaataacatagaaaccagctataattggccaattcaaatacctattatcatttttgtttattgtcttaaaatttttcttttacgtatgtttttaagtagagtcaaccctacatatccatgaattctgcatccatggattcaaccaaccatggatcaaaaatatttttaaattgcatttgtattggacatgtacagacttttttcttgtcattattccctaaacaataccgtattcacattatatcagatattataataatctagagatgatttaaagtatacaggaggatgtgcataggttatatacaaataatacacaattttatattggggacttgaacatccatggatttttggtacttgcaggaagtcctggaaccaatcccccacagacaccaagggacagctgtataaaacacaaaacaaaacacaaacacaaacaaaaaaatacaaatttttttcacttaatgttataagtatttttaaatattactacatagcttttatgtttatagtttttaatggctatacagtagactaaaaaaagagtaaaagcttccagtttttcagtactataaattttgctaaagtggacattttaaaatgatttttccacgttttagattatttccattgtgtaattctcaaacatccagcagcatcaaattgtataaataaatttatgtttttgaatgcatattgctaaattattgctgaatttccttttaaaagcatagtacttgtttagatctattagaaaagcctgaaataacgggtatctttttcctaacatttgatattgtttggatttattttattactaatgagtttttaccactgctttcctaattctgttttccttttttgaattttctgttcacttcctttgcacactcatctattgatatctcacattgcttttctcaccaatttgaacaagcctttcattcatttttccagcctgcagcttgccgttctacttagctgagtagtagcttagcaggatagtgtggtattaagataacagtctctggagccaaactctctggatccaaacctgactgccacctactaagtgggcagggtaaccaatctgtaaatgagaattatattggcttctcctctagaattgctgtagaaagaagagagactggcacaattattcacccagtacatgccagttattactaggcatattgtaatataagtaaaatagtaatattgtaatattgtaaaatagtaagaagggatgattttgagacatgcaggtgagcagaatgcaggctaaagccctggctcaacttctccctctccaggtggtggccaccatgatactcctcataatcgtctttgccatctttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcaggtaagtaacagtggtggggaagagagagacagagtcatgctgcgcctcaccagtggggcggggctttgacatggagatccagggaagttcagatgacagcgccaacgttaactgcacactctggtcataagcatgagacatttcactggtattttgtggtatgatgtgtgtgtgtgtgtgtgtgtgtgtgtgaaagagagagagagacagagaaagagaggcggctctaggtaaattcaatagagataaaactgtcccacataataataatccctcaattgctatatgattttatgtgaacattttagctgtataacttgtctgcagattcattttgtgacaaagttgggctacaatttgcatcctatgatgccactacagggctcttcctcgtgaaccacgcaacctatgctgcacttattccacagatatttgttgggcattatctgtgctttagtcactgtgctaagcaaggaaatttcaaatcagcaaaagcactcaccttgagcgatataataagtgctctggcaacccctaaaagtgctgcaggaacacagataacgtgtgagtaactgccagggaagcagggaaagacatgactgcaaatgtgagagctgacttggttctggagatatgagtaagaacttccggacaggacagacgtaagattgagcctctgccccagaaatggcaagactccacactttctacttcagaatgtgctgaggaaatacgccaactgttggtacctatcttctaggacaaaatttgccccttcactacttcctggtttccctgcatgcagtcacagaggcgcatcctcatccacccatggcaacttcctatggggaaggagctcactttggttcatcaggaaacagggctctaccatggagaaaagtaggaaaaacatgtgtgagcaaattctactttaatgtttcctgtgagaacaaaggacgtgagtgttcccaaatgatgacctagacatagagtcatcagggtttggcctgcatttcaccagggtgaaaaataagttaaaataactggtaccattgagatcaccaccacagatagcactcagagcatctagagtgtaagtgccatgagtaccttgacagccttttcccctggtatatccacagtgcctagaacagggtgtagctcatagaaaggctcaataaaaaggtattgaataaaagaatgaatgaattctatgtgacggacacttcctaggagttgaaggatgcaaagcaactcagtcaacattccctgtcctcaagaaattgacaatccaataaatttcctagaacagcagttctcaaccagaggtgggcaactgttccccagggcatttttggttgtcacggctggacctgagggaaggggctgctactggcatctaatgggtagacgccaggaatgctgttaagcatcctacaatgcacacggcacacctcccacaacaaagaattattcagtccaaaatgttaataggtttgtggttgagaaattctctcctagaatgatcacaactagaacacgaaaatgtccgcaactaggatggatctcttgtatctttccaatggagcatcaaaaacatatgtcctaaggatctccttattcccagagcccagaattcgcccatgagtttcccttaattccaccatccagagtctcagtcttggagaccaagctcttcttccaccccctttgagacctccttggtgattcattcaaaagtcaaagagacatggtggttccaaaacagatggagatcttgcccaatgtccctttgctctgttaagtatatgttaggagaactcacgtgaaggaaaatgttggaatcacctaatgtcccatgtccttagctagcatcaggatcttttcccttccatggagtcatttattcattcatgcagctacttgatatcttactcaaggctctccactaaagatgataagacctagtttctgtccttcactgttgtgtttatattctacttaagaggttattccagaagctcttacacaaggttgaagcagtcaagtgccattaaagagatttgactaattaactccaggagtttagaggtctacagctccaaatttaagaattatgggagtggaagtgggaacatttatagtatttggatatgcttaaacaagcaacagaggggttatctcaggcagagagaaccgttattcaaagacacaatgttaaaatcacaagtgatctagtctagctggaagggtgcagaaagaaagttggaaagggccgttgtcagatcatagaggacctggactcccagaatgagaattttggcttttcttctgctccctgttttgtaggttatagggagtagcaaagtatttggggcagaagtttggcaggtttagaatgtcaatttagcaaaattaatctggcatcatcctataagactgattgaaaaaggagagagtggggaagtagaaacccattaggaaagagcagggttggctggtaatcctcaaccaaaaatttctccccaaaacctttgagggacaacaggcttccaaagtgttcttagagtgtctcatttcctcagagttctatattcaagggaaatccctcagtagatatcctagcttggacctacacctaaggtcttagaaaaaaaacaaggctaccttgttcccaggtccccatgtactcctgaacggcaagcagtggaatgatggcaggtacagcgagatgccagagggtttgatgagggcaagagtcaacagaccctggccaaagactcttggtttttcctttaaatgttaagatgtttcccatcaaatttctctccacttattcacattgttaatgacttaatcagtgaaagctctcaggagtattattaaatttttcaaatagttggcccaaagtattgaatccctaaagatggtcctttagacagttaacatacacatgttcctggcatctcccgaatcatagtgtgcaaatgatcactatttgtgtgcatataggactaggctaggcaggtaaccacatctgagcgcctccatttgtgacttgtgaacctgatacaacatgtccaatctgataaaataaaaagcatccagccagtgaagaggacgtgtaccctggctgatatcttggaccttcatctgctaaatgacaggaagaaatttgccataaaaggaaatgatggacccaacaggtagcttatactcccttcatgttttgacctctagagaagacttcaagtctttacagccaaacgggagaggcagccaccctccatgtgcctcccctagaaaaatccatctggatttggggcctggggaagggcactgtgagggcggccgagtacagcatcctcgctgccgtgtggtaagagtgacatctggtggctgccatgctcaggctcagtgctcttccatcaaccctgcaagggcaatggaggacttcggagaccacttaggtgccccaggtggaagggaccatgcagatgaaggaaatggagctcacgatggggaatgggggtttgatttgctcaaagaccttctagataatcttgagattagacttagtttcctggattctaggacagggttcttgtgtcctgcttatttcctttatcgttctttctaatcaaagtttgagatatacaaaaggccacatggaacatatgtgtagttattcagcataatgatgaaaagaaaagctatgggtccttctagaatccaactagaacactgaaattcttacatgcctctgggtactcctcttgtctcccatcccctctgcatttatcctgaagttttgtgttttccattcccctgctttttaaaaatacttttatcttaaatgtatatatccttaaacaatatactgtataatttgtttgctttcctgatcctttctaagaaattatttacatggattttctctctccaaagaagatggtgacaactcacaaagatacctgcttttccccagaactatagctttgctgtaatgtactaacattgaggatttctggaagagagagagccatggcatgacagccttatcagagggtagcctcaagctaagatcttaaaaaataagtactgatttaaattatatttagaaggcaattcacacatccaccttagattttttaaaaattcattcattcattgaaaaacatttcctgattgattagtttgattgtcctcatacactaatgatgcccaggaatctctccacattctgcttgtaatccacaggaatcattatttcaggatgagggaaaggcaattctgaataattgacctgaactttcttaggggccctcaatcttaacgatgggctcaggcactatattttataaaaagaaaataaataagacataatatctcacaaatattagtaggacaattaaatagatcatctgaaatcaggtgtagtggaaagtcaaggatggcagttgccatgctgcactgagccccccttatacttagctcttgctgagttaagagggaaccatgagtgtgagaaagactaacaagtgagtgaaaaactagacagtaataccaggaggaaggccaagaaatgtatcactaatttcttgtttgatttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgacaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttgg

SEQ ID NO: 6714 - DNA, 336 bp, Homo sapiens
tttaaagatacatctcttttgagcttgtttttatatcctctgggcatggccggaggaactgctagatatagatttaaatcttatacatatattggataagcatattgacttttaaaagatatcgaagttaatagctacatcagtctgtttggggtgactgctttatagatagagggattcaagcctattaaaaaaacagccacttgagcacatcaagtttctttttatacctgactctcttttcatcaagataaacattctaaactgttatccaaggatgccatgaaaatgatcattcctccttctctccctgctcagatacacactctctctttc

SEQ ID NO: 6715 - DNA, 336 bp, Homo sapiens; identical to SEQ ID NO: 6714

SEQ ID NO: 6716 - DNA, 316 bp, Homo sapiens
gaattcttggccgggcacggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacctggcaggcggagcttgcagtgagccgagatcgcgccactgcactccagcctgggtgacagagcgagactccgtctcaaaaaaaaaaaaaaaaaaaaagaattc

SEQ ID NO: 6717 - DNA, 303 bp, Homo sapiens
ccaggcgcggtggctcacgcctataatcccagcactttgggaggccgaggcaggtggatcacgaggtcaggagattgagaccatcctggctaacatggtgaaaccccgtctctactaaaaattacaaaaaattagccaggcgtggtggcgggtacctgtagtcccagctgcttgggaggctgaggcaggagaacggtgtgaacccaggaggtggagcttgcagtgagctgagattgcaccactgcactccagcctgggcgacagagcgagactccatctcaaaaaaaaaaaaaaaaaaaaacc

SEQ ID NO: 6718 - DNA, 1052 bp, Homo sapiens
tcacgcctgtaatcccagcactttgggaggccgaggcaggtggatcacgaggtaaggagatcgagaccatcctggctaacacggtgaaaccccgtctctactaaaaatacaaaaaattagccgggcatggtggcaggcgcctgtggtcccagttacccaggaggctgaggcaggagaatggcgtgaacccgggaggcggagcttgcagtgagccgagatcgagccactgcactccagcctgggcaacagagctagactccgtctcaaaaaaaaaaaaaaattattgtttatatttgagatgagaattcttgatacattttttggtatattaaaaagtgagataaattgtttgtgctttaacatgtaaattgcatcgtagattcataaaattcatcttggatttatttctagcacagtactttctattgaaagcagtttactatcaagaaaatctatcaaaggggatggaatcccattcttcattttcatgaattgttttaaaaagtgttcttctggccagggtcggtggctcacacctgtaatcccagcactttgggaggtcgaggtgggtggatcacgaggtcaggagatcgagaccatcctggccaacatggtgaaacctcgtctctgctaaaaatacaaaaatttgctgggtgtgaccgcacgtgactgtaatcccagctactcgggaggctgaggcaggagaatcgcttgaacctgggaggcggaggctgcagtgaaccaagatcgtgccgctgcactccagcctggcaacagagccagactccgtctggaaaaaaaaacaaaacaaaaaacaatgccgggcgcggtggctcacgcctgtaatcccagcactttgggaggccgaggcaggcggatcacgaggtcaggagatcgagaccatcctggctaacacggtgaaaccctgtctctactaaaaatacaaaaaattagccgggcgtggtggcaggcgcctgtagtcccagctactcgggaggctgaggcaggagaatggcatgaacccgggaggcggaacttgcagtgagccgaga

SEQ ID NO: 6719 - DNA, 293 bp, Homo sapiens
gtggctcacgcctgtaatcccagcacttcgggaggccgaggtgggtggatcacgaggtcaggagatcgagaccatcctggctaacacggtgaaaccccgtctctactaaaaatacaaaaaattagctgggtgtggtggcgggcgcctgtagtcacagctacttgggagactgaggcaggagaatggcatgaacccgggaggtgcagcttgcagtgagcagagatctcgccactgcactccagcctgggcgacagagcgagacttcatctcaaaaaaaaaaagaaagaaagtaa

SEQ ID NO: 6720 - DNA, 272 bp, Homo sapiens
gggccgggcacggtggctcaagcctgtaatcccagcactttgggaggccaaggagggtggatcacgaggtcaggagattgagaccatcctggctaacacggtgaaaccccatctctactaaaaatacaaaaattagccgggtgtggtgtcaggtgcctgtagtcccagctactctggaggctgaggcaggagaatggtgtgaacccgggaggtggagcttgcagtgagcggagatcacaccactgcactccagcctaggcgacagagtgaga

SEQ ID NO: 6721 - DNA, 183 bp, Homo sapiens
tgtggtggctcacgcctgtaatcccagcactttgggaggcggaggcgggtggatcacgaggtcaggagatcgagaccatcctggctaacatggtgaaaccctgtctctattaaaaatacaaaaaattagctgggcgtggtggtgggcgcctgtagtcccagctgctcaggaggctgaggcagg

SEQ ID NO: 6722 - DNA, 149 bp, Homo sapiens
tcacgcctgtaatcccagcactttgggaggccaaggtgggcagatcactaggtcaggagattgagaccatcctggctaacatggtgaaaccccgtctctactaaaaatacaacaattagccgggtgtggtggcgggtgcctgtagtccc

SEQ ID NO: 6723 - DNA, 318 bp, Homo sapiens
gactcacgggcgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccacagtccggcctgggtgacagagcgagactccgtctcaaaaaaaaaaaaaaaaaaaaaaa

SEQ ID NO: 6724 - DNA, 140 bp, Homo sapiens
ttctcacgcctgtaatcccagcactttgggaggccgaggtgggtggatcacgaggtcaggagatcgagaccatcctggctaacatggtgaaaccccgtctctactaaaaaaacacaaaaaattagctgggcatggtggca

SEQ ID NO: 6725 - DNA, 223 bp, Homo sapiens
tggctcacgcctgtaatcccagcactttgggagtccgaggcaggtggatcacgaggtcaggagatcgagaccatcctggctaacatggtgaaaccccgtctttactcaaaatacaaaaaaattagccaggcatggtggcgggcgcctgtagtcccagctactctggaggctgaggcaggagaatggtgtgaacccccgaggaggagcttgcagtgagccgaga

SEQ ID NO: 6726 - DNA, 281 bp, Homo sapiens
cacgcctgtaatcccagcactttgggaggccgaggcgggtggatcacgaggtcaggagatcgagaccatcctggctaacacagtgaaaccccgtatctactaaaaatacaaaaaattagcagggtgtgggggggggcgcctgtagtcccagctactcaggaggctgaggcaggagaatggcgtgaacccgggaggtggagcttgcagtgagttgagattgcgccactgcactccagcctgggcgacagagcaagactccatctcaaaaataaataaataaa

SEQ ID NO: 6727 - DNA, 300 bp, Homo sapiens
gcgcggtggctcacgcctgtaatcccagcactttgggaggccgaggcgggtggatcacgaggtcaggagatcgagaccatcctggctaacacggtgaaaccccgtctccactaaaaatacaaaaaattctccgggcatggtggcgggcgcctgtagtcccagctactccagaggctgaggcaggagaatggcatgagcccaggaggcggagcatgcagcgagccgagatggaaccactgcactccagcctgggtgacagagcgagactccgtctcaaaaaaaaaaaaaaaaaaaccacac

SEQ ID NO: 6728 - DNA, 205 bp, Homo sapiens
tcccagcactttgggaggccaaggtgggcggatcacgaggtcaggagatcgagaccatcctggctaacacggtgaaaccccgtctctactaaaaatacaaaaattagccaggtgtggtggcgggcatctgtagtcccagctactctggaggctgaggcgggagaatggcgtgaaccccggaggcagagcttgcagtgagccgaga

SEQ ID NO: 6729 - DNA, 167 bp, Homo sapiens
gggccgggcgcagtgactcacgcctgtaatcccagcactttgggaggccgaggcgggtggatcacgaggtcacgagatcgagaccatcctggctaacacagtgaaaccccgtctgtactaaaaacacaaaaaattagccgggcatgttggcaggtgcctgtagtccc

SEQ ID NO: 6730 - DNA, 300 bp, Homo sapiens
ggcgcggtggctcacgcctgtaatcccagcactttgggaggccgaggcgggcggatcacaaggtcaggagattgagaccatcctggctaacacggtgaaatcccgtcttactaaaaatacaaaaaaaaattagccaggcatggtggcgggcgcctgtagtcccagctactccggaggctgaggcaggagaatggcgtgaacccgggaggcggagcttgcagtgagcagagatcgcgccactgcactacagcctgggcgacagagcaagactccgtctcaaaaataaataaataaataaaa

SEQ ID NO: 6731 - DNA, 226 bp, Homo sapiens
gggtgcagtggctcacgcctgtaatctcagcactatgggaggccgagacgggtggatcatgaggtcaggagatcgagaccatcctggctaacacggtgaaaccccgtctctactaaaaatacaaaaaaattagctgggcgtgatggcaggtgcctgtagtcccagctactcgggaggctgaggcaggagaatggcatgaaactgggaggcggagcttgcagtgagc

SEQ ID NO: 6732 - DNA, 305 bp, Homo sapiens
gtggggccaggcgcggtggctcatgcctgtaatcccagcactttgggaggccaaggcgggtggatcacgaggtcaggagatccagaccatcctggctaacacggtgaaaccccgtctctactaaaaatacaaaaaattagccaggtgtggtggcgggtgcctgtagtcccatctactccagaggatgaggcaggagaatggcgtgaacctgggaggcggagtttgcagtgagccgagatggcgccactgccctgcagcctgggcgacagagagagactccgtctcaaaaaaaaaaaaaaaaaaaa

SEQ ID NO: 6733 - DNA, 275 bp, Homo sapiens
gcctgtaatcccagcactttgggaggctgaggcgggtggatcacgaggtcaggagatcgagatcatcctggctaacatggtgaaaccccgtctctactaaaaatacaaaaaattagctgggcatggtggcgggcacctgtagtcccagctactcgggaggctgaggcaggagaatggtgtgaagctgggaggcggagcttgcagtgagcccagattgtgccactgcactccagcctgggtgacagagcaagactctgactcaaaaaaaaaaaaaa

SEQ ID NO: 6734 - DNA, 1365 bp, Homo sapiens
tgcctgtaagcccagctactcgagaggctgagcaccaaaatggggatgctagtcacacttacgtcctagggttcttggggatgaaatgggttcttacttgtacaactcttgaagtggtgtgcctggcatgtgacaagcatgcagcagatgtgatgctagctttcattattattggctatttgccatatccacggatgtcatcttgtcccttgtctcctttaattattgacagaagttgacacaagtgatcatctcatcctttaaaaagtgctttctctcttcccttggctactaggacactttactgtcgtcgttcttttccagtgtcattggccattttcagctccttcattagtttctctcccacttgtcttttaaatgcatgtatttctcaaggatctcttcatctaaatgtccttccctcaaattgctgtcttgtgcattttcctttttagttaatactattatatcctccaagtcactcaggattgttaccgtgaaatcatccagaattctgtctcctcctttgtctcccttttcagaccactccaaagctgaccttttttcaaattttgttgattggacctaccccatcttatgcatggccttctcatgttcgatgctacgatcccattttggatatctggtcattctctttttctgtcttctcattactgtcagagttctctttcttaaagttcagccctaatgtcactccccattgcatgaagtggtggtctccaaagaggggcgctggcataataggaggtatgcaaataagtacatttggatatgaaaagaaaatattcaagctgtatttatgcttaagttaagctttactaatatttggtgcatgcattggtacctttattggctctataagccatttgctcatatatcttgaagtacccaagggaagactgcaagatgaattaatggtcttccactgtttgttgcttctcagcatattgcagtctattaaagcttccatgtatctgcttaagtagatctacagggtaaagcatgtagtttttaagatgcatgtgttctcaaaaagggtaagtgacataaaatatttgtacagaaaaggggccgggcgcagtggctcacgcctgtaatcccagcactatgggaagccaaggcgggtggatcacgaggtcaggagattgagaccatcctggctaacatggtgaaaccccgtctgtactaaaattacaaaaaaaaattagctgggtgtggtggcaggtgcctgtagtcccagctactcgggaggctgaggcaggagaatggcgtgaacctgggaggcggaacttgcagtgagccgagattgcgccactgcactccagcctgggcgacagagcgaga

SEQ ID NO: 6735 - DNA, 2364 bp, Homo sapiens
ctcactcctgtaatcccagcactttgggaggccgaggcgggcggatcacgaggtcaggagatcgagaccatcctggctaacacggtgaaaccccgtctctactaaaaatacaaaaaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaagaataaagtataagagaacatgagtgaatgcctgtcatctttttttttttttcttcaaaaacagggtctcactttgtcacccaggctgcagtgcagtggcgcaatcatggctcactgcaacctctagcacctgggctcaagagctcaagaggtcctaccaactcagcctcccaaggagctgggactacaggtgcatgccaccacaccctaaggtaaatttttgtgtttttatagagacaggttttaccatgttgcccaggctgttctgaaactcctgggcttaagggatcgacccacctccatctcccaaggcactgggattataggcatgagccaccgcgcctggcctatcatcatttattcatttattcatctatgcaaaaatattctttgagtgcctaattgctaagcaatgggacaagcactggcaagtcacactggcaaaatatcatcccgccactcaaggagcttataggtcagctggggagacaaagaagaacatgggcccttgtaatgagctaagtatggtgctaggggaaatatccataagttatgggaacccagaggaattcattcatttattcgtttagtaaatatttatgtgccaaactcttgggacccaatggtgacctaagcagacaagacacatccacctacagtgtttacagagtagtgtgggagacagacattaatgaaatgctcttacagacctatcattacctattgtcatatgagttatgaaagaaaaataacaggccgggcatgatggctcacgcctgtaatcccagcactttgggagaccaaggcaggtggatcacttgaggtcaggagttcaagaccagcctggccaacatgatgaaaccccatctctactaaaaatacaaaaaaaaaaaaattatctgggcatggtggcaggcagctgtaatcccagctactcgggaggctgaggcaggaaactcgcttgaacctgggaggcagaggttgcactgagctgagattgcaccactgcactccagcctgggtgacagagcaagactctgtcaaaaaaaaaaaaaaaaaagaaaggaaggaaaggaaggaaggaaggaaggaaggaaatagagtgtaagaggggggcctagtgtagtctaagatgactcaggagaagctgtttgagctgatgcctgaagacgggttgcatgtaagtagttgagtaggtaaaagagaggggtactatcatatcagggattcgggagaaaaaaaaagagagagagagaggggaagagtgctgtggacccattgagctccagcccagctccaactctgtgggtcaggaaagactttccagcatctaagctgagtccagaaggatgagtaggagtgagccagctgaggaggagctggggtggaaggaaagcattccagagcagcagatagcttgtgcaaaggcacacaggcagctgggtgtggtggctcacacctgtaatcccagcactgtgggaggccaagatgggtggaccgtttgagcccaggaattcaagaccaacctggatgacatagtgaaaccctgtctctaccaaaaaaaaaaaaaaaaaaattgaaaaaaaaaaagaagctgggcatggtggcgtgcacctgtggtcccagctacccaggaaactgaggtgggagggaagtcgaggctgtagtgaaccatggtggcaccattgcattccagcccgggtgacagagcaaggccctgtacaaaaaaaaaaaaaaaaaaagcatggaggcaacagaacatagtggattggaaggaaaaacaagtggttcagaccaggtgcagtggctcatgcctgtaatcccagcactttgggaggccgaggcgggcagatcacgaggtcaggagatcaagaccatcctcgctaacacagtgaaaccccgtctctactaaaaatacaaaaaaattagccaggcgtggtggtgcgtgcctgtagtcccagctactcaagaggctgaggcaggagaatggcgtgaacctgggaggcagagcttgcagtgagcggagatcatgccactgcactccagcctgggcgacagagcaagactcca

SEQ ID NO: 6736 - DNA, 289 bp, Homo sapiens
aggccgggcgcagtggctcacgcctgtaatcccagcactttgggaggccgaggagggtggatcacgaggtcaggagatcgagaccatcctggccaacatggtgaaaccccgtctctactacaaatacaaaaattagcagggcctggggcgggcgcctgtagtcccagctacttgggaggctgaggcgggagaatggcgtgaacccgggaggcggagcttgcagtgagccgagatcgcgcactgcactccagcctgggtgacagagcgagactccctctcagaataaata

SEQ ID NO: 6737 - DNA, 298 bp, Homo sapiens
ttgggccgggcgcagtggctcacgcctgtcatcccagcactttgggaggccgagacgggtggatcacgaggtcaggagatcgagaccatcctggctaacacggtgaaaccccgtctctactaaaaatacaaaaaattagccgggcgtgttggcgggcgcctgtagtcccagctactcgggaggctgaggcaggagaatggcgtgaacccgggaggcggagcttgcagcgagcggaaatcgcaccactacactccaggctgggggacagaacgagaccccatctcaaaaaaaaaaagaa

SEQ ID NO: 6738 - DNA, 311 bp, Homo sapiens
agggataggccgggcgcggtggctcacgcctgtaatcccagcactttgggaggccgagacgggcggatcacgaggtcaggagatcgagaccatcctggctaacatggtgaaaccctgtctctactaaaaatacaaaaaaaattagccggttgtggtggcgagtgcctgtagtcccagctactccagaggctgaggcaggagaatggcatgaacccgggaggcagagcttgcagtgagccgagatcgtgccactgcacttgagcctgggcgacagagcaagactccatctcaaaaaaaaaaaaaaaaaaaaa

SEQ ID NO: 6739 - DNA, 131 bp, Homo sapiens
agtggctcatgcctgtaattccagcactttgggaggctgaggtgggtggatcacgaggtcaggagattgagaccatcctggctaacatggtgaaacccagtctctactaaaaatacaaaaaaaaaaagaaa

SEQ ID NO: 6740 - DNA, 175 bp, Homo sapiens
cacgcctgtaatcccagcactttgggaagcccaggtgggcggatcacgaggtcaggagatcaagaccatcctggccaacatggtgaaaccccgtctctactaaaaatacaaaaaaattagccgggcgtggtggcccgcgcctgtggtcccagatactcgggagtctgaggcagga

SEQ ID NO: 6741 - DNA, 1365 bp, Homo sapiens; identical to SEQ ID NO: 6734

SEQ ID NO: 6742 - DNA, 320 bp, Homo sapiens
atggtggctcacgcctgtaatcccagcactttgggaggccgaggcgggcggatcacgaggtcaggagattgagaccatcctggctaacacggtgaaaccccgtctctactaaaaatacaaaaaaattagccgggcgtggtggcgggcacctgtagtcccagctactcaggaggctgagacaggagaatggcgtgaacccgggaggcagagcttgcagtgagccgagattgcaccactgcactccagcctgggcaacagagcaagactccgtctcaaaaaaaaaaaagaaaaaagaaaagaaaagaaaagaaaacgaagtc

SEQ ID NO: 6743 - DNA, 308 bp, Homo sapiens
caggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaagttgaataaac

SEQ ID NO: 6744 - DNA, 300 bp, Homo sapiens
gctcacgcctgtaatcccagcactttgggaggccgaggcgggcggatcacgaggtcaggagatcgagaccatcctggctaacacggtgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaattaa

SEQ ID NO: 6745 - DNA, 140 bp, Homo sapiens
aggccgaggcgggtggatcacgaggtcaggagatcgagaccatcctggctaacatggtgaaaccccatctctactaaaaatacaaaaaaatagccgggcgcggtggtgggcgcctgtaggcccagctacttgggaggctg

SEQ ID NO: 6746 - DNA, 142 bp, Homo sapiens
taaaggctgggcgcagtggctcacgcctgtaatcccagcactttgggaggccgaggcaggtggatcacgaggtcaggagattgagaccatcctggctaacatggtgaaaccccgtctctactaaaaatacaaaaaaaaaaaa

SEQ ID NO: 6747 - DNA, 322 bp, Homo sapiens
cggccgggcgcggtggctgacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagctttcagtgagccgagatcgcgccactgcactccagcctgggcgacagagcgagactccgtctcaaaaaaaaaaaaaaaaaaaaaaaaaaaaaaaaaaaaattc

SEQ ID NO: 6748 - DNA, 281 bp, Homo sapiens
tcccagcactttgggaggcctaggcgggcggatcacgaggtcaggagatggagaccatcctggctaacacggtgaaaccccgtctctactaaaaatacaaaaaaaaattagccgggcgtgatggcgggcgcctgtagtcccagctactcaggaggctaaggcaggagaatggcatgaacccaggaggcagagcttgcagtgagccaagatggcgccactgcactccagcctgggcgacagagcgagactccgtctcaaaaaaaaaaagacaacaacaacaa

SEQ ID NO: 6749 - DNA, 270 bp, Homo sapiens
tgggaggccgaggcaggtggatcacgaggtcaggagatcgagaccatcctggctaacacggtgaaaccccgtctctactaaaaatacaaaaaattagccgggcgtggtggcgggcgcctgtagtcccagctactcgggagactgaggcaggagaatggcgtgaacccgggaggcggagcttgcagtgagccgagatcgcgcccctgcactccagcctgggcgacagagcgagactccgcctcgaaaaaacaaaaacaaaaacacaaagtc

SEQ ID NO: 6750 - DNA, 296 bp, Homo sapiens
cggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtaagccgagattgcgccactgcagtccgcagtccggcctgggcgacagagcgagactccgtctcaaaaaaaaaaaaaaaaa

SEQ ID NO: 6751 - DNA, 278 bp, Homo sapiens
cctgtaatcccagcactttgggaggcctaggcgggtggatcacgaggtcaggagattgagaccatcctggctaacatggagaaaccctgtctctactaaaaatacaaaaaattagccgggcgtagtggcgggcgcctgtagtcccagcaactcgggaggttgaggcaggagaatggtgtgaacctgggaggtggagcttgtagtgagccgagatcgcgccactgcactctagcctgggcaacacagcgagactccgtctcaaaaaaaaaaaaaaaaga

SEQ ID NO: 6752 - DNA, 299 bp, Homo sapiens
ataggccaggcgcggtggctcacgcctgtaatcccagcactttgggaggccaaagcgggcggatcacgaggtcaggagatcgagaccatcctggctaacacggtgaaaccccgtctctactaaaaatacaaaaaattagcccgctgtggtggcgagcgcctgtagtcccagctacttgggaggctgaggcaggagaatggcatgaacccgggaggtggagcttgcagtgagccgagatcacaccaccgcactccagcctgggtgacagcacgagactccgtctcaaaaaaaagaaaaga

SEQ ID NO: 6753 - DNA, 1365 bp, Homo sapiens; identical to SEQ ID NO: 6734

SEQ ID NO: 6754 - DNA, 306 bp, Homo sapiens
tggggccgggcgcagtggctcacgcctgtaatcccagcactttgggaggccgaggcgggcggatcacgaggtcaggagatcgagaccgtcctggctaacacggtgaaaccctgtctctactaaaaatacaaaaaattagccgggtgtggtggtgggcacctgtagtcccagctactcagagaggctgaggcaggagaatggcgtgaacccgggaggcggagcttgcagtgagccgagatcgcgccaccgcactccagcctgggcgacagagtgagaatccgtctcaaaaaaaaaaaaaaaaagact

SEQ ID NO: 6755 - DNA, 1087 bp, Homo sapiens
ttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggggtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaactgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcc

SEQ ID NO: 6756 - DNA, 523 bp, Homo sapiens
agaaaatacaactggttgcttgcttttataggaattttccctggaggccacacgaaaccacttgtgcctcagaacaactcatgactgggggagtaaggacaagcagtatatccattggcttctttctgtgtctcgtttcttactggttaatgtctactcctggggtatttcacttttccacacttcttagttatgtttcctggcctctttgaggagctgctgggaagacagagctttaattggtcctgttagagttatgaacaggaatggtggtttgtctctcttttctgggaagatacataactccagaaactgtgagagtcttttctggggctacaagacaagtggctgaagccaggggtgaggtgagaggtgatagtgtggttggtgggtgtgcaagcagggccaagcaaattcaaggtggggcatattctaggacttacacaacagtctggaaataaatatgtattttagaatattgagattctaaactaagaatgatgtcttacgtaaaattacaaaa

SEQ ID NO: 6757 - DNA, 686 bp, Homo sapiens
ccatttcagtgtggccctcttcatccacaaagtggtttggaatgaaaaatgctaagatgcagtatttggctggcacttagataactaagaaaagagaattgacttaactgtagcaaagagagttgacgtgaggctcaagtcatcttagggctcctaggagaggatgagaatccattagcacctctatatctggggagaggggtgttgccaagaaggcctgttttgtaagtttgttttcattgacactgaatttaatttatatcttagaaactatccagagaagtctaaagttaaaagtttgagaactgcaatgtagtagtcaaagaggccacagcttggatgaaaaatttcagctgctatgattagagaaaaacacaaacaaattaaaaatcaatattgtctcccttttttcaagcccctgatcagtcagtagtcaccttgagaacccaaagggattgaatacagtggagaggatccaaaaacggaaccagacatgacctgtgaggcaggaagtacagcatgaacttttattgaaaacagctcaacagtgatatcattggctgacgatggaggaggctattttatatctctctggaatataagtttaaaaattacattactctgtaaacaacagaaacagtacaacaaaagtttctttaacaaccatacctatctgtaatacaggc

SEQ ID NO: 6758 - DNA, 98 bp, Homo sapiens
tagtagagacgaggtttcaccatgttggccaggctggtctcgaactcctgacctcaaatgatccacctgccttggcctcccaaagtactgggattaca

SEQ ID NO: 6759 - DNA, 2327 bp, Homo sapiens
gcctttttgtctgtctttatttacagcaaagtacataatatgtggtcactttgtaaccactaacaataaaggtagggtggtaaaaagaaaagggagaggagcaagcatcttaaaaggggggaaaaaaaagcctaagtctgtatttagctactcaccctgctcctgaggcaggactgggtaggcactccctgcctctaagaccacagccaagctgacctggaatgccagtccccggtatgaggaaggcagcagaacgcccagagacaaaagattaaaggggactgagctctggatgcatccacttatgctttgccagacagttcccttccttgttttgtttgaatgcttcccccaccccgccctgagcaaagtgtaaagggcaacggtggtacagaagtacaggcagtcccttccagaagcagtcctgaaccgcataacccacctacctagctgctcctcagcctgccgagttcttggccctggaatctttaacaggcacataggagattccagggcaggggaaaatatttccctgcaagaggctacttccctccaacagctgtgagggccagtgcaggtcaaggttgctaaatcaaggaaagtgcacaagggcaagagaggtcatatacaaaccaaccaggcttccggccctcctgctgcccgactgctccgaggtgtacacaagcctccagcccgacccagcggcctaatgaaactctggcaacctatcctgggcgtggccacaagtatccagctccaagcccaagtgaggcggggagtcaacttccccatgattgccaagtggccaagaccagaagcagggatgattaggctagttctgcggcaaggtgaactggagaccctgtctctgccctccttccctggcctgtcccacagacatcccgttgtttaacccactgcctttgcaaggacctgctctgtccactccaaatcaaaggatacttgcatccttcttacacagactcccatctctctgctcatagtggtcccaggctgcccgagaaaaagaaacttgggtcagtagaaggctcattagtgtgaaggagtgagaggccaggccttcctgtgacataatgcttctatgcttgtttcctaaacacttggtccacacacaatacctgggcaggaagagagaaccaagcaccactggatggctctggagccaggggacttctatgcacatacaaccaacatcaccccactctgctcatctgtgcctccaccctgaacagcagagtacctagatggcaaatgtcatggtttctggtccactaattctactcctgactctccatggaatcagagacccagaggctcttaaaaaactaagaccattgtttgttccatagaaagctcaagttcagatacagagttggccaaatgctgggctgccacggaggggtagagccttccatcccttccttgttccagaaacagtgtgtcacagaccccagcagacactgttcattgtccccagccaagccaccaagaattggtgatcatttgacaaggggcagggcagcccttatagctgtttccaagctaggagtgggctattcagagatattggaggcttggtcccaacaccacaggtagatgaggaagcagctaggtaaaggctcagagatgagaggagtccatcttccaaggcagtgggataaacagccaaggcactaaatggtttggcacctgggagcttcaagtaaagttgagcatgctgcccactgaaaagccaaggctctcccagacacgggtgggcttcacctgagcacagcccagtgccatcaaggccaggggccctgtgtcctcaggatactaacccaggcctgcattccctgcttcatctcagaactgatcaaggcatgactacaaggataatgattgatcctgaactgatcttggtgagcaccggctttcaaaggaggcatcttgggagccttcccttgctccaagtaggcggctgctgtgactgggagctcccttcagagcctgcacggtctcctgaaagtctccgggtggcaagctctgctggggaccaggtttgactttttaaaatagcaaaacagatttagagtcaaactgagcccagaaacggggaatcagactggatggtgctgagtctgggggaaaatctggtgtgaccaggtaataatggagaccaatttacctgaatggctcgaacaggctctgagagcaatgggaagaaaaggttctccaaaatgtttctggcaatggcagccacagtgggatagctaagggcacagtccaccaagcactagggtggtcaacaatgaaatgaacatctc

SEQ ID NO: 6760 - DNA, 685 bp, Homo sapiens
ccatttcagtgtggccctcttcatccacaaagtggtttggaatgaaaaatgctaagatgcagtatttggctggcacttagataactaagaaaagagaattgacttaactgtagcaaagagagttgacgtgaggctcaagtcatcttagggctcctaggagaggatgagaatccattagcacctctatatctggggagaggggtgttgccaagaaggcctgttttgtaagtttgttttcattgacactgaatttaatttatatcttagaaactatccagagaagtctaaagttaaaagtttgagaactgcaatgtagtagtcaaagaggccacagcttggatgaaaaatttcagctgctatgattagagaaaaacaaaaacaaattaaaaatcaatattgtctcccttttttcaagcccctgatcagtcagtagtcaccttgagaaccaaagggattgaatacagtggagaggatccaaaaacggaaccagacatgacctgtgaggcaggaagtacagcatgaacttttattgaaaacagctcaacagtgatatcattggctgacgatggaggaggctattttatatctctctggaatataagtttaaaaattacattactctgtaaacaacagaaacagtacaacaaaagtttctttaacaaccatacctatctgtaatacaggc

SEQ ID NO: 6761 - DNA, 98 bp, Homo sapiens; identical to SEQ ID NO: 6758

SEQ ID NO: 6762 - DNA, 126 bp, Homo sapiens
ttaagatttctaactacatttacttccttgacgaagcttcggccgtgcgtagactggtcagcttccggggtgactagagcagggctgtggtcactttcactggcatctgggtcctgtcgtaggatc

SEQ ID NO: 6763 - DNA, 3291 bp, Homo sapiens
tttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggattttgttcctcataaatggcatagttgaaagagcttatacactgcttacccagccaaatgctttgctttgaagtattgggttctgtgaaaatattgagcattgtacttaccttatctaggctgtgaaactgtcctacataccagagaatcataaaaacaaaaacctcactggcagcaagctgccgaataacaacagagtctagaggacatatttgtgggctgcacagatattttaggaatttcagaaattagaacaggagccaaaatgatttacattggcgttggcactgattcctttaaatggtctgggaaagggggttgggaagaggatggagctcaactggccagaagaggagcagctgcagtcctgatagcttctctagcctcggtcttttgagtgataagtagtcatgttgttttcatccagttggtttcttgtcattcccaagaagaatctcccaggccacatctttggggataactgacatactggattagccttttcaaaagaaaagtcatcctatttggttttatggggtgtgagttttgtgtgtacacacacagaaacatgtaaggtggtttgggtcatgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtgcccctcccgcaacactaccagtagactttagaaccatagttaactaagtcttttacctctgagatacttaattctgggaaaattggtgacaattttcaacttctaaataggtaactcgactgcaaaataatcaaaactgataacaatgaaactgcggctcttaaacaaagccatgcatgccgtgcatttgtattgaaatgtctccatgatatgaagccaaatattcaatgtaacatacttaatatccaaaggtggaaacaaaagaatgtagagatccagtgttaagagttccatttgcttcaattaattatttaccttcctgtggaataatatatatatatatatttaatagaaccatagatagactagtagaatttagattataaatgtgtgagtgcagattatcctgctattgcacaagctagaggggggaaaaatctcaattccagctggcaagatgctagccaggacacatataagaaagttgcactagattgaatggtcacagaatcggaggacatggaagaaaaaggaaacttcggtggttctgcagcagacatgggctaggtcatatgtggtttctatgagttcgtgtctcaaaaaaaaaaggagggggggcatctgtccccggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgttattggtagttctgtaaaggaaactgtggaatcgaattggcagtggagtcataaatctatttactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgacttatttatttactagctagaagctcttaagttcacttgtttatcagggcatatacagaagggtttgttaaaactcgatgttaactttacaactttctgacctggtgcatgaattctcaagtactgtatttcactgtgttggtgtgtctgatggaaatttcgaggtggtcccacaaaaatattttatgtagtgtgccttcaaagagaaccatttatttctcttcacttatcgtcccacaaagtcacatttggtggtggtcagccaagtcgcatctggtctagttttactcttgtcccaattttaaagagaaatgggaatgagtttgccctggtgagacccataccattgcaatgattatcttgagcacttaaagtccagtgttggctgttagtgtatttgatattctgcctgtctcctcatggttgaaatatgtctgaagaatagcagcataatctcttggctgtttatacttttttaaactttcctgtgttgtaaatattgtatacttttggtgattccagctatgtaacctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattgtacttattactgcttttgatactgtattacgtgccaatagtttcccaatcacatagcaggcaagagatattttgtactttttgatccactgtaatatttaataaaaaatgttactatctgtttccttt

SEQ ID NO: 6764 - DNA, 3291 bp, Homo sapiens; identical to SEQ ID NO: 6763

SEQ ID NO: 6765 - DNA, 92 bp, Homo sapiens
ctcactgcaacctccgcctcccaggttcaagcgattctcctgcctcagcctcctgagtagctgggattacaggtgcgtgccaccacgcccag

SEQ ID NO: 6766 - DNA, 7852 bp, Homo sapiens
agattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtgagttgctttgctccatagaaatacctctggaagacatgtgctgcctcgaggtccttctggagccctgaatccacagctgtgtccctgcacagttggatggcttgatgaagaaaccaagaaatctaagcttcacagttccccacatagttccccagttcctgaaagcctttcagcttgctcatgagatgaaatccaatgcctagtattgaatgagatagcccaggaatagaatctagaaagatacaaacatcctgtagaaaactgatagcaaatgctcaggcttcaagagaaaagggtccagagccacactaacatcaaagaattttactgtgaaaacatggcttcttggccgctccacagcccgtctatctgaggtgctggtgcgactttaaaacatattttggggctggacatggtggctcgcgcctgtaatcctagcactctgggaggccaaggcaggtggattgcttgagcccaggaattcaagaagagcgtgggcaacatggtgagacccagtctctacaaacaaagctcacacctgtaatcccagcactttgggaggctgaggcgggcggatcacaaggtcaggagatggagaccatcctggctaacacggtgaaaccccgtctctactaaaaatacaaaaaattagccaggtgtggtggtgggcgcctgtagtcccggctacttgggaggccaaggcaggagaatggcatgaacctgggaggcagagcttgcagtgagctgagatcacgacagcctgggtgacagagcaagactccatctcaaaaaaaaaaaaaaaaaaaaaatatcaggcatggtggtgccccgctgtggtcccagctactcaagaggctgaggtgggaggataaccagagccctgggaggtaaagtctgcagtgagctgtgattataccactgcactcctgcctgggtgacagagtgaagccgtgtctcaaaaaaaatgctttggaggtccaggaaaggggaccttggaactgtggtgctgtatcctgcaagactctcctgaaaactttagagaagtgtttgtctcccataattgatttctgtgcaacagccatgggttgagaccaatttaagaaaatcttaagtgtggccgggcgcggtggctcacgcctgtaatcccagcattttgggaggccgaggcggtggatcacgaggtcaggagatcgagagcatcctggttaatacggtaaaaccccgtctttactaaaaatacaaaaaattagccaggcgtggtggtgggcacctgtagtcccagctactcaggaggctgaggcaggagaatggcgtgaacccaggaggcggagcttgcagtgagccgagatcaggcccctgcactccagcctgggtgacagagagagactctatctcaaaaaaaaaaaaaaaaaaaaggaaaaaagatcttaagtgcatattatttataggggaattttgaaatggttcctatgaaaccattattatttttcatattaacaggtagtttctgcactttttaagcccccaacagccttttggtagaagccattacccccagcatgtagccagtcatgtaggctgatctgggctccatttcaacatgaataataaaaaacgctgctgcccattaaaaaaaaaaaaaaactgagcagccacatttggagacagcatgttctaggattcaaccccagagggaattttgatgctgatattaaataccccctaaaaaatcaggtttataatgaacacataagaggctccataattaaacactggtttaaattgcacatgtacaacacgcaccaacctcccatctagacatcaacttacccagctgactcttacataagaaaatagtattgataccaagattagaaatttgtgggttttttgtttttattaggtttcataattattttaagctctagtaactaaaaagggggaggaggaagaagatgatgcagattttttttttttttgagacagagtctctctctgtctcccaggctagagtgcagtggtgcaatctcggttcattgcaacctccgcctcccaggttcaagcaattctcctgcctcagcctcccgagtagctaggactacaggcatgcaccaccacacccggttaatatttttgtatctttagtagagacagggtttcaccatgttggtcaggctggtcttgaactcctgacctcaaatgatcctcctgccttggcctcccaacgtgctgagattacaggtgtgagccaccgtccctggccagatgatgcagatttctcaacatctgcaagcttgcaacataaatggccaaaagcaaggaaattccaagtgcatgcttacattccatttttccttgatacttttggcctggtgatttattatagggtttcagatgagtgtgttctattagctgccatatgtacacaaaacaccaggggacaaactgaggaccaaggggacagctgaccgttgaatatctccaatttggggattaagtttgaaatggttggtttgtgaatggtaggaggaatctttagcctatgcactgagcctgtcagcttggatgatgaccatgcccaagagtggagccttactccctggagtccatagaaaccctgaaagctgttaggctttgtgtttcctgtaggctgcaactgttcccttcagggagctgtaagtgtctcaggttttgaaagttgtcatgatgaggttatctaaacctcatggaatcttccaccctctccaaggttgaccttataatacgaatcacttctcacctccaacatagaaccatgttattagccaggtgtattttttctcattaactctatttggggtttttggtttggattttattgttttcatcgcttttagtttttggtgttttcaatatgaagcggtgaactcaatggagatacaaagggtgagaaattccctctagttgaatccactatattcaagtaatgggattgcaagttgcatggtgggaagctaacatttaacatactaagcagatcataaaatgtcttactagaaaaaaagtcctttacttttttctgcctagctttcaaagacttcctaaacctgttttacaacccgaagcatgggactctgatataactgcagttctacatcatagaaacttcaatgagactgagtatccctcattgccctgcgtcaaactatagccccataagaaactaacaattagatgcaatttgcctttttcccttgccatactcatttgtctttatttttgtgtcatgtataagctcaagagaccaatgtgatgattattaatgtagaagaagtaatgatatttgtactggaaaaggcagctactagtacaaaaaataaaaagaaataatgatgataagcaaagtctcttaggtataacatgtccctaaaattcagggttttttttttaaagggatttaaggaaaaatacctgtgaaataggtgtgatttcttaaaacttttgttcccacgtattcctaaaccagcatcctcaatcttacccaaagatgctaattggcagacccacccttccttccttcctgcctgcctgccttccttccttcctttcttccttccttccttccctccctccttccttctttttcttttttttttttttttttgtgaaagttacactcttgttgcccaagctatagtgcaatggcatgatctcggctcaccgcatcctccacctctggggttcaagcgattctcctgcctcagcctcctgagtagctgggattacaggcacccaccaccacacctggctaatttttgtttttttactagagatgaggttttgccatgttgaccaggctggtcttgaactcctgacctcaggtgatctgcctgcctcggcctccctaagtgctgagattacaggcacatcttttcttaacagagaagaacaaagttcaagggatgagatggaaaaaggaggggaagaataccagctcagtacaactgttttgtgactgctctgctaagacatgtcagggcagaatgacagcagttttgaaagggcttgtcagtcagctgggtcatagatggaaagttaaaatgacctcctaaggtcaaagtttatatggctgcataatgcagtaaatgagtcgaattggtacccacaacttctgtcagtagggtcacataaggagtgtgtctgtctcattgactataatttatttcattcaacagcaaagctatatttgcggtggcactgactgtctgaattttgacaacttcattttgggctttaatagaaatgtagtttgctgcaacctagaaggacttagtctcctctgtccctctggtagacaggctgccaagaaatcttcatactttgtcaatattttagcattatctgcatatcatctggccctgagtagaaattattaacacttatgcattgctaatcttcagtgcatcatattgaatacattgggaagggatttgccctgttaaggaaagcagggagttgcaataggtttgttgtttgtcgttaacatggggttggttggatttttgaaagagaaatgctttaaaaaaatctttctcaggagtatcataaaacacaacatgtaatttaaaacccatttggataattgactgatttgacaagaagacaaccttagaattaaactatatattagaatcaaggagtgatatgattgtataccatcagtacataatactttgctattttgataggtatctcataagggactgaagcgaatatgcatatttcccctaatgtttctgtaatttagatttctttgtttagagccatgattggggagtaataaagctttacagaaacttcacgagctgattgacaagcctgttttcaagtaaaactgctgtgtggaatattttatttcatagcaaaacatgtctgtgtatttggttttcttctgactgtcttttgaaatatgttaccaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggcccaccaagcttcactccttacccaggaggtgctgggcttatagagttagaagtcagtttttcttctaatctgagggtaagatcagtcccagcgtagggggccagaagggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgtt

SEQ ID NO: 6767 - DNA, 7851 bp, Homo sapiens
agattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtgagttgctttgctccatagaaatacctctggaagacatgtgctgcctcgaggtccttctggagccctgaatccacagctgtgtccctgcacagttggatggcttgatgaagaaaccaagaaatctaagcttcacagttccccacatagttccccagttcctgaaagcctttcagcttgctcatgagatgaaatccaatgcctagtattgaatgagatagcccaggaatagaatctagaaagatacaaacatcctgtagaaaactgatagcaaatgctcaggcttcaagagaaaagggtccagagccacactaacatcaaagaattttactgtgaaaacatggcttcttggccgctccacagcccgtctatctgaggtgctggtgcgactttaaaacatattttggggctggacatggtggctcgcgcctgtaatcctagcactctgggaggccaaggcaggtggattgcttgagcccaggaattcaagaagagcgtgggcaacatggtgagacccagtctctacaaacaaagctcacacctgtaatcccagcactttgggaggctgaggcgggcggatcacaaggtcaggagatggagaccatcctggctaacacggtgaaaccccgtctctactaaaaatacaaaaaattagccaggtgtggtggtgggcgcctgtagtcccggctacttgggaggccaaggcaggagaatggcatgaacctgggaggcagagcttgcagtgagctgagatcacgacagcctgggtgacagagcaagactccatctcaaaaaaaaaaaaaaaaaaaaaatatcaggcatggtggtgccccgctgtggtcccagctactcaagaggctgaggtgggaggataaccagagccctgggaggtaaagtctgcagtgagctgtgattataccactgcactcctgcctgggtgacagagtgaagccgtgtctcaaaaaaaatgctttggaggtccaggaaaggggaccttggaactgtggtgctgtatcctgcaagactctcctgaaaactttagagaagtgtttgtctcccataattgatttctgtgcaacagccatgggttgagaccaatttaagaaaatcttaagtgtggccgggcgcggtggctcacgcctgtaatcccagcattttgggaggccgaggcggtggatcacgaggtcaggagatcgagagcatcctggctaatacggtaaaaccccgtctctactaaaaatacaaaaaattagccaggcgtggtggtgggcacctgtagtcccagctactcaggaggctgaggcaggagaatggcgtgaacccaggaggcggagcttgcagtgagccgagatcaggccactgcactccagcctgggtgacagagagagactctatctcaaaaaaaaaaaaaaaaaaaaggaaaaaagatcttaagtgcatattatttataggggaattttgaaatggttcctatgaaaccattattatttttcatattaacaggtagtttctgcactttttaagcccccaacagccttttggtagaagccattacccccagcatgtagccagtcatgtaggctgatctgggctccatttcaacatgaataataaaaaacgctgctgcccattaaaaaaaaaaaaaaactgagcagccacatttggagacagcatgttctaggattcaaccccagagggaattttgatgctgatattaaataccccctaaaaaatcaggtttataatgaacacataagaggctccataattaaacactggtttaaattgcacatgtacaacacgcaccaacctcccatctagacatcaacttacccagctgactcttacataagaaaatagtattgataccaagattagaaatttgtgggttttttgtttttattaggtttcataattattttaagctctagtaactaaaaagggggaggaggaagaagatgatgcagattttttttttttttgagacagagtctctctctgtctcccaggctagagtgcagtggtgcaatctcggttcattgcaacctccgcctcccaggttcaagcaattctcctgcctcagcctcccgagtagctaggactacaggcatgcaccaccacacccggttaatatttttgtatctttagtagagacagggtttcaccatgttggtcaggctggtcttgaactcctgacctcaaatgatcctcctgccttggcctcccaacgtgctgagattacaggtgtgagccaccgtccctggccagatgatgcagatttctcaacatctgcaagcttgcaacataaatggccaaaagcaaggaaattccaagtgcatgcttacattccatttttccttgatacttttggcctggtgatttattatagggtttcagatgagtgtgttctattagctgccatatgtacacaaaacaccaggggacaaactgaggaccaaggggacagctgaccgttgaatatctccaatttggggattaagtttgaaatggttggtttgtgaatggtaggaggaatctttagcctatgcactgagcctgtcagcttggatgatgaccatgcccaagagtggagccttactccctggagtccatagaaaccctgaaagctgttaggctttgtgtttcctgtaggctgcaactgttcccttcagggagctgtaagtgtctcaggttttgaaagttgtcatgatgaggttatctaaacctcatggaatcttccaccctctccaaggttgaccttataatacgaatcacttctcacctccaacatagaaccatgttattagccaggtgtattttttctcattaactctatttggggtttttggtttggattttattgttttcatcgcttttagtttttggtgttttcaatatgaagcggtgaactcaatggagatacaaagggtgagaaattccctctagttgaatccactatattcaagtaatgggattgcaagttgcatggtgggaagctaacatttaacatactaagcagatcataaaatgtcttactagaaaaaaagtcctttacttttttctgcctagctttcaaagacttcctaaacctgttttacaacccgaagcatgggactctgatataactgcagttctacatcatagaaacttcaatgagactgagtatccctcattgccctgcgtcaaactatagccccataagaaactaacaattagatgcaatttgcctttttcccttgccatactcatttgtctttatttttgtgtcatgtataagctcaagagaccaatgtgatgattattaatgtagaagaagtaatgatatttgtactggaaaaggcagctactagtacaaaaaataaaaagaaataatgatgataagcaaagtctcttaggtataacatgtccctaaaattcagggttttttttttaaagggatttaaggaaaaatacctgtgaaataggtgtgatttcttaaaacttttgttcccacgtattcctaaaccagcatcctcaatcttacccaaagatgctaattggcagacccacccttccttccttcctgcctgcctgccttccttccttcctttcttccttccttccttccctccctccttccttctttttcttttttttttttttttttgtgaaagttacactcttgttgcccaagctatagtgcaatggcatgatctcggctcaccgcatcctccacctctggggttcaagcgattctcctgcctcagcctcctgagtagctgggattacaggcacccaccaccacacctggctaatttttgtttttttactagagatgaggttttgccatgttgaccaggctggtcttgaactcctgacctcaggtgatctgcctgcctcggcctccctaagtgctgagattacaggcacatcttttcttaacagagaagaacaaagttcaagggatgagatggaaaaaggaggggaagaataccagctcagtacaactgttttgtgactgctctgctaagacatgtcagggcagaatgacagcagttttgaaagggcttgtcagtcagctgggtcatagatggaaagttaaaatgacctcctaaggtcaaagtttatatggctgcataatgcagtaaatgagtcgaattggtacccacaacttctgtcagtagggtcacataaggagtgtgtctgtctcattgactataatttatttcattcaacagcaaagctatatttgcggtggcactgactgtctgaattttgacaacttcattttgggctttaatagaaatgtagtttgctgcaacctagaaggacttagtctcctctgtccctctggtagacaggctgccaagaaatcttcatactttgtcaatattttagcattatctgcatatcatctggccctgagtagaaattattaacacttatgcattgctaatcttcagtgcatcatattgaatacattgggaagggatttgccctgttaaggaaagcagggagttgcaataggtttgttgtttgtcgttaacatggggttggttggatttttgaaagagaaatgctttaaaaaaatctttctcaggagtatcataaaacacaacatgtaatttaaaacccatttggataattgactgatttgacaagaagacaaccttagaattaaactatatattagaatcaaggagtgatatgattgtataccatcagtacataatactttgctattttgataggtatctcataagggactgaagcgaatatgcatatttcccctaatgtttctgtaatttagatttctttgtttagagccatgattggggagtaataaagctttacagaaacttcacgagctgattgacaagcctgttttcaagtaaaactgctgtgtggaatattttatttcatagcaaaacatgtctgtgtatttggttttcttctgactgtcttttgaaatatgttaccaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatggctccccaccccctttgatcagcaaaaagaaactgattgctagggatgacttgtgttccagtttgtcccagacccaccatggccaaagcactgaccatatggcggtcagccggccatcagtgattcagcacgtccagagtttcagaagcaagccctcggaagagagaaagaccatcaatgacatctttaagcatgagaaactgagtcgatcagatccccaccgctgcagcttctccaagcatcaccttaacccccttgctgactcctacgtcctgaagcaagaaattcaggagggcaaggataaactcttagagaaaagggccctcccccattcccacatgcctagcttcctggctgacttctactcgtcccctcatctccatagcctctacagacacaccgagcaccatcttcataatgaacagacatccaaatacccttccagggacatgtacagggaatcggaaaacagttcttttccttcccacagacaccaagaaaagctccatgtaaattatctcacgtccctgcacctgcaagacaaaaagtcggcggcagcagaagcccctacggatgatcagcctacagatctgagccttcccaagaacccgcacaaacctaccggcaaggtcctgggcctggctcattccaccacagggccccaggagagcaaaggcatctcccagttccaggtcttaggcagccagagtcgagactgtcaccccaaagcctgtcgggtatcacccatgaccatgtcaggccctaaaaaataccctgaatcgctttcaagatcaggaaaacctcaccatgtgagactggagaatttcaggaagatggaaggcatggtccacccaatcctgcaccggaaaatgagcccgcagaacattggggcggcgcggccgatcaagcgcagcctggaggatttggaccttgtgattgcagggaaaaaggcccgggcagtgtctcccttagacccatccaaggaggtctctgggaaggagaaggcctctgagcaggagagtgaaggcagcaaagcagcgcacggtgggcattccgggggcggatcagaaggccacaagcttcccctctcctcccctatcttcccaggtctgtattccgggagcctgtgtaactcgggcctcaactccaggctcccggctgggtattctcattctctgcagtacttgaaaaaccagactgtgctttctccactcatgcagcccctggctttccactcgcttgtgatgcaaagaggaatttttacatcaccgacaaattctcagcagctgtacagacacttggctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgtt

SEQ ID NO: 6768 - DNA, 3291 bp, Homo sapiens; identical to SEQ ID NO: 6763

SEQ ID NO: 6769 - DNA, 3291 bp, Homo sapiens; identical to SEQ ID NO: 6763

SEQ ID NO: 6770 - DNA, 92 bp, Homo sapiens; identical to SEQ ID NO: 6765

SEQ ID NO: 6771 - DNA, 7852 bp, Homo sapiens; identical to SEQ ID NO: 6766

SEQ ID NO: 6772 - DNA, 7851 bp, Homo sapiens; identical to SEQ ID NO: 6767

SEQ ID NO: 6773 - DNA, 10558 bp, Homo sapiens
gccatggttgcttgttatccgggcaatggaacgggttatgtacgtcatgttgataatccaaatggagatggaagatgtgtgacatgtatatattatcttaataaagactgggatgccaaggtatgcaacttaattgagcatttatttttttcttacaggtgtctttttctcaaaagcattaagtttcatacttctgataagactgtcacagacacagttaaaaattttcctcttaaatttgtttcagtctcaggtattaggagtggatttttgtaaaatgaaacaaatactactctatgttatacaacatgatacctgtagttaacaacgtagtgttgtgcacttaaaaatttaagagggtagactccatgttcagtgttctaaacacacacacatacacacacacacacacacacacacacgcacacacgaggttaggggaagggaaacggaactttgagaggtgatggatatgtttattaccttggttgtggtgtgtcatgagggtgtgcgtatatatccaaactcatcaaattgtaaatgttaaagatatgcatttttgtatatcagttatacctcaaaaccatataaaaaagtactgatatatcttaaaaagtggattcatttattttcagatgttagagcacttatctaaaatctaacttttttagaaaggtgacctttattaaaatattttccttttaatagtttttagaaaaacatttctgagaacagttgttttataatggcttttgggggagattatctatggataattgttaaggattatttgctatgttattcttggcatttttgtaaaaatattatatggcattgagttgtttaattgaatattggaggcaggattcagtctttccctgattattaaaaaactggaagtttatcagtactgacaagccctgtaaaaccaattagaatgtacaatatatttaatctctcttgttttaaatatatatttccttaatattagcctgagtctcattaaatttaaatgatttttaaaaaatatgtcatatattactacactagagactgtacagactaattttttggttgattttttaaaatcttaagtataacattcaaatagaaaagtggcttgtatagttcagtggattttcacaaagtgaacatacctgtgtagccagggtgcctttttttgttgtttttaagtcaaataacctttaaaaaacctctttctctgcatcccccaaaacacacaaatggaaactgcctgagtcttaaatgtgcaaaaacctaatcctgccctaaaaagtgttttaagtttagaatatgctcacagtgcttcactaatctttctaaaacacactgatttaaagagttttctctgccctagtccaggttcaaaatggagctgacctttctgctgagtatatattgaggcatgtcaacaagcatggtttttctgttacagctttcaaagtttgaagtagagaaataaattttgtaattgaatttgagcccaaggcacaaaacagatgggtgtaactttagttaaaatttaaaaattgactttttttcagattttgtgaatagctagaaagctagaactgtgtttcatcagcttctaacttctagattttgttaggctttttctaggctgatcttataatttctataatacttagtcagggtcattaatgtgtaggttttaaattaggacataggcagagaaacgtccctagtgtttttgtgtgtagaatagaaattttccatgctagattgcactgaatatgtagtgtgtcagttgttctggatgctagggatgtagcagaaacggaattagccctggcagagcttaggatctattggaggatacagatcagaaagattgacagttacagatagttatgcaaagtgtcaagacagattgctatggagcacacaggagggccacctaattcagaggaggaagagtggaagtgtcaagtagccatttcacttaaaacattttcagcaggtcacctgtggtactcccaatgacttgagtcaaagggaagggagcaggaaaaaaggaaagaagacatgttctcagtttggaggttctttagatgtttgcatagtagcctggggaatcactctgaacaacactggaacctgaggaaggttggcaagggtatcaaagtagctagaatttaacttacctgacagtgagcctgataaaccttttctttaactatagattctaggtttaggctcaaacgccatgttgtcctgaccaggtgttagagtttctttaaattttaagagtctacctgcttaggagtgtagttattcaagagtaaggagctacttggttggttgggttttgcctatccccagatcgtaaaccccgcaaggacaaagtctgtctgcattattccctactctgcacccagagcccaccacagttcccagtgcgatttgatgcctagttggtgtttaggtaaataataatcctttatgggtagaatcaagtttcacaagcaggtagtcatctgtgcatcaggcccagtctggaaagggagagccacaggttctaatgaactatatgctgatggtgatggtgacgacgacaataatgatggtcataataaatgatgacactttctactgatatactgaattatttaagtaagaggtatttgtgactatcctattgtttattgaattttaaagtatggtaaactatttgacataatttatttctaataataattttgtcaaaatttcttgaaatctatctatttgaagggtgggttaagcaaatcattaacatacaaaaataaacgtttagtagttttaaaagctttcaagcatcattttaagacttttaaattcagataacattcttgtgtttcatcagatatttataaaaatccctaaaatggctggggacagtggctcacacctgtaataccagcactttgggaggccgaggtgggcagatcacctgaggtcaggagttcgagtccagcctggccaacatggtgaaaacccatctctactaaaaatgcaaaaattagctggacatggtggcgcatgcctgtaatcccagctactcgcgatgctgagacaggagaattgcttgaacctaggaggcggaggttgcagtgagctgagattgtgccactgcactccagcctgggtgacagcgagactccatctcaataaataaataaatatccctaaaataagaactaaatttgtccttgcatcagtgcatatacttttaaaattgcagctcatcttcatactttattgagacgtatttgtgaataatccaattaagacattgaaattgtctctttttttccccctaaatttaatcttgtagcatttttggttactcctgcttacatatttggctcttttcctaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtagtattccttttcagaaaaaattggtttagagtatggtaggacaggagggaatctgtagagtaaacgtgaaagctttctaatgagtattttcctgccaggtacttttcacagtcattttaatttgaataattgtataagatttatgttgcacagtcatctgaattcaaataattatataagactcattaacagttagtactaaatgtgtctttctttgcacagccactctgaagaaagggaagcacaggccttcccatctttctagcactctctccgtgctttgtgcatctcttaactactatccatgctttgatttttgtaagagtattttacttgggagagagaaagatcaagaaggaaaagggttttttaaaaggtggtgagggacaacataggaaaatggatacagagtagaaaaatcagaggtaaccagagagtagaagtgaagagaaaaacagaagaaagaaaagtagagaacaggttaccatgtgtgggagttaatgttagaaaaatgatcctattagctttacaaataatgagcatctgtttcattatactttttctacaaggtatttgcaacctattatatttagtgctttatttcaaatgcttttttaaaaaccatttatcctgactcaattaaaatgctctggctgtgaaaacaagatattgtagacattatcatgaaagtaaatatttgtagaaaaatagcacattaaaaaaaaatacttattttttattatggaaaggtcttggaacattctgatagtgagcttccggcattcatttgctgtatctggcttaggagatgctagggtggcaagaagaggcacaggcttagatgcgctgggtggagagttggctttagtaatgatggttgactctaacgacttgattatcagctgtgccttttttcttcctgccttctgaggtgtgttgcctgcatcctaattcacgtactgagtagcaagctaagcaggttgtagctggagattgtaagaaatcctgaatggaaaccaaagaaagactgtcacatcacatgatgtgcccttttcaatcccatgtctcttcccagtggcatcccagtgctgtctctgccccctgctgcttctgtaaagattttctgacacagtaactgcctcatagaccttcctttttatgaaatcctgagtttggtttggttacgtcctttttagatgaataaataacagatacttgggagtttatagtaaataaatgccagatggcatggaggctaagtgctacaggagttgaggaacgaaggtggtgctacattggagagacgggcaagtgcgctttgaagggagaggctcagctggcctaggtgaggagaggcaaggggtgcagtcgtgttagtaaagttctgggggaaaaggcgtagttgttcaagttaaggcatggaaaatcatgcgacgaaaaggattcttgaagtagaatcctattctgatcttatctagaatgggtgataaggctggaaagttagaatgacataaggtaagttgttgatccagatattagaattctgattgctaagtgactaaaagtttagggcatgggcaaaagatacataaaattatgtatctgagccctttcctatttccaaggccacccaaaagtagaagaagccacatggtaagaaaggtagtggaactctggaaagagcagagtctggtctggaagtcaggagacctccttagacctcagctctgtgattcaccagtggtggggtctgtaaacgtcaggctcccagttgtccaaactcccagactctttacttcaaaatacattatgtgatttttcattctgtcatattactggctgtatgtctgataaatgttgccttttcccctgtgtccactggccacaatccacaatatatttgaactaattgctatattctgcccaggaactggtgatttgtagcgtactttcacttcctatagcgtttatacattttccccattatttgtatcagaaagtatgtcttttgtagtatttaataaactagagatgcctcacttattggtggaatgaaatattctaagtcagattttcagaaaaatgaagtttagacaaagtttaaacacaaaacacagtataattgctttgattaaaatccttaaaaattcttagcataatttaactgtcaaggttataattgtaaacatccatcattactctttgctataatgtagtgatgtccccagagactgttgaaactgttagcctgcaatgccctgagtccttttatctgtttcttttctgttcttttagtacttgtgctattgataatgtgctttttctgtaacagccattcttttacccttttattgtctctctttttttttagagggaggctcactctgtcacctaggctggagtgcagtggcatgatctcggctcactgcaacctccgcctccccgggttcaagcgattctcctgcctctcagcctcctgagtagctagggctacaggcatgtgccaccatgcacggctaattttttttttcttttttttagtagagatggggtttcaccctattggccaggttggtctcgaagtcctgacttcatgatccacccacttcggcctcccgaagtgctgggattacaggcgtgagccactgtgcccggcctattgtctctttctgatctgcagttcccttgcaaaaaataagtagttgaaataagtattaagaaagtcacaaaaactcatcaacttcagacatcaattttagtctcccctggttactgtataaataagctgttaaatttatcctttgatatcattccagtttaggcataattttggcattacaagttttaatataccattgcagcaaaataccactttttccccgcagtgtgatcattcttatcctattctaaattttcttttaggtacgcaataactgtttggtattttgatgcagatgagagagcacgagctaaagtaaaatatctaacaggtaaacgtcatttggggccaggatatattggtacagaaataccctgcaatcaggtgatgctttcaggaaactcaagcatagtctttgttaacaccatgaatacttactttttgttttttatcagatttcttatttgcctcattttttaagaagacataagtcatcttcactgttatctttaaccaaaaaaattgtcaaaggatgtggaaaatttgaggcaaagaagtctgagtaaattattcacatacaaactgagttttctgtgattatccttttcagtcaaaggccacttaactctaggtaacggccatatggtttcctctcattcactccttaaattaataccctttccttttcaaatggatgtgctctaaacagtactctaggtcttccatgttaaatgtagacatgaagaaaattaatacaaagaattatgaattcaaatgccaaaatcagtaaatgacacagacatgtagattccatatctgctaatggtgtacataggtcagcactcttgtactgaacctgaagatcctttaattatgccagttccccttctcttccacttatggactgcctctccaagagcagggggtctgtttcccatctgatggaccacttaccttcttttctttaactctactttctatctccaaaaatccactgagtattcacattactgattagctgtgttttccagagccattgctaatcgcacgtcgaccttacataaaaatggaatattcatgcattttctatgtatttttaaagccattatttgtggcacaagctcagtgtgctttcagagacactgaacactctgttgaagaaactcaaatggcttttaaaataaaaagacaaaatcattatctctgtgtagaggatggttttatccttgaaggtttactatttgaaacctcatcacaatagaatgctgagggaagtttttggaagtacaagcgtgatagttctcagatgatgtttgcaaagttgaaatattgtccatactcttaggaattcagtggaatgcagtagcagaagctctctggtgcttagtgaatgaatgaaaattttttttttttttaccttgcaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattatggtggttatttccagctgtcttttttgtttttcaatcctttatcatacattggctttccgaatgatccctttcatcagataaagcttttctggcttagtctaggacatttgttataactttttgtaaatgataatgaaggaaagagaacagtaaacataggagttcaacaattttagaaacatccctggggtcattggactgtctgtg

SEQ ID NO: 6774 - DNA, 10554 bp, Homo sapiens
gccatggttgcttgttatccgggcaatggaacgggttatgtacgtcatgttgataatccaaatggagatggaagatgtgtgacatgtatatattatcttaataaagactgggatgccaaggtatgcaacttaattgagcatttatttttttcttacaggtgtctttttctcaaaagcattaagtttcatacttctgataagactgtcacagacacagttaaaaattttcctcttaaatttgtttcagtctcaggtattaggagtggatttttgtaaaatgaaacaaatactactctatgttatacaacatgatacctgtagttaacaacgtagtgttgtgcacttaaaaatttaagagggtagactccatgttcagtgttctaaacacacacacatacacacacacacacacacacacacgcacacacgaggttaggggaagggaaacggaactttgagaggtgatggatatgtttattaccttggttgtggtgtgtcatgagggtgtgcgtatatatccaaactcatcaaattgtaaatgttaaagatatgcatttttgtatatcagttatacctcaaaaccatataaaaaagtactgatatatcttaaaaagtggattcatttattttcagatgttagagcacttatctaaaatctaacttttttagaaaggtgacctttattaaaatattttccttttaatagtttttagaaaaacatttctgagaacagttgttttataatggcttttgggggagattatctatggataattgttaaggattatttgctatgttattcttggcatttttgtaaaaatattatatggcattgagttgtttaattgaatattggaggcaggattcagtctttccctgattattaaaaaactggaagtttatcagtactgacaagccctgtaaaaccaattagaatgtacaatatatttaatctctcttgttttaaatatatatttccttaatattagcctgagtctcattaaatttaaatgatttttaaaaaatatgtcatatattactacactagagactgtacagactaattttttggttgattttttaaaatcttaagtataacattcaaatagaaaagtggcttgtatagttcagtggattttcacaaagtgaacatacctgtgtagccagggtgcctttttttgttgtttttaagtcaaataacctttaaaaaacctctttctctgcatcccccaaaacacacaaatggaaactgcctgagtcttaaatgtgcaaaaacctaatcctgccctaaaaagtgttttaagtttagaatatgctcacagtgcttcactaatctttctaaaacacactgatttaaagagttttctctgccctagtccaggttcaaaatggagctgacctttctgctgagtatatattgaggcatgtcaacaagcatggtttttctgttacagctttcaaagtttgaagtagagaaataaattttgtaattgaatttgagcccaaggcacaaaacagatgggtgtaactttagttaaaatttaaaaattgactttttttcagattttgtgaatagctagaaagctagaactgtgtttcatcagcttctaacttctagattttgttaggctttttctaggctgatcttataatttctataatacttagtcagggtcattaatgtgtaggttttaaattaggacataggcagagaaacgtccctagtgtttttgtgtgtagaatagaaattttccatgctagattgcactgaatatgtagtgtgtcagttgttctggatgctagggatgtagcagaaacggaattagccctggcagagcttaggatctattggaggatacagatcagaaagattgacagttacagatagttatgcaaagtgtcaagacagattgctatggagcacacaggagggccacctaattcagaggaggaagagtggaagtgtcaagtagccatttcacttaaaacattttcagcaggtcacctgtggtactcccaatgacttgagtcaaagggaagggagcaggaaaaaaggaaagaagacatgttctcagtttggaggttctttagatgtttgcatagtagcctggggaatcactctgaacaacactggaacctgaggaaggttggcaagggtatcaaagtagctagaatttaacttacctgacagtgagcctgataaaccttttctttaactatagattctaggtttaggctcaaacgccatgttgtcctgaccaggtgttagagtttctttaaattttaagagtctacctgcttaggagtgtagttattcaagagtaaggagctacttggttggttgggttttgcctatccccagatcgtaaaccccgcaaggacaaagtctgtctgcattattccctactctgcacccagagcccaccacagttcccagtgcgatttgatgcctagttggtgtttaggtaaataataatcctttatgggtagaatcaagtttcacaagcaggtagtcatctgtgcatcaggcccagtctggaaagggagagccacaggttctaatgaactatatgctgatggtgatggtgacgacgacaataatgatggtcataataaatgatgacactttctactgatatactgaattatttaagtaagaggtatttgtgactatcctattgtttattgaattttaaagtatggtaaactatttgacataatttatttctaataataattttgtcaaaatttcttgaaatctatctatttgaagggtgggttaagcaaatcattaacatacaaaaataaacgtttagtagttttaaaagctttcaagcatcattttaagacttttaaattcagataacattcttgtgtttcatcagatatttataaaaatccctaaaatggctggggacagtggctcacacctgtaataccagcactttgggaggccgaggtgggcagatcacctgaggtcaggagttcgagtccagcctggccaacatggtgaaaacccatctctactaaaaatgcaaaaattagctggacatggtggcgcatgcctgtaatcccagctactcgcgatgctgagacaggagaattgcttgaacctaggaggcggaggttgcagtgagctgagattgtgccactgcactccagcctgggtgacagcgagactccatctcaataaataaataaatatccctaaaataagaactaaatttgtccttgcatcagtgcatatacttttaaaattgcagctcatcttcatactttattgagacgtatttgtgaataatccaattaagacattgaaattgtctctttttttccccctaaatttaatcttgtagcatttttggttactcctgcttacatatttggctcttttcctaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtagtattccttttcagaaaaaattggtttagagtatggtaggacaggagggaatctgtagagtaaacgtgaaagctttctaatgagtattttcctgccaggtacttttcacagtcattttaatttgaataattgtataagatttatgttgcacagtcatctgaattcaaataattatataagactcattaacagttagtactaaatgtgtctttctttgcacagccactctgaagaaagggaagcacaggccttcccatctttctagcactctctccgtgctttgtgcatctcttaactactatccatgctttgatttttgtaagagtattttacttgggagagagaaagatcaagaaggaaaagggttttttaaaaggtggtgagggacaacataggaaaatggatacagagtagaaaaatcagaggtaaccagagagtagaagtgaagagaaaaacagaagaaagaaaagtagagaacaggttaccatgtgtgggagttaatgttagaaaaatgatcctattagctttacaaataatgagcatctgtttcattatactttttctacaaggtatttgcaacctattatatttagtgctttatttcaaatgcttttttaaaaaccatttatcctgactcaattaaaatgctctggctgtgaaaacaagatattgtagacattatcatgaaagtaaatatttgtagaaaaatagcacattaaaaaaaaatacttattttttattatggaaaggtcttggaacattctgatagtgagcttccggcattcatttgctgtatctggcttaggagatgctagggtggcaagaagaggcacaggcttagatgcgctgggtggagagttggctttagtaatgatggttgactctaacgacttgattatcagctgtgccttttttcttcctgccttctgaggtgtgttgcctgcatcctaattcacgtactgagtagcaagctaagcaggttgtagctggagattgtaagaaatcctgaatggaaaccaaagaaagactgtcacatcacatgatgtgcccttttcaatcccatgtctcttcccagtggcatcccagtgctgtctctgccccctgctgcttctgtaaagattttctgacacagtaactgcctcatagaccttcctttttatgaaatcctgagtttggtttggttacgtcctttttagatgaataaataacagatacttgggagtttatagtaaataaatgccagatggcatggaggctaagtgctacaggagttgaggaacgaaggtggtgctacattggagagacgggcaagtgcgctttgaagggagaggctcagctggcctaggtgaggagaggcaaggggtgcagtcgtgttagtaaagttctgggggaaaaggcgtagttgttcaagttaaggcatggaaaatcatgcgacgaaaaggattcttgaagtagaatcctattctgatcttatctagaatgggtgataaggctggaaagttagaatgacataaggtaagttgttgatccagatattagaattctgattgctaagtgactaaaagtttagggcatgggcaaaagatacataaaattatgtatctgagccctttcctatttccaaggccacccaaaagtagaagaagccacatggtaagaaaggtagtggaactctggaaagagcagagtctggtctggaagtcaggagacctccttagacctcagctctgtgattcaccagtggtggggtctgtaaacgtcaggctcccagttgtccaaactcccagactctttacttcaaaatacattatgtgatttttcattctgtcatattactggctgtatgtctgataaatgttgccttttcccctgtgtccactggccacaatccacaatatatttgaactaattgctatattctgcccaggaactggtgatttgtagcgtactttcacttcctatagcgtttatacattttccccattatttgtatcagaaagtatgtcttttgtagtatttaataaactagagatgcctcacttattggtggaatgaaatattctaagtcagattttcagaaaaatgaagtttagacaaagtttaaacacaaaacacagtataattgctttgattaaaatccttaaaaattcttagcataatttaactgtcaaggttataattgtaaacatccatcattactctttgctataatgtagtgatgtccccagagactgttgaaactgttagcctgcaatgccctgagtccttttatctgtttcttttctgttcttttagtacttgtgctattgataatgtgctttttctgtaacagccattcttttacccttttattgtctctctttttttttagagggaggctcactctgtcacctaggctggagtgcagtggcatgatctcggctcactgcaacctccgcctccccgggttcaagcgattctcctgcctctcagcctcctgagtagctagggctacaggcatgtgccaccatgcacggctaattttttttttcttttttttagtagagatggggtttcaccctattggccaggttggtctcgaagtcctgacttcatgatccacccacttcggcctcccgaagtgctgggattacaggcgtgagccactgtgcccggcctattgtctctttctgatctgcagttcccttgcaaaaaataagtagttgaaataagtattaagaaagtcacaaaaactcatcaacttcagacatcaattttagtctcccctggttactgtataaataagctgttaaatttatcctttgatatcattccagtttaggcataattttggcattacaagttttaatataccattgcagcaaaataccactttttccccgcagtgtgatcattcttatcctattctaaattttcttttaggtacgcaataactgtttggtattttgatgcagatgagagagcacgagctaaagtaaaatatctaacaggtaaacgtcatttggggccaggatatattggtacagaaataccctgcaatcaggtgatgctttcaggaaactcaagcatagtctttgttaacaccatgaatacttactttttgttttttatcagatttcttatttgcctcattttttaagaagacataagtcatcttcactgttatctttaaccaaaaaaattgtcaaaggatgtggaaaatttgaggcaaagaagtctgagtaaattattcacatacaaactgagttttctgtgattatccttttcagtcaaaggccacttaactctaggtaacggccatatggtttcctctcattcactccttaaattaataccctttccttttcaaatggatgtgctctaaacagtactctaggtcttccatgttaaatgtagacatgaagaaaattaatacaaagaattatgaattcaaatgccaaaatcagtaaatgacacagacatgtagattccatatctgctaatggtgtacataggtcagcactcttgtactgaacctgaagatcctttaattatgccagttccccttctcttccacttatggactgcctctccaagagcagggggtctgtttcccatctgatggaccacttaccttcttttctttaactctactttctatctccaaaaatccactgagtattcacattactgattagctgtgttttccagagccattgctaatcgcacgtcgaccttacataaaaatggaatattcatgcattttctatgtatttttaaagccattatttgtggcacaagctcagtgtgctttcagagacactgaacactctgttgaagaaactcaaatggcttttaaaataaaaagacaaaatcattatctctgtgtagaggatggttttatccttgaaggtttactatttgaaacctcatcacaatagaatgctgagggaagtttttggaagtacaagcgtgatagttctcagatgatgtttgcaaagttgaaatattgtccatactcttaggaattcagtggaatgcagtagcagaagctctctggtgcttagtgaatgaatgaaattttttttttttttaccttgcaggtgaaaaaggtgtgagggttgaactcaataacctttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgcttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtggttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattatggtggttatttccagctgtcttttttgtttttcaatcctttatcatacattggctttccgaatgatccctttcatcagataaagcttttctggcttagtctaggacatttgttataactttttgtaaatgataatgaaggaaagagaacagtaaacataggagttcaacaattttagaaacatccctggggtcattggactgtctgtg

SEQ ID NO: 6775 - DNA, 2915 bp, Homo sapiens
ggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgatggttgccagtgactgatgattaattttattttacttaaaataagaaaaggagcactttattacaactgaaaaacagattgttttgtagtccttccttacactaatttgaactgttaaagattgctgcttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtggttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacattatggtggttatttccagctgtcttttttgtttttcaatcctttatcatacattggctttccgaatgatccctttcatcagataaagcttttctggcttagtctaggacatttgttataactttttgtaaatgataatgaaggaaagagaacagtaaacataggagttcaacaattttagaaacatccctggggtcattggactgtctgtg

SEQ ID NO: 6776 - DNA, 1016 bp, Homo sapiens
gatcaaaatacctgtttatatatctgttatttaaagaaaaattttccacagtgttttgttattttccagcgtttcttagaacatttgggaattacactaaaatatagctgggtggattgaagtaaagggcaaatgagtttgagatgaagtttgagatgtgcttttttatatacaaaaagcacatcttccaccttaaacagttgtatgagacctaaatgaaatacagtgtgcaaagtaccttacaatgcatggaacaaagtaggccttcaacgaggattattgccctttcctttaacaatatgatagcataattgcagagagagaaaattggggcaatgagctttgaatagctaacggttttatcagttgtaaatgtgaatcatttggaagcaggagtgttgtcttattaatgacaggtcttattttatagcttagatttaaattaagtcactggtgcaaggcacttcatcagattattttcccaaagtgcaaaagtgcatgtgatccaagaaagagagctgtatttgggtatgaactgcaatgatacatatttatgtcatatctaataacataattgtatgttggattttttcaattagtttataaatattcagaagtaactagtctccattgcttcaaaagataattgtttagacttctcaggtcatgaatttatccctcagattatgtttttggtttgaattttatctgaaccatggcgatgctcaagtatgtaccatgggaccaatgggaccaatgagatgtgtgaagggcatggcctcatgagctggaaatagtttcataagtagaacacactaaatgtcagccacttcacaagatggggagagcctaaacagctgcaagtagctaaagctctttttattgaataattactaaacagttgtcaaaaattattgataatttttgctctgaacaagatgtcattggggtcagaaagttactagatagggccttcattgagattaggatgttttctgccaaaattattccaaatg

SEQ ID NO: 6777 - DNA, 1016 bp, Homo sapiens; identical to SEQ ID NO: 6776

SEQ ID NO: 6778 - DNA, 416 bp, Homo sapiens
cagtaaatgacacagacatgtagattccatatctgctaatggtgtacataggtcagcactcttgtactgaacctgaagatcctttaattatgccagttccccttctcttccacttatggactgcctctccaagagcagggggtctgtttcccatctgatggaccacttaccttcttttctttaactctactttctatctccaaaaatccactgagtattcacattactgattagctgtgttttccagagccattgctaatcgcacgtcgaccttacataaaaatggaatattcatgcattttctatgtatttttaaagccattatttgtggcacaagctcagtgtgctttcagagacactgaacactctgttgaagaaactcaaatggcttttaaaataaaaagacaaaatcatta

SEQ ID NO: 6779 - DNA, 1016 bp, Homo sapiens; identical to SEQ ID NO: 6776

SEQ ID NO: 6780 - DNA, 583 bp, Homo sapiens
atagacgagttgaagattttgtttttcatatacaattcagccagtcctagctaaaacgcaatcactggaaatttaaccttaaattcatttaaaactgaaaaaggtcttttgaaatcaaactaatgcagaaactgctttacccaaaattctgatccatggccctcattagacgacccatcaggacaaataaagtttagcttgtgaacaagtcccagttttgtcaaaaatataatttggattgaagtgtcttttagaaactgacacatttgtgttattatctcatgaccaaaattctaaaatgaaagctacagtgtctttatttgtgtgcgtatgtggttaagtgtgtttatgcatatgtatgtgtattatgttgtatgttgttatctacatggtaaaatctggcatcatcaacaaaaaatctattaagggattctatttagattggcttagataaataagcattcataaaaaatatgtactaattaacccaaatgccttttagttcatgtgacttaggtatatctttaataaacaaatcagttttaaaattgttggtaaaataaaaatacaaatgttctcagaa

SEQ ID NO: 6781 - DNA, 1121 bp, Homo sapiens
gtcttgatcttgttaccgaaatgcattctgtgtaatttcaacgtagactacgttcctgagtctgatgatgtcattgtaaataatcattcctcatgttgctctcacgggtttgacattggaggatagatgtgccatcaactttaaatagagtttccatcttttgtcagctctgcatgtcatacagcaagatggaacacaggttgcaagaaagaaccaacgttattcctgacattctattgatgtgttttgagcagcaatgtgtaaccaggtgtttctgcttctaatcttgattctgctgatgaccatttttatactttatggcaaagcctcattgcctcagtttcctgtctggaaaatgagttcatcatctacctcttgggcaattgagagttttcattttgtgtcttttaaacatctggaaaatggaaaacactgagggctaaggataatgatattgtttaatgtaatttgtcatcagaccggcctcctgctcactatttctttttttttagatgctgtttttttagaatattaaattaaaggagtgctgttaatatgtaatcttcaactagttccatggaggaaagtgatgttttatgaattagagcttaaattcctatctaatttctgaagactgcattcttttcaaagacttgaaattaaactcaggaggatacattttgtttgttctagggggaaacgtaatagaatggtatgagatgaattctatccttttacaataattattactataatattgaagtattctatgcctttctgaaacactttattcagaaaagatcattttttggcttccttttaaaaataagcttgaagtagggaagcatttgcttcttagattttaaatgtagtcttattatgctgaggaaaatctttagttgaaagaataattcattacagatttttgatgaagggaagaaattaattatgttgctggaagactgtctacaaataatcaaaatatttaaatgtaatgtattcaagttgttattaaaaagttactgaatgttatctgaagatgtgaaatgtgtagtcaagtaaaaagttggcgtatactttcttgggctgcatatccaatttaattaaaaaattaaatctca

SEQ ID NO: 6782 - DNA, 1121 bp, Homo sapiens; identical to SEQ ID NO: 6781

SEQ ID NO: 6783 - DNA, 498 bp, Homo sapiens
ttgcctaactgctgttgcccacgttgaagctaaagagtaaaaacctattcatgaacaaagaaggcaggtgagacccggtaacaaactgtctctcttcccactttctctttcttattaatttggcaggatctcccttcccattttgtcaacatggttgaatttgtgtgttggggttgttagggcatgggaattcctggtttgctttctctattgcatgcttgttcatgttaactctttggggagcagaatgagatacatatgcatccatggttatgatggaaaaaagcatgcaaaatccatttttagagagagagagaaagagaaaggtgggggtgggggagcacaaagatcagaagagtactatgctgatattcaagatatagtacagatagctttctgtgtacctatccatctacctattcatctgggctattgattgactcccacagcagtaaagaataattacgcagttattcttctggttatgttttaatttca

SEQ ID NO: 6784 - DNA, 498 bp, Homo sapiens; identical to SEQ ID NO: 6783

SEQ ID NO: 6785 - DNA, 3200 bp, Homo sapiens
gttgtttttcagcatattctgtctttctcctcagtcaaggaccaacctaccttttcttttctagtgctgaggaatgtaaacaagtttgctgggccttgcgagacttcaccaggttgtttcgatagctcacactcctgcactgtgcctgtcacccaggtgaggatacatagttcccagcttttgtccggactgtcggactgttggggatgcctgggaatggggataggttttaatgcctatcatgggaccagtcttatagctagagtcagggaaggactcagcagtttaactgtggtgaacagctggaatatacagggcccggattttcttgggcctgggcagccagtaattgtcagtgtctttggggtaccattttcacctccataagaaagtaactgttacacagtgcattgaaacattttcttcccccttccccttacagacacttctaagatggtaagtgtacatggcaacaaacaaataagtatttttaacctggccactttggcgaaaacaacctcaagttgactgttatatgtggtgccagtctcctaaaactgaccctccagatgtaatgagcaaagagcttattcttatcacttttatgacctgaatgctgaagtgccaggttttgaccagggcaggaggtatgaattgaatatcccttatccgaaatgcttgggatttcggaggaaaaaacactttcagaagtgtttttcaattttggattttttgggattttggaatatttgcagaatgcacaccagttgagcattcctaatccaaaaatccaaaatccaaaatgctccaatgctcattcgcttgagggtcatatcagcgttcaaaaagtttcagctgttagggatgcttggcccttacaggagaggaggagcatctttggctcccgatgagcacttttctccacgtgctttccgtctcctggttctgaagcaaagcaagaagcttagctgaaaggagtgggtagtagaatttgggtgccagtttcttgatggagagaagaaaggtagctctcctctaagcccaccctttgatgtctcaaggtgagtttcttctcccaggaggcaattcttgatgaatctgtagcactcactggtagtttctgtgttaaatgcattcataggtaaaagtgatgttcagcagtgccttgccacacccaaaatcatttctcaactttgattgttttaatgagtaataatatcatttgggatgtcctggttttgcatggtgtctgggttagctgacattgatacacctcataaggttgctcatggacagctgtaggtgttcatggttaacttttattgtgcccttactgtgtgtcagggcactgttttaagtgttttagatgtattaactaagataatcctcatctgcttttctggatttgttactatttttcccattttacaaatgaggaaattgaggttcaacaatgtttaacaatttgcctgacagttattcgtggagccagaattcacatgtagatattctggtaccagagtcctcactttgaaccactccgcttaatacagtatcctttcgatagcatctaaattggtgttttgttttgttttgttttcaactgttattagtaggcaaagccttctttcaaaataaaatcgacatgaagcctgtgggatttagcagactgaggcaaagcttccctggttgctttggaatgggaggcctggacctgctggctctttgccctcctgacacatcatcccttgtttccacagcacactcagcattggaagcacactgcagacggtgtctcattaaagcagtagctcccttgaacccacaagttaaaacgccagacttttatttatttgtttattttttctgagttcttattggcagacttcagaatgaggtacctgaggaaatatagaaacctctgccttaaggttgattttactaaatgctctattttctggtgcagttattgactgtcttatctcttttgtcaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaccagt

SEQ ID NO: 6786 - DNA, 3200 bp, Homo sapiens; identical to SEQ ID NO: 6785

SEQ ID NO: 6787 - DNA, 337 bp, Homo sapiens
tttatttccaaaagtttccttgaacccctaggtaatacctgtttcctccctcttcccatccatccccatttccacataaccactggtttgttttctatcactgtagattagtttgcattttcctgagtttttaataaatggaatcataacagtctgttatggcaattgggctttgagctaatacctgcagagctgtattctaatgtgatagatctggcagtgttgttgatatactgacacttctctgccttttctttgcctgtcactttaactttttcactcctgggcataaatcctcaagctacagaacaataggaattggtgaaacaaatcttcc

SEQ ID NO: 6788 - DNA, 337 bp, Homo sapiens; identical to SEQ ID NO: 6787

SEQ ID NO: 6789 - DNA, 3055 bp, Homo sapiens
ggagtcacctttcctcactaggagctgtttgcttcagcaaagcaggatttgaggagttggggtctgattggggaaaagcttgctgaggtggaggtggcgataagcctggacttgccctcacctcaccccacaggccaggattcgtctttgggtttcagggtgcatgtctgtcttagcactgactgcgtgccaagccctggatgttgatcaggcagacacgggctcagcccttgaggctcacagtgcggtgggttgcacaggcagcggcagctgatccctcttaccgggtctccttctcgggactcccttcagtccacttaccccgtttctgccccccaggccttctctgggcagtgactgtgagggctgacaggaaaggcatgtgcagcgtgcttgtgaggagctcagcacagagggtggggtgagggcatgtgttgctgaagtctgcatcctgaggtgcctgtggcaaaccactcttcccttctgtctcctcagttcagccaggccctggccatccggagctataccaagttcgtgatgggggtaagttgtgccagctgtccttccttcccactgccttgcggacccaagcggggcctaggaggccaaccctggtaatggctggaggcaggtcttggtacagggtgttggcgtggtgtgtccctgctccctgggccggggtgggtcactggcactcaggcctctctgggtttcagattgcagtgagcatgctgacctaccccttcctgctagttggcgacctcatggctgtgaacaactgcgggtaggtgtgcgcccctctacttgccactctacctaccaaggctgtggggtgggggagacccaccgagcccttccagcactctgccccctcccacctgctctgtgtgtaggcttggcctgccaggcaccctggcttccgctgggatttcccagcaccccctggggtaaactgtggtgtcaggggtcagggtgtggatgggtggtagcctgaaggcattccttcttgaagtggctttcccgtggctggctgtcttccactgttctctgcatctacactctccttctccggcaggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggctttggccgagggcagaaccttgccttttcctggccttgatttgcctcgcagtgaaatggggcagtggcccggagggagccagaactctgagtggcctcgaggctgagaagaggacagatgggagggaagcagggaggagagccgcagttcttcccagtggccctggtcagcgtgagtgtgtctcgtcctccctatgagcactgaaagagtcctagaccacttgggctctgaagcaagaggggcaatgagcctcctctctagggctctcctacagagtagccccaaagacacccctgggcaggaaatgaaccgctcccttctgcttcaacacaggcagattctgccctccagggatgtaggccgaggccgtccaccccggagctgggtctttgagctcctggacccttctttgcctgacactggccttcctctcggagggacaaggaagcgtggcctccctttcactcaccttacttttccttctggtccagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggagttttt

SEQ ID NO: 6790 - DNA, 18038 bp, Homo sapiens
gggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggggaccagaggcgccgtagggagatgggaggctgatgtgaaggtgacaggccaggatttggaggattggggcgggcagtcaatggcgacggatttggggagaggggtggggacggcgggtttggggggccgagtgggtgggatgggagggaagccgtgagggagttgggaacgcaggggtcacgggttttaggatacagaaaggagaccaaggggttagagtaataacagatacgggagagggtggaaggaacaagcgatttgggggagtgccaaggagggagcgatgggctggaaaaacatatttgggagataaaggagtggggacgatggacttgggatagggaagggagcgaatttggggcgagggaagaagcaatagaattgggggaggggcaagaagtttgggtgaagagatggggaggaaggttgggggcccaggcaaagtgtttagagaatgaggagcacataattggggtagaggggaacggaggctctggatttgatagagatggatttaaaacgtcttggggtggggacaaagtgggcgccagggccagaaatttaggagggaaagaaggacaccagactgggggtggacagaggagacggaggtcttgggttgcattgtgatttaatttggtgggagagtgcgaaggcaaagacttttgcaggggaatgctatcggtttaccggagatgggggctctggatttgatggcgacgacggatttggtaggaggaggggacagggtgacgcgtatggggggaggggaacagatagggccagcattgggggaggggagtggcagcgatttgtctagagaggggagctaggaggaggctttaagcggggaagggggatgacgcatttggaggaggaaatggaagtcatagttggggtcagagagaggaatcacagtgcttgtatctgggcagatgaggagaaggggcacgggagtattgaaattgggcagaagggacagtggagacataggtggcaggataggtagggactaccagaaattgagaccgaggtagggatgtctctggaacagagggatgcataggcacttggcagatttggtggtggccagcaatgcggtacagatgaagtgtgctgcttgaggagtgagctggaatgaagggcgtgtggaggtgtgagaattaggtgggtgtggctgggatgggtacagttttgatgggggtcattaggccagaattttccagttaagaagcttggggggaggaaggtaaaaattgaattggagacccatccaagatttgagttgaggcaggtgggtgtcagattttaccatctttataattgaaccgagagaatgcaaaatacaactggaatgagaaggccttgagaatgagagtaattgaaatctgggatccgaggaatggtaatagatttgtgggtgtgaccaggaatatgacaaggaatgaggagattcagtcaggggcatcaaggtgcctgactagaccctaattgtgacagatttgaaaattgttgatggcggaaggtgtagaccagactggcatttggttgtgatttgggaatgagggctgtcttacagggttaagattgtatttacagcagttgaacttgaagtttgggagataaattggtgctttggacctgagaagtgagggttctggaaactgatggaatgagactgagtgagggctaggattttagggcacaggtgggagagtctgtggagtgaaggatactggagcacaagggctcagtgtgagggaaatgaagaagtggcttcatcatttggatgatggcagatctggtttgaaagaacattgaaatgagggtggtttgggaagggaatgggggaatgaaggacaccaaagcgtgagaagaactagatggtgggcaggtaaggatggatgagccctgttgaaggaccagaggtgcctgtctgatttgaacccagctggtgttgagtgtaacatatattagggtaagatcttcaatgggtatagtttgggaatcagagtaataacttgcagaaaggcaaattactgggagtgggggtgtcaggagtggagtgacagatttggggattgtctagattaggtgcgtaagaatgcagtgccttagattagtgcatgtggctgtcaggtttgggagtcggagattttaagatgacagactgtccctgctggtatctgatatagggccacagcatttgccgtagttaggactgggttaacagatttgaggttgaaattgggtttaatgacttgggaacaaataattaaaacttgaaggcaggaggaatgggggtgagatacagccagtgtgcctatgataacccaatagaagttaagaaaatagattcaacagatttgggagccatggggatatgggataacgttacaaatttaagtatgaaattggggtcagtgggactcccaaatagtgttgactaaactggataaggacagcaaaagagcagttgtggcgatttggagtggaggaataaaggaataccacctgtatttaagagaacacagatcaagacaaaacttaattcagaacaaccttggagcttttaacccagaagggaaaaggtctagaagggaagtactcactgcctgggtcagctgactcacccctttcctcctttgctccactgggtcaaaatttttttcttttaaagacagtccccatcatagaggagtttttaaatttacaatcattaatctgttaggcatctcagaatcagatccataggagatagcctgaactttgaaaagcacttgcttgataaaggcaaaaggggacagggttgatcccaaaaagcactggaagcatacctaatccagtttacaaggtagcgctttctaacttgccacttctactgcctcccacagctgcaggccaaatcctctcccacatgtcagaggaatcgctctggtccatgggcccagctggcctgcttagagggcacagggctggtatcctggccccttgccaagggaggaaggagccttctcactccccacctaggtgctggtctccttgacaccttgcctcctccctggcagcaggggctctcacccctcgacagagacttcctgctcctcacatggatatggatggtccttcacccacccgcgggtttaataaatatttcaggctgggcgcagtggctcatgcctgtaatcccagcactttgggaggccgaggcgggtggatcacctgaggtcgggagttcgagaccagcctgaccaacatggagaaaccccgtctctactaaaaatacaaaaaatttgccgggtatggtggcgggtgcttgtattcccagctacttgggaggctggggtaggagaatcacttgaacccgggaggtggaggaggtggaggttgcggtgagctgagagcacgccattgcactccatcctgggcaacaagagtgaaactccatctcaaaaaaaaaaataaataaataaatatttcagatataagaagcatctgtacagcaagaactatcatagccctacagaaatgagggggtcgttttgtcacagggatgtagggtgattgaggtgagaacgcagctaaggatatgtttgaggagtagctggaatttgaggtaacagtttgctaagcctgggaatgggaggaatagacatggaggtgtctgcagtagatttggtaagaaatttgagtttggggtgcactttggaatagatgacttaatggctgacctgtctgaggtttgggtatgatgtattttcttattgccacatttggaattgaggttggaatgaagtttttcatctggagatgagaataactgagatttgttctgagatgggagtagggtttgcagtacatacaaatggaggtttctctactgggaatatttgggatttgaatgtaagaatgttggggtgtgggtgtgacttggattgtggttggacagtgtctgggaccaggcatttctgttgattgggagtttacgtgctgccaatggttagagacactgacgagctttctggtatgctttgatggggaaaacatgaacaagagccacattagaatttgtgggagaagagttaagcaaagggggcaagaggtgtgaggagaggtggtgaggctgaatcaccacgagactctgagcgtccctttgtctttgttaattctgaaggtgggtcatgagccgatgccccccacccttgggaccaatgtgctggggaggaaggtcctctatctgccgagcttcttcacctacggtgagtgtgcctcccaagcaggaaagcccacaccaacagaaaagaggcctcaggtggggagcaggaccagctggccccggggaactcactgcgcagcatggcacgcagtcgagctggcatggaggaggggatctaagcgtgtacagagaggacatggtgtcggggtgcgagcaggtgaaccatacagctttggtccagctcctctgcctgtagctgccagctgccagcccagacagcaggaggggacagacacaggtgcctgagagaggagccaatctaggacactggtccctattatttctgctgccccgggttgtgcctggaacatgcgtgggggtgatttccttttgtcctgtgagcagcctggccctgctactccagcaggaggcccggggggtcctcttgagtttttttcttttatcccacctgggtgtcttgtttcccctgcattcctcaggcagtgagtggtgctcactcactctggtgtctccatctgttggttacagaatggtgtgcagtgaattgcagcttcacttctgtgtgctgcgtgagtttgggtgggccacttacctgctgtggcctggctgcaccccttgtctgcaaagtaaggtcagcttctcctgcccaggccttcctgcaagctccccaactgtcatcaagaagcccaccttgctgcctctgctgcccatcacctggcccacaggtgccgtctggccagggccttttcatgttcaccctcactgtccctctcccagtccctaccctcaccagatgaccatgatgaaggccttctttaaatgtgccctttttctccgtgttcacagctggagttccattgcaggcaaatcccctccagtttcctgcacctctgctcttacctgtttggttgtctagaatattctccagaatctatctttctgttgagtaacttggggcttggcctctgtcttaccttttccatttcacatgctgttggcagaattgggtgtcatatttctcttccagttttgtccctgtgttgttgagtgcagagtctagggccaggtggaatgtgtcatcttgtgaggaaatgtgtttgtgttgttttttacttaaaaattgtcagcgtagtggagaggggaatgacagaagtaggaaggcaccccaccattgtgtagtgaggcagtatacagagaggtaaggcagccggggcagatggctgcggccctgcacggggctttttctggatctggttgcacgtgctgtgttctgagaggcgaggttagagcccagatcatctctattcatgtgacacagccattcccaaaaggacttagagcagagggaacttgacccccatcttaactgtctcttttgaggatgagcagagttctcaggtgtgcccccagcctggtttatataaatgtagctttaatctaggtgtgagcagatgtctgttggggatctctggacaccaggcctactctggagtcagagaggggacccgccatttggctctctggtacagtgtggacagtgtctgctcctctacttgtcatggctgaaagtactgcagctgtcatgacattctctggtgtagaagaaagaacttcccagagggtttcctggcactgcagaaagacccagaatgagggaggccctgggacccacagaggcccctgcaggcatttcagcacgcctccctccgctctcacttgttcctcagttctctcagaaatggagagaaatgacggtccttattccttctttttttacaggtgggcagatggaagagggtcgatgttttgctcaggatcacaaacagaggtcctgaggctccctctcctcactaggatccaccctcccccaaagcaaattttccttttgcctgttcactctgtgaagagggctccttgccaagtcacccagcatcccctcccctcctcctcctctccttccagcccaccctcatctcaggcaatcacatatacaggtaacaggtgttctcagcctcatgaaaaacccatgctagctgtgacattgaattgctgggctggcagacatctgcggaggagcaaaaggcatatttgcttcttcctgcctctgcgcggtgccagagagctaaagtcatggtctaacagggggagcatgctgtctgagagaatgttctgctagcttccagatgcacaggtttataaaaataccaccctgccatttaaaacatgtttaaaatgttgatagaaaacaatgaatcgtatccttagaaagacagaccctagtgaaagaaacactaactcacacaggtagggtctagcttccataacatttaagtttattctatggaattgttcattggtgctcctgttttagttacttctccatagacttgtttttcccttgactaatcaatgccatctggtgccaggtggtatcctgggtgtagcacagtgacagggtggagactgccctggccgtggcatgtgcagggggcgttcttgagcctgtcttctgggagccctttcttttcctttttccctcctttaggttgaagacttcatcattccctgcgggcagtttctctgtttttcctattttcttttcctcaagaaaaatgtaatttttaagtaacagaattgttttctgtgttgcagcatttaagttgctgagttgagaaatcatggctgagtttgccaagtaaagtttttaaagcaaaaaaaaaaaaaaaaaaaaaaaggagggagggagggaaggaaggaagaaaatatatgaacttgtttgtcagaaatacattttgaggcttttactaaaagaaatgggctagaagacatttgggggttagggcctgactgcttccaggtcctggacagatgttaccttctgtgcctgtagtcagcagttacctgaaggacaagccgagcctggtctgggtgtgtgtgacccaggagtgggtgcccctgaactgggtgtgactcctctgccacctctgttttcttacagccaagtacatcgtgcaagtggatggtaagatagggctgttccgaggcctgagtccccggctgatgtccaacgccctctctactgtgactcggggtagcatgaagaaggtgagcccacacaaagccaggaacagtcgcccgaggtttcctcatactcccagccacccctgcagcagccagttaccctggtcttgcctcctccttcccagaccattgggggcttcactccagccccatgggggagctcccaccccacagttctgctttcccacagctgtgacaccagatagtggctttcttttccccccaagctccagacctggaggttacctgaggtgggcccagccaatagacactgcagaggaaatatttggagctggttcctgccgcccaagtccccgaagagttccatggaagaggcgtagctgaacttggttctttcccttctctgtttcaggttttccctccagatgagattgagcaggtttccaacaaggatgatatgaagacttccctgaagaaagttgtgaaggaggtgggtgttgagagttggagagggagaggtgcgtggaggggagcctgatgatttctcacccccaagttgggcgggtcattgacaagtcgaagagttgggtccttgtgtatgcatgggtgggatggtaagggaagaagccctggcctggatgtgccgggaaccccggaaagccttctcagccattgttgggcctagcctgggacccgacagcactcctgggtgggggactggggagtgggcaacaggtggagccatccttggcagaccgaccccatgtgcagtccctgggacaggtttctccctcctgagcacttgtagctcccctcgagggccagttccagagacaggccgagggtggcgagtccccaccccatgctctcttccagacctcctacgagatgatgatgcagtgtgtgtcccgcatgttggcccaccccctgcatggtaagccaccccccttcccccgagactgtatctaagctggcgtcgggggcgtggggtgaggggcgccccctcgtggactgtacatagacagccgtagacctgttgggaagtggtagtggggttgggggtattctactggaacccacctcactgaggagagattggaattctttccaaagggaggtggggctcttcccaggcagtagaaatggcatgctgtggtcatggggtgtaacagggaatccgaaaggccctcttcctctcctgctctctgaataggccacgttgttcagtggccactctgcacctggcacccggtggctggagcattatgaagtgtggcccaccacatcacctgtgtgtgttttcttttttttcctcagtcatctcaatgcgctgcatggtccagtttgtgggacgggaggccaagtacaggtgggtaactcttgggactggcagagtggccctgttaccctttcagagtcggccagggcaggccgtgctgggattggttgctgcaccttttctgccctagtgctgtgtgagttcagcctgctgcctggcttctgaggaatgtggcagtggcttcaatagtctgtccagggtcattttctcttcgtcatctcttatcaagggcagccctagatgagcctagatgcctttgcagaggggtgagtgggattgtagtcagcttggattaggatttctggccccagagctgattctgccacttaggactgagctggggtctccttttggactcccgaagtaatgctctaacgatttttccggccctcataggctgatagctctttttatcccctatgaagaagccatccaccccatgggcttggggctcatcccttccattgtgtaccagaccctcacctagatctgctgcgtgcagccctgggcaggtgccaggggcatatgtgttgacacggaggtgggtcttggaggcatgtgtgaaggacacacctgggttgcccttcctctcttaagattctcatttcctggggtcggtgttttttgcagctgtcctgcggggccaccatcccaggaagctcagctgccatggtgcctcattttggggtcattaatgggaaattggcccattcccctagactgattatgaggttggtagttgggaccagaagggtataatctggccaccactgttctgagtggtggggccgggcctggcagggctgggatgatctgggaccggggctacccagggctttgccttccactggctccctctgttagtaggttgttattgagcttccttggcatttcacacccaagaacccacagcctgtcctctcatccagcttgtcctctcatctctaacagggtgcagtggccagggcatgagtccccggctccctgctgaggagtgccagatgtcttctcctaggctggttccagtgcctcctcctgcagggccctgtattctttctctgccctctgggaaagtacttctctttgcttactaccccctcctactcttactcttgggcgggcctgtgggctcctctgctagagggttgtttaaccagagataagtgtgagggccgggtaagagaagggcctgccgcctctgcagcagtggcccaagttaggagatgcattcctaaactcctatctcccagaaaacaccagtagaggactgctagtgggctgctcccatgggtggttgggcttccccagtctccatgaactgtgtaaactcctcctcaccctgaacaagcgctctttgcctttctacttggttcttcatggtaatagtcctccccatccctgccaggactggctggatttgagcagaactggtgggctcagccccacaccaacgggtgggcttctggtaggtgactgcatgaccctgtatctctgtcttgccttcttcacagtggtgtgctgagctccattgggaagattttcaaagaggaagggctgctgggattcttcgtgtacgtgagtttatacaccccataactggccacgggcatggctctgctaacaggtgtgtcctcaacctctcagaccgcagctgctggcctgggacttcactacatggccctgccctagcctgagtgctgcagccagctctccagagctccatagcgtgtccaagctgcttagcccttttcaggccatggctcatgtaaaagtggaactgtgtgtctagtacatgggggagatgaactgaccagccccactgggcctcatccagttgtggtgggtgtggggctggtcttcatgagctaagtcactgcatagtccttggcctcactgctaaaacatgactgaaaatctgacttggactgagggtggagctctggaagctcacaggctgaccacagccagtggattctgtttgacattgcttttctgacaaattagttgttgccgttaacatttaagatatgttgcacaaaaatccacatgtctggcatctcttgaaaagccagaaaatcttgtcctgctgagcggttctttctgtagagcatccatcggccaggacccaggacctgcttctttggcagggcacatggtctccgagggccgcagacaccctgtacttcgtcacgtcacatccagtgtacttcacctctaaagaaagcacatactgaaaagactaagttcagaaagaataaggtgcagacagaagccaggcttgatgagttgtattttgatttgccgttttaaggtctaggcagtgacatacatgctgataagtatgtcacaaacgtggtagacacatggtatacaacagtatccgctgtactagatacagggctccatattattcataagaagtctttatatcatggttttcccggtttgtgagatgttttttatttatggccccttgtttaaccaattagtgactacttgtaggtgcatgtgtgtgtatatgatatagaaatatatatacggttctcagcaggaggtgattttgctccccggggaacatcggcagtgtccggagacatcttgtggttgtcacaactggcatctagtgggtagaggccagagacgctgctaaacatcctacagtacacaggacagccccgcaacaaagacttattcagtcaggtgtcgttgcttgcatctgtgatcccagttagttgggattagtctcagtggtttctgcagctgtcaggagaccaaggcgggaggattacttgaggccaggagttcaagaccagcctgagcaacatagtgagacttctgtctctacaaaaatgtttttaaaaattagttggccgtggcggcatgcacctgtagtcctagctacccgggaggctgaggtgggaggatggcttgagcccaggagttggagactgcagtgagctatgattgcaccactgcactccagcctgggtgatagagtgagaccctgtctcttggggaaaaaaaaaattattcagcccaaaatgtcaatagtgccaaggttgagaaactctgatttatattcacacacacacatatatgtatgtgtaagtatttatacatacatatatttgcacatgtacctggtaacaaaccaacatttgtgacatacctatcagcatgtatgtcaccgcctagaccttaaaacagcaagtcaaaaaacaactcatcaagcctggcttctgggttctgtctgtgctttattctttctgaacatagtcttttcagtatgtgctttctttagaggtgaagtaagttggatgtgaggtgacaaagtgcagggcatctgtggccctcagggaccatgtgccctgccaaaggggcagccccgggaccccagccaatggctgctctacagaaacagccacccatcttgaaacactgcacatgaccacctctggcatttttcacactgcgtagttctcttctggtgtttgaataggattcccgcacaacagatgcctactctttgggttctttctccccatgtgattttggaacaggtgatactcatacatgttacagtgcatagaaagcaccaaagggtatagcacaaagtcaatctgagcacaggcagggacgacaagattagaaattgcattcacagaggttccttttattaatactcttcatagatgtattacatatattcttttgagtttttcaaatataagatttttttttttaattcaaaaacaaaaattctgcttctcctcccaggagacagccatccttctcctggcgagcctcccagggcactctgtacctaaacaagcaaacacattgtaaaaaacacaagaggcacatgggactcactgacctcaaactggccttttgccctcagcactgcatcttggggaaccttccttagcagtttatagagctgtttatcctaaaggccatcacttaaaaagttagccctccttgtaaatgcttgcatagaatctttttgatagaatattttcaggggcaaagagaacagatgcattgagcagtgtgtcttctgagagttggttaggtaaagaggccaggagaaaattaccaacacgtcggcactcttattatctgcatttggaaattccaaatttggcagtattcacatcttgatccctggcttctgtggtttgaaaactgcttgagactgttagctaatttatggcatccaaagcggcatagaacacctccccatgggaaaaggagcactatcttcccagtgtgcatagctgctggaccctgcaggcctcctttctaaggctgtgccattggatatgctaagattttgagctcggaacatccctgcctgcttcctgggtgtggagcccccaggaactgctcctctccctctcctgctcatctctgcttaccttgttttttagtggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccaggttggttggaacaaggacttgtccttctttccgtgtgctgctgatgcccagggtctgggacaaactcaaggattctgggattctcagcatcaggccgggagggtgagagaggacctctcattatccctggagtcatctttgtctaaggggagaacggcctcaagaggcgagattccagattagtacccagacctgggaggaattaatggaatgcttgtccctgggcgccttagaaacagaccccagcttatctaaggctgctccgaggcagtgacccaactagggctcaggaagtcagaagatagaccagctaatagtgatcacctcttgacctttgtgtcacgtcttttgctttttaaaacccttttgtgaacgttatggcctttgatctgacggcatcctagttgtgaagggaacagggcaggtataatgttcgtttaccaatacagaaatcgagacccagagatcacaaattctggagaggctctgggctctccagagtcactcagctggaactgacagggctggaattagatccctggccaggccaagggtgcattcctctgagttttttcagatctgctaggaagtgtacagtccgatacaccctcctattttgttagctgtggtctacacagcctagtatacatagacctttcagcaggtcgggtcaggcataggaaggcctggtccttctacacagcacttgttgaggaaggccatccaggtacctgaggggttgactggttctgcctgaaccaagataagaggtagggagcagcgatggctgggaattgcagtgtccagacattctcacagtggggatcaccttcaagaaggatggcattccttcttgaagtggctttccctcccaggaggctaggagggcctggggacgtgtctgccagaatcacctgggtgggaagggggtcatgttcagcatgtgtgtgtgtgtggtacatgtctgttctgtgtggtgaggagtgccccatcccagatgggagcctctgcttgcagggagactggccacttgacctgggcaggtgagtcttcactggcctttcgatgtaagcaaattaaagtggctccatagagacccaccccatctgcaatcacagtggtacattcctgcagttctgccccttctcggggggccttgtgggtgggtaagctgctgctgtcacatacagagcaagggtggccaggagtgcaccgctaagtggtttctcatctaggtgggcagctgtctgaccagaggctgccgtgcttacatcagcaacaacagcagtcaacagatttgtctaaagtgtttttcgagtgcttttctgtatgtggcttaaaggccgaggtgaggctgccgggctgtcaaagccactcaagcagacatctgagcaaatctctgaccaagaacccaggccatcgatctggtgggatggccgctccacaggaagctgagggtgggggagtcacctttcctcactaggagctgtttgcttcagcaaagcaggatttgaggagttggggtctgaagggggaaaagcttgctgaggtggaggtggcgataagcctggacttgccctcacctcaccccacaggccaggattcgtctttgggtttcagggtgcatgtctgtcttagcactgactgcgtgccaagccctggatgttgatcaggcagacacgggctcagcccttgaggctcacagtccggtgggttgcacaggcagcggcagctgatccctcttaccgggtctccttctcgggactcccttcagtccacttaccccgtttctgccccccaggccttctctgggcagtgactgtgagggctgacaggaaaggcatgtgcagcgtgcttgtgaggagctcagcacagagggtggggtgagggcatgtgttgctgaagtctgcatcctgaggtgcctgtggcaaaccactcttcccttctgtctcctcagttcagccaggccctggccatccggagctataccaagttcgtgatgggggtaagttgtgccagctgtccttccttcccactgccttgcggacccaagcggggcctaggaggccaaccctggtaatggctggaggcaggtcttggtacagggtgttggcgtggtgtgtccctgctccctgggccggggtgggtcactggcactcaggcctctctgggtttcagattgcagtgagcatgctgacctaccccttcctgctagttggcgacctcatggctgtgaacaactgcgggtaggtgtgcgcccctctacttgccactctacctaccaaggctgtggggtgggggagacccaccgagcccttccagcactctgccccctcccacctgctctgtgtgtaggcttggcctgccaggcaccctggcttccgctgggatttcccagcaccccctggggtaaactgtggtgtcaggggtcagggtgtggatgggtggtagcctgaaggcattccttcttgaagtggctttcccgtggctggctgtcttccactgttctctgcatctacactctccttctccggcaggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggctttggccgagggcagaaccttgccttttcctggccttgatttgcctcgcagtgaaatggggcagtggcccggagggagccagaactctgagtggcctcgaggctgagaagaggacagatgggagggaagcagggaggagagccgcagttcttcccagtggccctggtcagcgtgagtgtgtctcgtcctccctatgagcactgaaagagtcctagaccacttgggctctgaagcaagaggggcaatgagcctcctctctagggctctcctacagagtagccccaaagacacccctgggcaggaaatgaaccgctcccttctgcttcaacacaggcagattctgccctccagggatgtaggccgaggccgtccaccccggagctgggtctttgagctcctggacccttctttgcctgacactggccttcctctcggagggacaaggaagcgtggcctccctttcactcaccttacttttccttctggtccagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcgagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggagttttt

SEQ ID NO: 6791 - DNA, 13540 bp, Homo sapiens
aggtgggtcatgagccgatgccccccacccttgggaccaatgtgctggggaggaaggtcctctatctgccgagcttcttcacctacggtgagtgtgcctcccaagcaggaaagcccacaccaacagaaaagaggcctcaggtggggagcaggaccagctggccccggggaactcactgcgcagcatggcacgcagtcgagctggcatggaggaggggatctaagcgtgtacagagaggacatggtgtcggggtgcgagcaggtgaaccatacagctttggtccagctcctctgcctgtagctgccagctgccagcccagacagcaggaggggacagacacaggtgcctgagagaggagccaatctaggacactggtccctattatttctgctgccccgggttgtgcctggaacatgcgtgggggtgatttccttttgtcctgtgagcagcctggccctgctactccagcaggaggcccggggggtcctcttgagtttttttcttttatcccacctgggtgtcttgtttcccctgcattcctcaggcagtgagtggtgctcactcactctggtgtctccatctgttggttacagaatggtgtgcagtgaattgcagcttcacttctgtgtgctgcgtgagtttgggtgggccacttacctgctgtggcctggctgcaccccttgtctgcaaagtaaggtcagcttctcctgcccaggccttcctgcaagctccccaactgtcatcaagaagcccaccttgctgcctctgctgcccatcacctggcccacaggtgccgtctggccagggccttttcatgttcaccctcactgtccctctcccagtccctaccctcaccagatgaccatgatgaaggccttctttaaatgtgccctttttctccgtgttcacagctggagttccattgcaggcaaatcccctccagtttcctgcacctctgctcttacctgtttggttgtctagaatattctccagaatctatctttctgttgagtaacttggggcttggcctctgtcttaccttttccatttcacatgctgttggcagaattgggtgtcatatttctcttccagttttgtccctgtgttgttgagtgcagagtctagggccaggtggaatgtgtcatcttgtgaggaaatgtgtttgtgttgttttttacttaaaaattgtcagcgtagtggagaggggaatgacagaagtaggaaggcaccccaccattgtgtagtgaggcagtatacagagaggtaaggcagccggggcagatggctgcggccctgcacggggctttttctggatctggttgcacgtgctgtgttctgagaggcgaggttagagcccagatcatctctattcatgtgacacagccattcccaaaaggacttagagcagagggaacttgacccccatcttaactgtctcttttgaggatgagcagagttctcaggtgtgcccccagcctggtttatataaatgtagctttaatctaggtgtgagcagatgtctgttggggatctctggacaccaggcctactctggagtcagagaggggacccgccatttggctctctggtacagtgtggacagtgtctgctcctctacttgtcatggctgaaagtactgcagctgtcatgacattctctggtgtagaagaaagaacttcccagagggtttcctggcactgcagaaagacccagaatgagggaggccctgggacccacagaggcccctgcaggcatttcagcacgcctccctccgctctcacttgttcctcagttctctcagaaatggagagaaatgacggtccttattccttctttttttacaggtgggcagatggaagagggtcgatgttttgctcaggatcacaaacagaggtcctgaggctccctctcctcactaggatccaccctcccccaaagcaaattttccttttgcctgttcactctgtgaagagggctccttgccaagtcacccagcatcccctcccctcctcctcctctccttccagcccaccctcatctcaggcaatcacatatacaggtaacaggtgttctcagcctcatgaaaaacccatgctagctgtgacattgaattgctgggctggcagacatctgcggaggagcaaaaggcatatttgcttcttcctgcctctgcgcggtgccagagagctaaagtcatggtctaacagggggagcatgctgtctgagagaatgttctgctagcttccagatgcacaggtttataaaaataccaccctgccatttaaaacatgtttaaaatgttgatagaaaacaatgaatcgtatccttagaaagacagaccctagtgaaagaaacactaactcacacaggtagggtctagcttccataacatttaagtttattctatggaattgttcattggtgctcctgttttagttacttctccatagacttgtttttcccttgactaatcaatgccatctggtgccaggtggtatcctgggtgtagcacagtgacagggtggagactgccctggccgtggcatgtgcagggggcgttcttgagcctgtcttctgggagccctttcttttcctttttccctcctttaggttgaagacttcatcattccctgcgggcagtttctctgtttttcctattttcttttcctcaagaaaaatgtaatttttaagtaacagaattgttttctgtgttgcagcatttaagttgctgagttgagaaatcatggctgagtttgccaagtaaagtttttaaagcaaaaaaaaaaaaaaaaaaaaaaaggagggagggagggaaggaaggaagaaaatatatgaacttgtttgtcagaaatacattttgaggcttttactaaaagaaatgggctagaagacatttgggggttagggcctgactgcttccaggtcctggacagatgttaccttctgtgcctgtagtcagcagttacctgaaggacaagccgagcctggtctgggtgtgtgtgacccaggagtgggtgcccctgaactgggtgtgactcctctgccacctctgttttcttacagccaagtacatcgtgcaagtggatggtaagatagggctgttccgaggcctgagtccccggctgatgtccaacgccctctctactgtgactcggggtagcatgaagaaggtgagcccacacaaagccaggaacagtcgcccgaggtttcctcatactcccagccacccctgcagcagccagttaccctggtcttgcctcctccttcccagaccattgggggcttcactccagccccatgggggagctcccaccccacagttctgctttcccacagctgtgacaccagatagtggctttcttttccccccaagctccagacctggaggttacctgaggtgggcccagccaatagacactgcagaggaaatatttggagctggttcctgccgcccaagtccccgaagagttccatggaagaggcgtagctgaacttggttctttcccttctctgtttcaggttttccctccagatgagattgagcaggtttccaacaaggatgatatgaagacttccctgaagaaagttgtgaaggaggtgggtgttgagagttggagagggagaggtgcgtggaggggagcctgatgatttctcacccccaagttgggcgggtcattgacaagtcgaagagttgggtccttgtgtatgcatgggtgggatggtaagggaagaagccctggcctggatgtgccgggaaccccggaaagccttctcagccattgttgggcctagcctgggacccgacagcactcctgggtgggggactggggagtgggcaacaggtggagccatccttggcagaccgaccccatgtgcagtccctgggacaggtttctccctcctgagcacttgtagctcccctcgagggccagttccagagacaggccgagggtggcgagtccccaccccatgctctcttccagacctcctacgagatgatgatgcagtgtgtgtcccgcatgttggcccaccccctgcatggtaagccaccccccttcccccgagactgtatctaagctggcgtcgggggcgtggggtgaggggcgccccctcgtggactgtacatagacagccgtagacctgttgggaagtggtagtggggttgggggtattctactggaacccacctcactgaggagagattggaattctttccaaagggaggtggggctcttcccaggcagtagaaatggcatgctgtggtcatggggtgtaacagggaatccgaaaggccctcttcctctcctgctctctgaataggccacgttgttcagtggccactctgcacctggcacccggtggctggagcattatgaagtgtggcccaccacatcacctgtgtgtgttttcttttttttcctcagtcatctcaatgcgctgcatggtccagtttgtgggacgggaggccaagtacaggtgggtaactcttgggactggcagagtggccctgttaccctttcagagtcggccagggcaggccgtgctgggattggttgctgcaccttttctgccctagtgctgtgtgagttcagcctgctgcctggcttctgaggaatgtggcagtggcttcaatagtctgtccagggtcattttctcttcgtcatctcttatcaagggcagccctagatgagcctagatgcctttgcagaggggtgagtgggattgtagtcagcttggattaggatttctggccccagagctgattctgccacttaggactgagctggggtctccttttggactcccgaagtaatgctctaacgatttttccggccctcataggctgatagctctttttatcccctatgaagaagccatccaccccatgggcttggggctcatcccttccattgtgtaccagaccctcacctagatctgctgcgtgcagccctgggtaggtgccaggggcatatgtgttgacacggaggtgggtcttggaggcatgtgtgaaggacacacctgggttgcccttcctctcttaagattctcatttcctggggtcggtgttttttgcagctgtcctgcggggccaccatcccaggaagctcagctgccatggtgcctcattttggggtcattaatgggaaattggcccattcccctagactgattatgaggttggtagttgggaccagaagggtataatctggccaccactgttctgagtggtggggccgggcctggcagggctgggatgatctgggaccggggctacccagggctttgccttccactggctccctctgttagtaggttgttattgagcttccttggcatttcacacccaagaacccacagcctgtcctctcatccagcttgtcctctcatctctaacagggtgcagtggccagggcatgagtccccggctccctgctgaggagtgccagatgtcttctcctaggctggttccagtgcctcctcctgcagggccctgtattctttctctgccctctgggaaagtacttctctttgcttactaccccctcctactcttactcttgggcgggcctgtgggctcctctgctagagggttgtttaaccagagataagtgtgagggccgggtaagagaagggcctgccgcctctgcagcagtggcccaagttaggagatgcattcctaaactcctatctcccagaaaacaccagtagaggactgctagtgggctgctcccatgggtggttgggcttccccagtctccatgaactgtgtaaactcctcctcaccctgaacaagcgctctttgcctttctacttggttcttcatggtaatagtcctccccatccctgccaggactggctggatttgagcagaactggtgggctcagccccacaccaacgggtgggcttctggtaggtgactgcatgaccctgtatctctgtcttgccttcttcacagtggtgtgctgagctccattgggaagattttcaaagaggaagggctgctgggattcttcgtgtacgtgagtttatacaccccataactggccacgggcatggctctgctaacaggtgtgtcctcaacctctcagaccgcagctgctggcctgggacttcactacatggccctgccctagcctgagtgctgcagccagctctccagagctccatagcgtgtccaagctgcttagcccttttcaggccatggctcatgtaaaagtggaactgtgtgtctagtacatgggggagatgaactgaccagccccactgggcctcatccagttgtggtgggtgtggggctggtcttcatgagctaagtcactgcatagtccttggcctcactgctaaaacatgactgaaaatctgacttggactgagggtggagctctggaagctcacaggctgaccacagccagtggattctgtttgacattgcttttctgacaaattagttgttgccgttaacatttaagatatgttgcacaaaaatccacatgtctggcatctcttgaaaagccagaaaatcttgtcctgctgagcggttctttctgtagagcatccatcggccaggacccaggacctgcttctttggcagggcacatggtctccgagggccgcagacaccctgtacttcgtcacgtcacatccagtgtacttcacctctaaagaaagcacatactgaaaagactaagttcagaaagaataaggtgcagacagaagccaggcttgatgagttgtattttgatttgccgttttaaggtctaggcagtgacatacatgctgataagtatgtcacaaacgtggtagacacatggtatacaacagtatccgctgtactagatacagggctccatattattcataagaagtctttatatcatggttttccggtttgtgagatgttttttatttatggccccttgtttaaccaattagtgactacttgtaggtgcatgtgtgtgtatatgatatagaaatatatatacggttctcagcaggaggtgattttgctccccggggaacatcggcagtgtccggagacatcttgtggttgtcacaactggcatctagtgggtagaggccagagacgctgctaaacatcctacagtacacaggacagccccgcaacaaagacttattcagtcaggtgtcgttgcttgcatctgtgatcccagttagttgggattagtctcagtggtttctgcagctgtcaggagaccaaggcgggaggattacttgaggccaggagttcaagaccagcctgagcaacatagtgagacttctgtctctacaaaaatgtttttaaaaattagttggccgtggcggcatgcacctgtagtcctagctacccgggaggctgaggtgggaggatggcttgagcccaggagttggagactgcagtgagctatgattgcaccactgcactccagcctgggtgatagagtgagaccctgtctcttggggaaaaaaaaaattattcagcccaaaatgtcaatagtgccaaggttgagaaactctgatttatattcacacacacacatatatgtatgtgtaagtatttatacatacatatatttgcacatgtacctggtaacaaaccaacatttgtgacatacctatcagcatgtatgtcaccgcctagaccttaaaacagcaagtcaaaaaacaactcatcaagcctggcttctgggttctgtctgtgctttattctttctgaacatagtcttttcagtatgtgctttctttagaggtgaagtaagttggatgtgaggtgacaaagtgcagggcatctgtggccctcagggaccatgtgccctgccaaaggggcagccccgggaccccagccaatggctgctctacagaaacagccacccatcttgaaacactgcacatgaccacctctggcatttttcacactgcgtagttctcttctggtgtttgaataggattcccgcacaacagatgcctactctttgggttctttctccccatgtgattttggaacaggtgatactcatacatgttacagtgcatagaaagcaccaaagggtatagcacaaagtcaatctgagcacaggcagggacgacaagattagaaattgcattcacagaggttccttttattaatactcttcatagatgtattacatatattcttttgagtttttcaaatataagatttttttttttaattcaaaaacaaaaattctgcttctcctcccaggagacagccatccttctcctggcgagcctcccagggcactctgtacctaaacaagcaaacacattgtaaaaaacacaagaggcacatgggactcactgacctcaaactggccttttgccctcagcactgcatcttggggaaccttccttagcagtttatagagctgtttatcctaaaggccatcacttaaaaagttagccctccttgtaaatgcttgcatagaatctttttgatagaatattttcaggggcaaagagaacagatgcattgagcagtgtgtcttctgagagttggttaggtaaagaggccaggagaaaattaccaacacgtcggcactcttattatctgcatttggaaattccaaatttggcagtattcacatcttgatccctggcttctgtggtttgaaaactgcttgagactattagctaatttatggcatccaaagcggcatagaacacctccccatgggaaaaggagcactatcttcccagtgtgcatagctgctggaccctgcaggcctcctttctaaggctgtgccattggatatgctaagattttgagctcggaacatccctgcctgcttcctgggtgtggagcccccaggaactgctcctctccctctcctgctcatctctgcttaccttgttttttagtggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccaggttggttggaacaaggacttgtccttctttccgtgtgctgctgatgcccagggtctgggacaaactcaaggattctgggattctcagcatcaggccgggagggtgagagaggacctctcattatccctggagtcatctttgtctaaggggagaacggcctcaagaggcgagattccagattagtacccagacctgggaggaattaatggaatgcttgtccctgggcgccttagaaacagaccccagcttatctaaggctgctccgaggcagtgacccaactagggctcaggaagtcagaagatagaccagctaatagtgatcacctcttgacctttgtgtcacgtcttttgctttttaaaacccttttgtgaacgttatggcctttgatctgacggcatcctagttgtgaagggaacagggcaggtataatgttcgtttaccaatacagaaatcgagacccagagatcacaaattctggagaggctctgggctctccagagtcactcagctggaactgacagggctggaattagatccctggccaggccaagggtgcattcctctgagttttttcagatctgctaggaagtgtacagtccgatacaccctcctattttgttagctgtggtctacacagcctagtatacatagacctttcagcaggtcgggtcaggcataggaaggcctggtccttctacacagcacttgttgaggaaggccatccaggtacctgaggggttgactggttctgcctgaaccaagataagaggtagggagcagcgatggctgggaattgcagtgtccagacattctcacagtggggatcaccttcaagaaggatggcattccttcttgaagtggctttccctcccaggaggctaggagggcctggggacgtgtctgccagaatcacctgggtgggaagggggtcatgttcagcatgtgtgtgtgtgtggtacatgtctgttctgtgtggtgaggagtgccccatcccagatgggagcctctgcttgcagggagactggccacttgacctgggcaggtgagtcttcactggcctttcgatgtaagcaaattaaagtggctccatagagacccaccccatctgcaatcacagtggtacattcctgcagttctgccccttctcggggggccttgtgggtgggtaagctgctgctgtcacatacagagcaagggtggccaggagtgcaccgctaagtggtttctcatctaggtgggcagctgtctgaccagaggctgccgtgcttacatcagcaacaacagcagtcaacagatttgtctaaagtgtttttcgagtgcttttctgtatgtggcttaaaggccgaggtgaggctgccgggctgtcaaagccactcaagcagacatctgagcaaatctctgaccaagaacccaggccatcgatctggtgggatggccgctccacaggaagctgagggtgggggagtcacctttcctcactaggagctgtttgcttcagcaaagcaggatttgaggagttggggtctgaagggggaaaagcttgctgaggtggaggtggcgataagcctggacttgccctcacctcaccccacaggccaggattcgtctttgggtttcagggtgcatgtctgtcttagcactgactgcgtgccaagccctggatgttgatcaggcagacacgggctcagcccttgaggctcacagtccggtgggttgcacaggcagcggcagctgatccctcttaccgggtctccttctcgggactcccttcagtccacttaccccgtttctgccccccaggccttctctgggcagtgactgtgagggctgacaggaaaggcatgtgcagcgtgcttgtgaggagctcagcacagagggtggggtgagggcatgtgttgctgaagtctgcatcctgaggtgcctgtggcaaaccactcttcccttctgtctcctcagttcagccaggccctggccatccggagctataccaagttcgtgatgggggtaagttgtgccagctgtccttccttcccactgccttgcggacccaagcggggcctaggaggccaaccctggtaatggctggaggcaggtcttggtacagggtgttggcgtggtgtgtccctgctccctgggccggggtgggtcactggcactcaggcctctctgggtttcagattgcagtgagcatgctgacctaccccttcctgctagttggcgacctcatggctgtgaacaactgcgggtaggtgtgcgcccctctacttgccactctacctaccaaggctgtggggtgggggagacccaccgagcccttccagcactctgccccctcccacctgctctgtgtgtaggcttggcctgccaggcaccctggcttccgctgggatttcccagcaccccctggggtaaactgtggtgtcaggggtcagggtgtggatgggtggtagcctgaaggcattccttcttgaagtggctttcccgtggctggctgtcttccactgttctctgcatctacactctccttctccggcaggctgcaagctgggctccccccttactccccagtgttcaaatcctggattcactgctggaagtacctgagtgtgcaggtgagcaagcactggacggcggaggcctttcctgttctttgctacatccttcagctgaaatggttttgtggatgcttcattgcatgcaaagataagtggtttcatggaattcaatattgtgaggagatacttggtatctataaggcatttaagttttcatcttacataatttcagaaaggatttgaggtggctaagtgtgggtttattttaagattatacatcagacaagaccttttcttctttgagtcttaaagactcttaggataaggataagagaactctggcccaggtggcaggtggtaaagcccaagaactgcttctccttcaagtaacatgggctgaaaattcgaggtctgtaaccagttgagctgagttcctgggttgttagggcggctggcattggaaaccgactcctccctcctgcaggacattcctgggcccaggagagcctgtgggtggggctgggccacgtggggaactggcagcagtaccaaccttgggttctcgtgttctgtaccgaagctacctctccgtagctggagctcttgggcccagcagtcaggggtccaggctttggccgagggcagaaccttgccttttcctggccttgatttgcctcgcagtgaaatggggcagtggcccggagggagccagaactctgagtggcctcgaggctgagaagaggacagatgggagggaagcagggaggagagccgcagttcttcccagtggccctggtcagcgtgagtgtgtctcgtcctccctatgagcactgaaagagtcctagaccacttgggctctgaagcaagaggggcaatgagcctcctctctagggctctcctacagagtagccccaaagacacccctgggcaggaaatgaaccgctcccttctgcttcaacacaggcagattctgccctccagggatgtaggccgaggccgtccaccccggagctgggtctttgagctcctggacccttctttgcctgacactggccttcctctcggagggacaaggaagcgtggcctccctttcactcaccttacttttccttctggtccagggccagctcttccgaggctccagcctgcttttccgccgggtgtcatcaggatcatgctttgccctggagtaacctgaatcatctaaaaaacacggtctcaacctggccaccgtgggtgaggcctgaccaccttgggacacctgcaagacgactccaacccaacaacaaccagatgtgctccagcccagccgggcttcagttccatatttgccatgtgtctgtccagatgtggggttgagcgggggtggggctgcacccagtggattgggtcacccggcagacctagggaaggtgaggcgaggtggggagttggcagaatccccatacctcgcagatttgctgagtctgtcttgtgcagagggccagagaatggcttatgggggcccaggttggatggggaaaggctaatggggtcagaccccaccccgtctacccctccagtcagcccagcgcccatcctgcagctcagctgggagcatcattctcctgctttgtacatagggtgtggtcccctggcacgtggccaccatcatgtctaggcctatgctaggaggcaaatggccaggctctgcctgtgtttttctcaacactacttttctgatatgagggcagcacctgcctctgaatgggaaatcatgcaactactcagaatgtgtcctcctcatctaatgctcatctgtttaatggtgatgcctcgcgtacaggatctggttacctgtgcagttgtgaatacccagaggttgggcagatcagtgtctctagtcctacccagttttaaagttcatggtaagatttgacctcatctcccgcaaataaatgtattggtgatttggagttttt

SEQ ID NO: 6792 - DNA, 309 bp, Homo sapiens
gagtgtcctcctcctcccgtcctgggaaacctcatccaatgggcaaagctgaaagggcctctgacaggcctttggggacctccttatatatatccttacgtatatacccaagataattggaaacttaacgttcacacaaaaactggtatatgaatgcttagtagtattattcgtagtagctcaggagtggaaacagcctgagtgtccgatgacaaataaaatggaaatgttctatagaatgtaatgaatattccatagaatggaatattacttggcaataaaaatgaatgaagttccgattcatgctac

SEQ ID NO: 6793 - DNA, 577 bp, Homo sapiens
tccgttcaaacagaaacttttattgcgaacccccaaaactagcacggttctgttgtaggtgttgttgcagagtgtcgggcacgtttacaaacaggaacagggcacttgctgtcctatcttcctcgcagggttcttgtgacgattacacttaaatcaacacgtataaagcattttaaaaagtgcctgtcacatagtccctgcaatttaaggtctagttgtgattattcacttgtattaactaagaatcaactacaggcgcctagcagtgcctgcatgtgctcacactgaggcactcactaaaaccctcaggatctagtgagggagacagtcaaatactttagagcaaaacaaattttacaaccacggactctgaggaaggcgtgcgaaggctccacagctggggagggtgcccacagtcgccgaggggacatctggatttgctctggttgggagagcattcctggcagaggagatggaaaatgcgatcggacaaagaggctgggaccgcggaggggatcgggctcggggtcggggctcgtcctgcagcaggagattcagctcgcgcagagttccacgc

SEQ ID NO: 6794 - DNA, 147 bp, Homo sapiens
ggtcccagctactcgggaggcttaggcaggagaatggcgtgaacccaggaggtggagcttgcagtgagccgagatcgcgccactgcactccagcctgggcgacagagcgagactccatctcaaaaaaaaaaaaaaaaaaaaattgtg

SEQ ID NO: 6795 - DNA, 153 bp, Homo sapiens
cccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaagaaagcagtggggcc

SEQ ID NO: 6796 - DNA, 1433 bp, Homo sapiens
aacagatggaccattgacaatccatatatttagaaatgatcaaacctaatgttttccttttttaagatgaaagtaaacataaatagagatggtatttttttctgcaattctctttttatacatcttatatctctttgcagattacagttctatatttgacttcccataacatgtcacaggacatgtgctttaaatcccccacaagttgttctcttgtggatatagtctaggtcttctgggttgtcccaaaatatgatgtgcacagacacaaacatattctgtatattggttttgattaacacagaatgcagtgggatttccttcctattatcattatatttcccttaatgcagtccaagattatgtattagtgtctaaagaagtataccacattcttaggtcttttagaaagtatcatctgcctctttggactctgggctatctttactaattcatctcaagtattatttttgtctcttcttttcatctaagactaaatattctccactctgctgttctactcagattaatgtatggccatatggcagtagacttctttatacttagtgctttctcaattttaagatgtttgaatattacactgatgcagaagttatttcataagcatagctttttcttgtgtggggtggaaagggaagaggattaaatcactgcctcacttgagcacatacatagctggaaaatgtgtggaaagtttcttgatgttgagaaaaaaagacagtgtcttgttaatcaataaattccgtttatttttcttttactatgtcctttactatatcataactgtagccttgctatatcctgaactcctcacaaaggccttctctgagccaactaaattaatgataaagaattgtaattcttggctgggtgctgtagttcacgcctgtaatcccagcactttgggtcactgaggtgggcagatcacctgaggtcaggagttcaagaccagcctggccaacatggcgaaaccccatctctactaaaagtacaaacattagctgggcatggtggcatgcacttgtagtcccagctactcgggaggctaaggcaggagaatgacttgaaccctggaggcggaggttgcagtgagccaagattgcaccactgcactccagcctgggcaacagagcgagactccatctcaagaaaagaaaaaaaaaattgtaattcttatacccttgctctgcttctttatcattgtgtaattttaaaaacaactgacatatattatacaggtacttgtttattgtctatttctaccactaaaatggaagctccaactgctattagattaatttccctcccaggtccaattttgattatgttactctgaccaagctgatcttttctcttcaatctagaccttttaactaccttcaaaaatacaataaatataattattctagact

SEQ ID NO: 6797 - DNA, 1434 bp, Homo sapiens
aacagatggaccattgacaatccatatatttagaaatgatcaaacctaatgttttcccttttttaagatgaaagtaaacataaatagagatggtatttttttctgcaattctctttttatacatcttatatctctttgcagattacagttctatatttgacttcccataacatgtcacaggacatgtgctttaaatcccccacaagttgttctcttgtggatatagtctaggtcttctgggttgtcccaaaatatgatgtgcacagacacaaacatattctgtatattggttttgattaacacagaatgcagtgggatttccttcctattatcattatatttcccttaatgcagtccaagattatgtattagtgtctaaagaagtataccacattcttaggtcttttagaaagtatcatctgcctctttggactctgggctatctttactaattcatctcaagtattatttttgtctcttcttttcatctaagactaaatattctccactctgctgttctactcagattaatgtatggccatatggcagtagacttctttatacttagtgctttctcaattttaagatgtttgaatattacactgatgcagaagttatttcataagcatagctttttcttgtgtggggtggaaagggaagaggattaaatcactgcctcacttgagcacatacatagctggaaaatgtgtggaaagtttcttgatgttgagaaaaaaagacagtgtcttgttaatcaataaattccgtttatttttcttttactatgtcctttactatatcataactgtagccttgctatatcctgaactcctcacaaaggccttctctgagccaactaaattaatgataaagaattgtaattcttggctgggtgctgtagttcacgcctgtaatcccagcactttgggtcactgaggtgggcagatcacctgaggtcaggagttcaagaccagcctggccaacatggcgaaaccccatctctactaaaagtacaaacattagctgggcatggtggcatgcacttgtagtcccagctactcgggaggctaaggcaggagaatgacttgaaccctggaggcggaggttgcagtgagccaagattgcaccactgcactccagcctgggcaacagagcgagactccatctcaagaaaagaaaaaaaaaattgtaattcttatacccttgctctgcttctttatcattgtgtaattttaaaaacaactgacatatattatacaggtacttgtttattgtctatttctaccactaaaatggaagctccaactgctattagattaatttccctcccaggtccaattttgattatgttactctgaccaagctgatcttttctcttcaatctagaccttttaactaccttcaaaaatacaataaatataattattctagact

SEQ ID NO: 6798 - DNA, 577 bp, Homo sapiens
ctgaggtgatatattttgactatttttgacatatacaacctgcttatgtggtattttttactattaataaatgctaaatatcaaaccttctgtttagctcttagttgacatgaatttatagaccaaggtaaaggttaacacactacattgttataacctatattaacaaagaattaatactcttctatgtaatatttttagcagaattattttgttgaaaagtgccaagtgtttgtttcctctttgttcttcccctttttgttgtaaaattgtttcactttgtagcaaatgatgaaaacattattattttctaagtgttatgcaaatctttataatatcagtatacattaaatatctacctatttagtattctttctctagtaagagcttaccttctgtgcattctgaaatgtacaactttttatgtacaaaaatgtctgttttagcattatgaggaaatgaatgcctatacagtggtctccccttatctatgttcttgtgttccacagtttagttacctgcagtctgaaaatattaagtggaaaattccaaaaataaactacttataggttttaaa

SEQ ID NO: 6799 - DNA, 196 bp, Homo sapiens
aaccccgtttctactaaaaatacaaaaaattagccgggcgtggtggtgggcgcctgtagtcccagctactcgggaggctgaggcaggagaatggcgtgaacctgggaggcggagcttgcagtgagccgagatcgtgccactgcactccagcctgggtgacaaatggggactccgtctcaaaaaaaaaaaaaaaaaa

SEQ ID NO: 6800 - DNA, 577 bp, Homo sapiens; identical to SEQ ID NO: 6798

SEQ ID NO: 6801 - DNA, 196 bp, Homo sapiens; identical to SEQ ID NO: 6799

SEQ ID NO: 6802 - DNA, 4454 bp, Homo sapiens
atgattaatcactaaacaggtattgcataaaatagcaattttcagctctggattttggggaagggagtagaggctggaaatgtaggtggagagtcaggctggggagagatgccacattcgcaacattgggttttttacaatagtactgcatctatctctgtgcaggagtctaaaagtggttggaagctacatttaggattatttaaaataacatactgccttatttttatctctgtagcaacaactttttgtaagaaaaatagctagttccatgatcttttgccttttgaaaaggagagatctattttaaactctttgcaggctcctcgaagttccttttcttgctgttgagtagcaggtagaatctctagttcatggaggtctgacggatccatggtcccgtgctggtccatgtgctgccctctgcttccgtccctcatccttgccactctcaacagtcttccccgacaacccttaggaagacaagggcttggaggagggggaggactgagtgtccctggcatgttctgattaatcctattcattgtcaagtacagctttttaatgaactgattcattactgagagtaggtctcatgcaaatccctagtttgtatcctgtggatttaatttctaacaatttcctcatttcaacacaactccattgtaccatgggctttgtgattttgttctaatatagagcttgacctcacattttaagactataagatgaatactaaaaaaacgaaatccttaaaataaaaaataaactagaagaacatgtaggtggatattcaactcctctctaaaggaagaagggttgtccacacataaaagttttggaagagactgggtttagtggctcacgcctgtaatcttagcactttgggaggctgaggtaggaggatcacttgagcccaagagttcgagaccagcctgggcaacataatgataccctgtctctacaaaaattaaaattagccaggcatggtaatgcacacctgttgtcacctgtggttgggaggctgagtgggaggatcgcttgagcccagaaggttgaggcttcagggagccatgattgcaccactgcactccagtgtaggtgacagagcaagaccctgtctccaaaaaaaaaaaaaaaaaaaaagaaattctggaagaaatgacagaggaaatcactgataaatttcgaaacataagtttgtgcaatatcagagacaaatttaacaaatatgtaaaatttgcctccattatgagttaatataaaactatgaagagttcaggagattataaaaagagacaaagacaaccaggagaaaacagataacttaatactttttaaaaaaacaccaggctaacaaaaaagaaatatatagttgactaaataaatatagcacaatatatttaaccctacaaatttcaactaatgcaatgaaaacataatagcagcttttcaactgttattattaccagaaagaaaaatattttaaaatgctattgtggttttggtgagggaacatttttcatgccctgttgtttgagagtagaattcagtgcaccctttctggaaagcagtttggtaacctgtaatacttcttttaaaaaaaaattcatcctcttgtctaaaaatttctcctctagaaacttaaagataatagtcaagtgaaaacacatttatgggcagtgtttaaagttttgtgagtgaaactgttgataagaacctattacaatggttaagccacctggaacattctattgatatattatgcagccttggaaaatagtacttttaaggaatgttaataagatgggcaatacaaaactgaatgaaaatccaatacagaattctgcctacataacatgatccaaattttgcctaaagtttgcctaaaacgtgcatagcaaaagaatttcgggaactacaccagaatgttagcatgggtccatcatttctgagctgtggtgttactggcatgactcttgtttttcttgtttattcttttatgttatattaaggtgaccacctgttcccgttggcctggtactgccctggttttagcactggaagtcctactctggacaattaatgattcgtgtgtgtgtgtgtgtgtgtgtgtgtgtgtgtgtacacattaaggtgaggttgtgcccatttgaaaggaagggccaaagataaagtgacaagctcatggggcctgtgtggtagtcaggcagtagatttttttttttttttttgagatggagtctcgctctgtcacccaggctggagtgcagtggcatgaacctggctcactgcagcctctgcctcccaggctcaagcgattctcccacctcacctgcccaagtagctgggactacaggcatgcacccccacacccagctaattttattttgcattttttgtagagacggggttttacatgttgcctaggctggtctcaaactcctgagctcaagtgatccactaccttggcctcccaaagtgctgggattacaggcatgagccactgtgcttggcccagggagtagattttctgatgataaaattaacgtgacttgttctagaaaatacagggaaagagtaaatgtgcaaagacttaaatagcatttacatgtagcccacagtgctctaaatgcttttggtggttcacagtttaatcatcataaccctatgaactagatactgttgttgcatccccatttacagaggcatagagacatggagtaattcacccatagccacacagcccttgacagaatctggatttgaactcaggcagttcggatccagagtctgggccattgaccacctcctgcatctctgtagatccccgactccagcctctcctcttgctgcctctctcaacagtaacgatgctgttactccccacgccaaacctctgggctggccaggctcactccagtcccacagtcattgccaggactgcctttgaccttacacagaggaaacatcttccacctgtcgggagggagccggggcggggatttccatggcagagttactgttctctggtgatagagttctttcagttttgctacatggtcttgtggcaaaggactgggtgcaggtgcagccttggttatttctggaaacacttctccttttcttttattttgccaggtctggctcatcagtcaccttcctctcagaaaggtgattttggctcctctgcccagaccatcaaacatttctggaggtgtcacaagcttccgtgagggttctggtctctgcgaattgcaggaagaatccaaacataggaaaggggtgatgtgtatcagggtgtccatcctcagctttgctccacaaagaccctcacacttgcacattgttttgttaacagtattatctctgagtagtgggtttattgtttttgcttacctgttttaaacacttcttcaacaaacttgctttactttccattttttaaaagtgtatttcaattttttattaataatgccattttactcctgcaaaatttctcactccttcaaagtctgtgtatggcaaagatcttcctaaccatcattcaagttagagcaactccatttctgtatcaaaaagaaatacctttagttattgtctgaacttgtcagaatttctgagaacgatgccagaaattctataattgttttgtcacattaattgaacaatgagagggcaccagcattcctcactcatgaggtagaagcaccacatctacatttctttttagctatgggtgatgtttttgcttttaaatcttagaaatctgttaataaacaaataacacaacaaagtttggggtacttccttgtggggactgggatgcttaagctaaaacaaagtttaaatttggactgtgtgtgttatgtttcgcagaatctatatgtttctcaaaagtgggtgtcaccctccttcctcccccaacacacccttcaggggtaagaggagaagtaatgtagaaaaattaactgtttctccactgtaaaagtagggtgtctttagaatgtttcatgttcaaaggaaagattgtgcttctcccaaggcaaggtgttcccttaaaaaaaaaaaaaaaaaaggttgagcatgtctttgtattgctgtctctggaagaggaaatgaggcatctcttggggtgagaacaagggagaattgaactctcgggcctggccagatggattcctcacactggcacagagctgtgaagggaagggcctttcatcctccagaggaaagagggctggggtctcagaggccagagcatagggacaggcaggagtcctgcagccctgatgcctgcccctcccagtacagaatctctgtcctgacccccacctgttgaacctttcaaatcccagtgactcgccagctttctctgtggatattggctgaattggtggcttgtgtggctgcctgggagagcaatttacccctgagccaaggagggggtgggc

SEQ ID NO: 6803 - DNA, 1569 bp, Homo sapiens
cccacgccaaacctctgggctggccaggctcactccagccccacagtcattgccaggactgcctttgaccttacacagaggaaacatcttccacctgtcgggagggagccggggcggggatttccatggcagagttactgttctctggtgatagagttctttcagttttgctacatggtcttgtggcaaaggactgggtgcaggtgcagccttggttatttctggaaacacttctccttttcttttattttgccaggtctggctcatcagtcaccttcctctcagaaaggtgattttggctcctctgcccagaccatcaaacatttctggaggtgtcacaagcttccgtgagggttctggtctctgcgaattgcaggaagaatccaaacataggaaaggggtgatgtgtatcagggtgtccatcctcagctttgctccacaaagaccctcacacttgcacattgttttgttaacagtattatctctgagtagtgggtttattgtttttgcttacctgttttaaacacttcttcaacaaacttgctttactttccattttttaaaagtgtatttcaattttttattaataatgccattttactcctgcaaaatttctcactccttcaaagtctgtgtatggcaaagatcttcctaaccatcattcaagttagagcaactccatttctgtatcaaaaagaaatacctttagttattgtctgaacttgtcagaatttctgagaacgatgccagaaattctataattgttttgtcacattaattgaacaatgagagggcaccagcattcctcactcatgaggtagaagcaccacatctacatttctttttagctatgggtgatgtttttgcttttaaatcttagaaatctgttaataaacaaataacacaacaaagtttggggtacttccttgtggggactgggatgcttaagctaaaacaaagtttaaatttggactgtgtgtgttatgtttcgcagaatctatatgtttctcaaaagtgggtgtcaccctccttcctcccccaacacacccttcaggggtaagaggagaagtaatgtagaaaaattaactgtttctccactgtaaaagtagggtgtctttagaatgtttcatgttcaaaggaaagattgtgcttctcccaaggcaaggtgttcccttaaaaaaaaaaaaaaaaaaggttgagcatgtctttgtattgctgtctctggaagaggaaatgaggcatctcttggggtgagaacaagggagaattgaactctcgggcctggccagatggattcctcacactggcacagagctgtgaagggaagggcctttcatcctccagaggaaagagggctggggtctcagaggccagagcatagggacaggcaggagtcctgcagccctgatgcctgcccctcccagtacagaatctctgtcctgacccccacctgttgaacctttcaaatcccagtgactcgccagctttctctgtggatattggctgaattggtggcttgtgtggctgcctgggagagcaatttacccctgagccaaggagggggtgggc

SEQ ID NO: 6804 - DNA, 787 bp, Homo sapiens
ctcatccagagatgcactgggcacagggaaagctttttttttcaagtagcagctgctattcattgaaatgttacaattttcctgccttagtatttcacacgtccttatactcctcataacattttttgcttgtgtagttttagccccatttcagaaatgaggaacccaggttcagaaggtttagaagcttgctcaagaccccccagctattaggtgccagagctgcaactggaatgcagctttgactccattgtgggtttctgttccattatcaagagtagcctgacagttggcaataacaatgactgaatgaatgaataaatgaattctccaaagaaaatagttcatgtttccctagtatgagggaatacttgagatagttgttttgagaagggggccacagaccaggagacaccaataagtctttctcatttctggtaaatcgctttataatgaccgttattataaagtgtaaaaacaacaacaacaaaaaataataggcgcagtggttcacacctataatcctagcactttgggaggcagaggcgggcggatcatttgaggtcaggagttcgagaccagcctggccaacatgatgaaaccctgtctctactaaaaacacaaaaattagccgggcggtagtggcacgtgcctgtgtagtcacagctactcgggaggctgaggcaggagaatcacttgaacccgggaggtgaaggttgcagtgagccgagattgtgccactgcactccagcctgggagacagagccagactccatctcaaaaaaaa

SEQ ID NO: 6805 - DNA, 622 bp, Homo sapiens
gtatgcacacaaatacctaacctttccaatgtaggccctagttacttccaaaataatttagaagtgtttacagatatgttttgacgattttgctatgatttttcatttattggtatcagaattgaatatatttagctgttgctctctgctaagtaaactgagacctaggtgtgcttaccattgttttctgtgaaaaccagctgatccgtgttacaaatgactgttttagctatggaaacaagacacctctgtgaatatgattccttgtgtggtgggcatcactagagagcaatgactgtattccctaaagagaaagtgcgagagcggcagtacagaccaaggcagaggtggctgaggagattgttccggtcagcaatgtagaattcctgcccctgtgttctgtgaccccaacagagggagccagcacccactgtgcacctcccacacagcccacactgcacaaggcatttagacagtgccttaaattcactccatcaatactgtgagagccccactggcttcccctttggggttttagacatttagggtattcactgaatactttacgttgaagtgtttttctataacattagaaccaggttcaacttaaaaaaaaaaaaaa

SEQ ID NO: 6806 - DNA, 31169 bp, Homo sapiens
  misc_feature (4244)..(4244): n equals a,t,g, or c
gccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtaacgccgcgcaggccggcgccctgccccgcacttggcgcttcgcggggcgtggggcgcttgggcgccgcgggcggggggtcccggggccacgtggacgccgacggctctggtctgcggcgtgcgtgctacgggcgcggggctcggggctcaggggtgcggggtgtaatactgggggcgcggggccgggagcgcggggactctgcgggttcggggctccggctggcggggagcggggggcgcgggcgccgcggctcggggccgggagccggggactgcaggggaccgagggcttggggctccgggtcggggggcgtgagctcagcgggccgggcactggcggctgacgtggcgctcggcggccggggcggtgcgggaggagggggcggaccccgaggggacagccgggaaaagcccgccctgcgccgcgctcctgaattcaaccgcctcttgcacctcggcaccgagggaggggaaggtggggtcgtcgccctttcgggcagccgggagtccaaatgtcaccccgcggtccctgcccagcgccccaaacttcctgtgccggccggacgcgcggcctgcccgtgggccacgtgcactcaccagagcggccttgctgctgccgcggccaccggggtcggctgggacagactgcgggcacgtccccttccagaggctttaactgaaaaatagaacccaggaaggtgtggtttcccactttgtgcgtcttttgtgggataggaaggagtggtccgggcagaggagggttgctgagctaccccgggaagaccaaggtagtgcgaattctggaacccctccgcccccctgcagctcagggtggatgtaatctctgaacggagcccactggtcctcaactccaggctgtcctgtcacctccctgctgctctctcgggtccaggtcacttgttatgtgtgagatcggaaaagcccctccgttgagcagatggtccctcttgctttggttctctgggcgaggctttggtgtgggcctcgctgctgacctgagagaccctaccctggcactcatcccacggaagagcttcctgtcattcacacaagcatgtgcacagctttcctgccagtgccgggatgccccgaggaagggaagtgaccacaggccagagcagaaagccataattttaggacacaagacctttgagaggttggaatagcctgcaggttcttgttgcagaacttggtattcttccccagagctcagtagaggctcacttgggaaagggatgtagggaggcatagagaaaaggtaccctaagaaaaatggccagttcagaaattgtacctttcaaactgggagaaacgtttttctcttaaccttgtattcaggctattactgcgtttcagttcatttggagttaaatcaactttttgggccagtgtgggtttattaacaatgtgtatatgaagtacattatgtttcacattcctaagaaccaactgactcgaatttttacaactccaatggtttagaaattactttgtaacataaaacaatcaggcagtattaacagtttctctttgttcgggagtattctcagcaactatttcaattaagtgtactacttaattggagcctatttcagtggaatacatctgtcgatgggttttcttttttctttcttcattatttatttattttagagatgggatcttgctctgttacccagcctgaaaccagtggtacgcagccgcagctcactgtagcctctaactcctgggctcaagtgattctcctgcctcagcctctgaagtagctgtgactacaggcgcaggtcatcacacccagcttattttgttgttgttgtttttgttgtagttggtagaaacagggtctcgctatgttgccggggctggtctcaaactcctggcctcaatcagtacttctgccctggcctcccaaagtactgagattacaggcatgagccatcgcatcccattctttacttttttttttttttaaagaaaaactgacatgcagatgtaataagtccccacagtgccaaaggaattttaagtttagaatctttgcaataaataccagctagtcctgggctgagtgagagaaaactggcacatctgggcacttggtattaagtaaattccttttccattatatgtggcttgtagacatttagctggatgcttccagaataattagctttatgttgttacttttttttttttttttttttttgagatggagtcttgctctgttgccaggctggagtgcagtagcgcgatcttgatttactgcaacctccacctcctgggtttaagcgattctcctgcctcagcctcctgagaagctgggactacaggtgcgtgccaccacgcccagctaatttttgtatttttagtagagatggggtttcaccatgttggccaggattgtctcgatctcttgacctcgtgttctgcccgcctcttcctcccaaagtgctgggattacaggcgtaagccaccgcacctggcatatttgttgacttcttgatagtctactacaaatacttaaacagagatatgtgggtttctatgatggtgtttaagttggacttttaagagggccctttcagaaaactgcagatactgcagtagggctcaggaataggctgccaggaaaggaggctgagtgggcggcgagtcaaatgggaggtcagcaggggcaagatcaagtaggaccaacaatacctggcacaacactttggtaagttgtaaggctgagagcaaggtggtgactctggaggggtctatgcaggagagggaaggaggtcctggagtggtgagctgagcgtttggagctcagatagaagactcagtggactccccctcaacacacacatacctttttccagtttcagctgccgtggagtggtgaaagcccacgtgtgattaaggggctggggcccctgtaacaaaaacatcaatctgtgtatttttgccctgcacttggcttctgcagggttatcctgctgctgtagattttttgccaacatcaggtcacaacttctgtatggccagtttgtgagtcacccttgacctggtgacagtgaggtcaagatttggaccaggtagctttgctctacttcttggccacaggctaccttctgagtgcagctgcctgtctcagagttgggtgctgtagccgcagggccgactagatagcacctgtggccccatcacagccaggagcaagggcacgcccaacttggtgatggcccagaatggtcagttttgatttagcgcaccacaaacttatttattgtttattctcattcttaatctaatcttgtgttttctcaaaaaaaaaaaagggaaaaaaaaagcagtagcaaaacaaaaccttgtcaagattgcagaggagttctaaagttccagaatgagcatatctgatcaaagtcccctgaaggtcagaactgcccttgacagtcccttaggaaggtgccttgttggacaccgccccagtcagtcagtcagtccccactgccagcgtttcctccagcattagaactatcatggcttctttggttaaacaccaaatggactagttctcaaacctgtgcctttagacaacagggtcacacttaatgtagtcggagagatgctcatgccatgagaagcatgtaggaaccaaggcctgctgaggaacaaaaacctcacatctcccagcttgcacacacttcagggttctgtgggaattgcctttttttttttcttgtttccttctcccccgccacataaactcactttgttgaatctacagaagttaaatctgcatgtatagtttcattgtgcttttttttttgtatctgagtatctcataaagcagggattctcttagctggccaagaaagtgctgtttagggaagacacattaacttgaagcagactttttcagtgctacctttaagtctgngtttttttttttttttttttttttttttgaaatggagtcttgctctatcgcccaggctggagtggcaatagcatggtctgggttcactgcaacctccgcctcccgggttcaagcgattttcctgcctcagcctcctgagtagctgaaatacagggcgtgtgccaccatgccccagctaatttttgtatttttagtagagatggggcttcaccttgttggtcaggctggtctcgaactcctgaccttgtgatccgcttgcttcggcttcccaaagtgctgggattataggtgtgagccaccacacccggcttaaatcctttttttcttaagagacaaaatctctgtcacccaggctggagtgcagtggtgtgatcatagctcgctgcagcctcaaacttctggcctcaagtgatccctctgcctcagcctcccaggtagctaggactgcaggtgtgtgccaccacaccaggctaattttttaaaattttttgtagatgggggtctcactgtgttgcccaggccagtcttgaacccctgggctcaagcagctctcctgccttggcctcccaaagtgctgggattacaggcatgagccactgctaccgacttaaatgcttatttttgaggtaatctgtcagaaaataaaaggagatttaacagattattaaattattttgaggaagaagtcacaattctaagcgttgagtgttcatataagcaagtgtgtttaaaaaaaaagcattttaaaaagcgatacagcaaagtggttacattgtaggcatcagtgtgttcctgccatattaaatagcaaacaaacccatgtgtcataatgctatgggattgtagttgaaacctgggataaagtttctagggttgtctcattcaaaattcgagtatggcactgtagacatactgtccagagaacacagcaagagctgtggtcagctgtatgacttaaggtctagtgttgggaaagatgctgatatcctcatgaaatgtgaagcatggcaagaagcctaattaagatactattttaaatgatgggtgattttaaaatatttatacataactgaattcatacaatgaatactaagaatagacatttgcttacttcaaccctagaagtataggtggccacaaactttttttttccccttctcattggagaaaattgcaggtgattaaattttgagattgccttatgtttgtagccatttggttatatagtggaggagacttgacgaataaaagtagcagatacagcaggaagtgctaagctactgtccaagggaggagtagagaggctttccagaagggcaggagaagagaatgggtgctgaacagcccggggagtcagggccaacttgctagaggaagtgacacccaaactaaacctgaagggcagatagatttagctaggtggagtttagggacgaagtgtcagagagaatgtgtcccagggccaagccaagctatagtcctttgggaacactgcagatgctgcagtagggctcaggagtaggccacaagggaaggagggtggactctgggatagaagtcaagcgggaggtcagcagggccagaacaactaggatccagaacaacactttgctaagtttaatactggaacaaggccaagatttcatgctgagaacagggcagtgactctggagggatgggagcaggggagagaggtcctggagtactggtccaggagctgccatctgcaatggtgtaaagaaaggactgagagccccattgtcccctggacagagctgaagttgtgggccagctgccctgtgacctgatactcaatgtgcttgtactcttgccttgttccaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccacgtaagttggaaggaagggggcacacttcctaggtggctcctggctacaaagaaagtcctagttaaacttttggtaaaggtgtgaagagatactaaatttaagcaggcagtccctgtcattagggagaaactgcatttaatgctgtgtctgttttagatggcttttatacttggataacctttaattcatcagtgttgggttttcctgtttataagagaatgtgtttgcaagagaaaaatgacggtcccgccatgctagatgttcaccggtacattttacacagtgtgcatggactgtcatcagttttggcttgcttttgctggtgacttattcgcaaacacccttcctatagttccttcccgtgtgactcccacagggctgttcctgttggaaagaaagtatagagtctgacagacgatgatacttacttccttgacagttaagaatttttttggttataagaaatagaaattgaaatgttctcaattctagaaatagaattgttctcttattaaacagaaagaaaggactatttaaaaggctgtggaggaacctctgagagccagctccaggggcctggggtctgtttctcctgcacctcccttgagatgacggctttccaggcctgtatctctgtttgcacagaagggcccaccactgactggccctgcttggctggaatgttcgttccaggaatagtcactgtggccagggaaacaggagcttatagcaagacacatgcccattcacaccatgtgccaagtgttggagggaaaagcagttcttcaaaaaagagaagaagctgtttctgaaggaggtggagggattgccacggtcacttccttgctgtttgtttcaattgaggaatgaagtcaattctatacaatttattgcttaattgaataatataggggtccatcaataaagcaaaaaattggagcttatattcaaacctgggaggcagaaaagtggagggatctccaggcttgaacctagaagtcgtagtcaaatcccagctctaccatttacttaccacccagctctgacctcatcacttaacctgtaagtaaggtgatcccccaaacattgttacaggacttacatggaatgtgtgcagacaccaatctgagcacacccaatacatgttagggttttccctaccatttggaaatgtgggtgtttccacaaaggaccctggaattcttggtctttggtgactgcttgctaatgtaagtgccataatttgggtttactttaaatcagatcaatggagataaaattgcttatctgtatctacgtaaaagcattaactattctatgctttatagtattgcattgaaagtatggatcaagagcatcccaaagaagcaggtagtgagcagagatgagggcgaggaggtgaatgcttacctgttgagagactgttgctttcaaagttcaggggcagcaggggtgagctggctgtggtgtctttcctcttaacctgctgaccatctgtggcctgagactatgtgcatcacacaccatgccacagggaaggtgacacaggacctgtaatggagctgagagtggtatgtgttatggggcttcagagaaggaagtgaaggcttccacctcagcctggccataacagctgtcagctgcaatatcagctactccatagttggtattcaccaaaaaccatcacagatttaaaaagtcacaaatgtaaaaagtcacaaatttaaaaaggcccatgttggatcatgtgtttagatttttaatgagaagagctggtctccccaagtaaaccatggctggttttgtgttattaaaaagaacaaaaatgaacgtacaccacactgaacacagtttgggaaggaacctctgtgaccatcactgccctgcagaagctccaagaacagattattttccccccgagaatgcaggaggtggaatgtgctgtgtgcaatgtggtcgcactggggcatctgtagattgacttgagcgagctttgactcctctaagacaagtgcccatcccatagagtggttgtgaggcccgaggcaggtgacgactgtacctgcctgagtccaggcatgtgtcaggacatgagctttcacgttattctttcctggcaagtgtaactggagtaaaggattggaggggcagggagtttgggctcccacgctccctagagatggctggctgtgctcaggaaaatgttttgaggtcttcctgttgggccagtcatgaatcattacagcagggcaggactgacggggggaactacctgtgttagtttcctaggctgctgtaacaaagttccacaaaccgggtggccagaaacaatagaaatgtattctctgcagtcctggaggccagaggtcctaaatcaaggagccagcagggtcatgctccctctgaaacctgtaggggaatcctcccttgcctcgtcctggctcctgttggtttcctggtcatctttggcgttccttggcttgtagatgcatcactgccgtcctctgtcctcacatgcccttctctctctgtgtgtgtgtgtctctctgtgtccaaacccttcttacaaggacaccagtcatgctagattggggcccatcctagtgacctcattttaacttgaatatatctgtaaagaccttattctaaataaggtcaccttctgagattgatggttatgacttacacagatctgtcttgcaggacacagttcaactgataacactgtctacggtagtagaactttcatcatgctgtttgccaaggcagtacctacatggggattttctccctgcagtctccttgaaaaaggagactcaaatgcccatgtggaggcttggtaatagcggaaatctggggcaatactttgtttgggcttgtaccctgtggcccagtctccatcacctccctcacccctgtcgacagtgagaattgaagtcagatgtcccaaactcactgcaaggtctggaccagaagtgtccgctctgtccctgggctctgtgaacttaccgaggaagaatctcagacttcctgggcaggttagaacgattatcagtccaacaacaagaagatggttttttttaaattatttgttttgcaaatgaatagcaaattacaaaaaaatcataggctaggtcttactgtattttacttttagcaaagacacaagtgtgaccgtccctggtcctttctgatgtcttgaggatccacccatttcccttcctgaagagcgttagcgggaggcagagccgtgcaggaagcagtttctgtttccaggtgcggaacacaccttgtgggagcctggggaggtgccaggctaggtgagggcaatcatctttgataccgcagatgttgcagttgcttatcatgttgaacttcgtgacgtagccggtgtactggccaaatctagttaagttttggctgttttttgtggttatgagagtctgagctgctgaggaagctgggtgtatattctgcactggagacacattagggaccctacctatgccccatcataccatcttaggttctgggtaaggccagtatgctgatactaatttcaaagcctaatctagccatgtgacttcattttaaggagaattagccatttttttttggactgaatgtgtgtgtaccccagcattcataggggaaatcctaatccccaatgctggcaataggaggtggggcctttgagagggagcaggttattagggtggagctctcatgaatagggttgcataccttatgaaagaggccccagagagttctgtttccccttttgccatgtgagggcacagcaagaagacaccatctgtgaaccagaaagccctcaccagacactgactctgctggcaccttgatctcagacttcccagtctctagagctaggcgaaatagattctgttgtttctaagacacccaatctgtggtcttctgttacagccgttgaactaagacactattcaaaccttcatgtcagattttacatatgttgccgtcttacaattctgataccgtacattgggcatttactcacaaaatccacatacgcgctgtagaagtggcaggggtgtttagatgagcaggcttgccaacaaatggtactctgtatttcttttttcttctattggtagtcacatttttgcctatccttgacaccttctatgaatttttatctagagtattagagcacgttttcccgtgactgctggagggatacaggaactgagtgttaatttcatcctctggtgatgtcttttgcttatggttaaaggacctactcccgtatcctctctgcagattccttcagaggccagcatttgtaggaaaaagaaaagattccttctctatgggaaggtgaatggacagcatcagtcaatgtcaaggatgttcttatagctggaaacttgaattctcacagtaactggatattcaggccttgtaagagttgaatacctgccaggtggcctggaagaataccttaattgcaaaacaacaccgtgtctgctccagtcctaatttgaacacagacacaacaactgctgaagccgggaaagcataacagtagcttgcagggaaggcccgaggctgctgcagaggagcactgagtactgtagcttttgaggcctcagtcacagcagcgggctggaagttttcacctcattttagttttccttgaataaaaccagaaacttctgaaagtttaggattaactgaatgtattatctcctggaacgttatgtttgtttcctttttatcagagaggagcagatacgtgcctggctgcagccccttgacagctcattttctgattgtttcactaaatgagtttgctctctgataagacaactttctttttgctctgtctaatcctttgttattctttcagcttaaagcttttcaagccaggccaagaagctgtgaagtaccagggtcctcgggacttccagacactggaaaactggatgctgcagacactgaacgaggagccagtggtgagtgtctacctccttccctccctccctccctccctccctctctccctgcctacatctttggggtaatatgtaacggggcagaggccagttgaggttaatgattaaggctgccattttaaagcaactctactttttttggagcttattgatattataggtaaagatgaacttttacagaaactttttggtgtggaaatacctaaatgtgcacaaaagtcaagagaaggctaaaccctcagtttcagcagttaccaccattttggtgtttgtcttccccgccaccctgcgccttgtttggctgtagtcagtcttcagggaagtcacttgtgtggcctcacagataagcacttactctttgttaacactgccaccctgccactgtcacaggtaatacagttcacaactgtaccctagcatcagagactgactctggaccacctggggtcagggctgggcccagcctagaatctcctatccaagccagcactggagcctcctcccatccccccgacctttgccctccaccacctgcagccctctggctcgggcctagcccgacagctgtacccgtagggtggatccttccttttcttctcggtgctcagtccccgagtctctaatgggctttgcttataacatcattttgtaccattaatactctgtgtcttaatgcacttcccttactaaggctaatatcaggagattgtagactcttagaatattatgtactaaaaaggatttataatcctccccctccccagttgatgttggaagtcttcacttttttataaatcatgatcataaaccactggttaagtgttcctttgtgggtggtgccttctgattaatgccgagtgctcaggtccctggatgccgggtagacctggtgggtcatgctgctgtgttggagagggactggaaaaacacccgtgttcctacactgtaggatcctgatgagctaggaagagcatctgaagtctttgtaatttcaatttcaacaaatacctaagactaccttcttgtatcagctaagcgcccactgatttgaaggtggtctgtggtggtccttttggagctttgccgcttactgttgccagtttccagtgtgtctgtgcggctcttccgctctgccccatcttctctgatgacctaatcagaaacttggctgctgattcagtgcttccatccctcacctgcaaagactctctcaactcggctgggtgtggtggctcatgcctgtaatcctagcactttgggaggctgaggcgggtggttcacccaaggtcaagagttcaagaccagcctggccaacatggtgaaacgtcgtctctgctaaaaatacaaaaattagccaggtggtaggtgcctgtaatcccagctacttgggaggctgaggcaggagaatcacttgaacccaggaggcagaggttgcagtgaggcgagatcatgccactgcactccagcctatgcaacagagcaaaaactatcgtggaaaaaaaaaaaaaactctctgaactgtatggtggagactgttggtgtgtgatgttatgtcgttgaaccagagacttacctaactttagctaaaagaaccacagacctctcaggaaatttgcatctttgtcctggcaagaaagctgaatgagcaggtgtgactttcatagttttcaattggacattgtttcctttgtgaaaatattctctttgtggggacacatatattggatggtagcaaaccaattttaaggaggagttaatagcctcaaataaatttcaccaaaaaagccagtcttctatgatggctttattcaagaaaccagcagccagtatcaggacggcagaaagacctcatctcatggcccatttcccttagtggaggtggcggcctcacctgcaggttggaaagggctgagaggctgcgtccaggctctgcaagggactttctgtctcctcagtgtgggagcaggatggccgcgtgtaatccccccatgccaccccagaaccacagtcaccaacttgccatattttagtgtctccagcaatagcaggccccagataattgccagaaacaatgacaatgcgccttattgtggaaaagtttaagtatatacactttatactgcaaaccagaattctcttagctttttaagtgaaaactttaaaaaaagttctttatctgtatacctaagtaacttagtacatacattttttaatattcacgtgggataaatttagatttttttaagtgttgtggcaatattcaagaaactcaaaagacaatttgtcactttgtacattctactgcaatttttgtatttccatgtttgcttctgtattttttcttgaacagttatacaaacatgtttcatctcattaatgattttatatatttatgtggtctttatattgatcatgtcttatattattttatcatgtggatttgccataattcaactctaattctgtcagtggatatttaggttatttataccttttccatcatcagtaatgatgtagggaacaagtttatctttgtaaaggactttccacccccccttcttttgagtgatatttttagaatatagtattcccagacataaaattataaggccaagaataaaaaaaaagatcatttttatggctcttgatgaatatagccaggtttcttaagcaccatatcagcttatgctgccactgtagggcaagacgtgacctgtttctgggatgcactgtggtgttcccgtgccgggggactgctctggagtctgccaggaacccaggaagcaactagaggccccgcatgtgccataaatgaacacttcatactgaaaggcccttgaacatctcatggagagtggcacacggtattttatttcaccttatgtgcacccattgactgttcacttagccattcttcccttgggcattgttttgtgtgggtatttagcactttgaaagtcttgacgcgctggcagcagaagggaaactttgtggttctttatgattccagccctgcacagctttgaactgtcagcacctttaaagcctttaacaacttagcttggatattctttttaataggaatatgaacccccagataaaagctgagtaatatacacttaatgtgtctgcagcagaacactgattccattatctttccctcatttctggttactttggttggaagccacagctgtacctggtctgaaaagttgagaaatgtaggattgtgactagacagctgcacacattgctgtctgcttgggtcctggcagaagcatcttttgaaaagcccctttccccctctttctgtacgagacttagtcatatgaattacattctttcttgaaggtgcagcttatgttcatgccatggttttctctctgttgcctttcattcacctgcattttccttctcatcacctccttttctctctgatcagtcttccacagttgtgtcttcctcacagttttccctgtcatttgtgtaaagtaaggataaccaggccttcctggtccctgagtttctcattctcagctttgtccattttgctaccctcgtgtctgtttgtgtgttttttgaggaagagtctcactctgttgcccaggcaggagtgcagtggcatgttctcagctcactgcagcctccaccccctgggatcaagtgatcctcccacctcagcctcccaagtagctgggaccacaggcgcacgtcaccatgctcaggtaaataaaattttttttttgtagcgatggggtctcactctgttgcctaggctggtcttgaactgctgggctcaagcagtcctcttgcctcagcctcccaaaatgctaggctgtcacctaggctggtcttgaactgctgggctcaagcagtcctcttgcctcagcctcccaaaatgctagggttacaggcacgagccactgcgctgggcactctggtgtctgcaagtgctgaccccttcagaatacgtccattgggcgttgtattttgtattctttgtgaagtatccaagtacgtttcaaagaagaggacagggtatagggtaagactgtcctttgcattgtctgctttgtttggttgggttttggggtagggacagctatcacttggctgccctggagactcagacctagagctttcactgagggtgaggctgacgagggggctttttgctgaagcttccagagggcttgacgagatcagttcctgacctggcctcactcagcacagcagcatcgtacaagggttcccaggttgttgggtgagggaggcatctgcaggcggttccccacagacacagtcacctcctggatggtttccctgtgtctccactgacacacccatgactgttttatttcctcctgttagacaccagagccggaagtggaaccgcccagtgcccccgagctcaagcaagggctgtatgagctctcagcaagcaactttgagctgcacgttgcacaaggtaagggggacgtcctgatgccagcttcagagaatcactattattccttggcgtgctgggcttttccttcctgctactcaagggctcttagatagcagcatcagtggcactgacaaagggtcactctagaggagctgttgggaccgttgttcagtgcacctcctctaaaacatgagttctccttttgtctgtgcccttatagaaacgccgagtctaatgctaagcacacgtgacccgcacactagctggacagtgcatccttggctaagagtgtttattgacagactcacctcgcttgattgctctttactttattgcactttggagatactgcatttttttacggattgaggattttggcagcccagcatctggcaggtctagcggtttttccagcagcttgtgcttactttgtatccctctgtcagcatctttttagcaataaaatattttttaattaaggtacattgtttttaaagaagtaatgctgtagcacatttcatagactatagtgtaaacataactttgatattcactagggaacaaaaaaatttgtgtgacttgttttattgtgatattatctttattgcagtggtctggaaccaaacccacagtatctcggaagtatgcctgtgtattaatgataatcatatgcttaatgacctcaggcagaaacaaaagcttctctctgtctaaacagaatttagattgggcacagtggctcatgcctatcatcccagcacttggggagaacaaggtgggatgactacttgagcccaggagttcgagatcagcctaagcaagaccttgtctctacagaagattaaaaaaaaaaaaaaggctgggtatggtaagcgcactcctgaagctgaggtgggaagatcacttgagcctggaaggtcaaggctgcagtgagctgtgatcatgccactgtactccagcctgggtgacagagtgagatcctgtctcagaaaacaaccaaacaaaacccagaatttaatgacaccgttataacatgaatcaaattagttactctttacacttaaaagatctttctataccacatcccattttttgcaaatggtctcctaatatcagaatgatccccataaaatttccagtgtgaatacataagtctccctttattcacacatagatgtgtttcagaaaacttggcccaacaccgaatgacttgaaagcaattttggcttcctggccggctcccattaccaaatgctaccatggagagaaatccccttagaagactgggttggaaacgtgagaaatggcttggattgcctctggccttgtgacttgtgcctgctgggagtcagagcccctcccccaccacacttactgtccacagtaacttatcgtgaggccttcagccttttcccacttttgctaaaagttatttcatccataccagcgccctgacggcagaactctagcatgctttccgctacgggaatgcattttcagctgggattgtcttgggctctgagcagggtgtgtttcccaaatcacctgttacggaccgactccggcaggacagaccgactccggcaggcctagccagcgcctccctaagtgggtcactgccacacagctgtgtcgtgtaggtaccatggtggcttcctgcccttgctggcttcccatcagtactctgattaggttcccagagagcctgtctccaccttacagtgcaggatctactgtgcacctgcacatggtttcagctttgcacattttttaatggaagttgttaacttttaaaggaagtttttcaccattttcttcaagtgcattgttgctgtgctgatgagacagtagctgtgagccttagtgtggcagagtcctgctcagacgccaggccacatgccactggttagttctctccccggccacagcctgctttcagtttggtatcagcccaatgtcagggtagaacagctaaacaccttctgtgtccaaataatgatgctgtgagggtttgtttgtttttttccccgtagccaagggggtgatgtttcattttttaaactttttttcatgataaaatataatacagatcgagaaaacaaatgtagggcttaatgaatttttatagcgtggtcacactgtaactactgtccagttcaagaaataaaactgccagcttcccgtgtcccatgcagggcacagcccgccctcccttctccaagaaggcacttgcctgacatttgtggaaaccacttgtattagtccgttttcactgctgatgaatacacacccgagactgggcaatttacaaaggaaagaggtttaatggagaactcacagtttccacgtggctggcgaagccttcccaatcatggggaaggcaaggaggagcaagtcacatcttatatggatatcagcaggcaaaaagagtttgtgtagggaaactcccgtttttaaacccatcagatctcatgagacttattcactatcaccagcccagcatgggaaagacctgtccccgtgatccagttgcctcttacctggtcctccccacgacatgtggggaattcaagatgagatttgggtggggacacagccaaaccatatcaactcctttatgtgcactgaagtgcacattcctgagcactatagttctatatgtgtatgtgtttatatatcttttaaggctcttttaacctgcatgttctccagacatctctttatctttcttgctgaagacataggtggtttgacctgtagagctccccgtggtccagactttgctaattgtgtccccgtagtgtggtctacatgtttccctgatttctctgtttcctggaaattggtagttgggtctggggacaaaatcagtttcagtgtgatgttttttgggggcacaagaagacctcatagctggtgggggcacagaacgtccagttgtctctctttgggatgtggtcgaccatgacaggcagagcctgggtccgtccattccttagggctgccaagtgccgaggctcattcaagcgtcccttcattttttaaccaagagaaactcaccctcatttatcacctggttattcagcggtacagtgcatataggagaggtgggagaaatgcctgattctttccttttattacagttttccaaataatgagttgattgctgattgtccatcaaagatgacaaatttggttttgagtattgttatgaactcatgaacagaaacacatttgatggagtccctttgtaccaattaaagtgctcatgccgaactaagatttgctaagcaggacaaagatctgattcttcaattaactctctagtgaggtctgacataaattacagttcctctttcccccgtctctgccttggctctccactccaggcgaccactttatcaagttcttcgctccgtggtgtggtcactgcaaagccctggctccaacctgggagcagctggctctgggccttgaacattccgaaactgtcaagattggcaaggtgagtgaaagcccttattaaactggaaatggactgctttgggctggattaattagcagagtggcccattattcattccgtgtgcaaagtcgcaaacttgatttattaattccatttagtgtgccacttgataattcatttcaccttcacagatggcagtctgattttgagttttgctggattttccacagcctagagataaattatggcctcggctgctttgtttattttgaagagatggccaaatctgaattggcagccccagagcccgttctgcaaagagatggggtagagccttgtagaatgttcactggacgaacttggagaccgtccacgttcgacctcacccaagagctctctctaaaaggaccctggctctgtgctcccccaagcacgcagaagaccctccctcagtttgcactgtgcctgggattctttccagcatttcctactttatacagagaagccaagagtggtgtctgacaacttctgtgtaactggattttctggaaatatccagtgtagctccagggacatcacttttattcttctacactttccagcacccaccagacaccatgcatagatttcctttcttaaaaatctcatttttctaccttgccatggggctgatttgtatccaaaagtaatgctgcgtgtctaggactgaatgatggttaacaggatgatctaattgggatggtgagatggtcaaaagcataaacttgggggttgggtagacctggctggctgaccttgggaaaaacctctccacgcctcggtctccccctttgcaaaactgagctaagatctactgtgtggtgtctgggcagatgaaagtacactgcttagtgtgatgcttagcatggggcagatgcttggtaaattgtaatcacttttgttgtcagttaaatggatatttcactgttgcctcttaaacgcttacgataatatatactaattatacatgttattatcagtttatatttattgaacatttcggggaagtaattataaaataatcttgtctactgtcttaccccattccttgtatccttacttaattattgtatgaaaatttatgggagattcttttaggtttatatccatagaggatcctagcagacctaggcgtgagcagacacaagcccaggtgaccacgctgaagcccttcatccctggcacatgtggctgggttacactggacccttaaaaatgcttgtcctctcccgaccttgggctgaggcctcttgtacttcagttccgcaccttagctgctctctgacgggtcttaggtgttgaaatagtatttttacccccgtttgctgacatagtgaataacaacttagtcctgcctattttagtgctggtagaaaataaaaaagaaagcaatgacttagaacaagatgtttcatgaaaatgttgggcaagcagcagctttatgagatttaaatgaaagaaaaagcttgaagagctgtgcttgttggtaaattaagtttataaaattaaggacggattataatcttgacatctttgcagtcttacctttattatataccaactactcctgtttaaaattcatttcttgctccctgttgattttaaaaccctctaagcttcagcatgagagtaaattctaagctggcatgtgaactggtctgggtcccagtcaccgacagccaggctaacccccctcccaccaccaccaaatgtcaagccagggccctgactccagctaccaggtgctgactttacttgctcgagttaaaatgttgcttcctaaaaaccggcatgtttaactgagctattaatacaataaatcttgcctctaaagtctttcctttactccttttagctcaggtatgttttagcatagctttcaggaacattctcttcaaaaactgcaccttgctggcagagttgctacagaatgtggattttgaaaagaatatttgtaacgtacaaagtgtccagtagccccattagcaagaaggttcatgaagaaactgactgggaagttgatctgcttttattctcaggttgattgtacacagcactatgaactctgctccggaaaccaggttcgtggctatcccactcttctctggttccgagatgggaaaaaggtacgtctgcacttcttagtactgagaattcttcatctcttaaccccatcaggctgagctactgagtggtttaatgggcacagtgaattgccaatcttgattgttagggcactggtttggagaaatgtgtataatgaaacaaacgtctttctcttaattgataagatttgggttgtggagatgaaccttgaaacatttcagtggcccaggttatcactagaataacccacatcttacagtcacagggtaactgtgctctggtcgtaaacacaaaccttcaggcctttgaacagagctaaggcttgcacttggtccggttctgcctgcctccctccctccttccctggccgatggtcagcagctcagagttccccatcagcacaacggcttgctggcaggcctctgccccagacttctatgatgtgtaaccccgtggagggaagaggggcctgtacagttctctcaccaaagccgaggcattcagttatcctctctacattcccgtctaaatatgaacatgcagactttgcaccaccgctaagacatctgggagctctgacccgggcaagcaggggttgcaggaaggcttaagtgattcagaacacctcagtggactcactcagccgcgtgcccgtgtctcggccaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaaggtgggtgcctgctggagtcgggatccccataagtggcccgtggcccccggccccccacctccccaccctcagaggcctcctcaaatgctttggacaaaatgacagtttggggacacagtcatctgatggttggctccagttgcgttttcaacacgtatttttcatcgactttcacatgctttcaggggcgaatgcaaacaaaagctttccttttgaaaacatgaaatggatgtgagacaaatcccaagacaatatttggtgtcaaaaatctctagagaatccttcctttccgcttcattcattttaaagaatgactctgctgggcatgtttctgctatgaaatctcgactgctggccccggggccctgattctattcctgaccttgctccgggcattttcctttacccgttgtaaaggcccctagaagacctgtagccaagagggcatccgcagcgatcaggccagtgactgtagctgtaacctgcctaggcagtcctgatgcactgaggggcttccttccttcactcaggtagcaggaggtttcagattcatttgttctgctttatgaagcccttgttatgtcacaggcactgttctaggccaccaggaaataaaaataagaccggtttcctgcctctgaagcatacaggtctctgaggcaaatggtgagaagacacacaagccaatggcagggggctggggcagaaatgtgtgcagggcttggctgctagagagaagtgggggcaaatgggcaagaagtgtccctaaagagctgattgacgggatctgtgctggacagataggctgggcagggctgccactgaggggctgcaccaggagaggcacaacccgagaatcagccggcatttctgcagggccagagctggggctgggggaacacagtgggagacaggtcagggtgtggtgtaggatccctgagagtgagagaggagctggagttgagagtctgtgggcagctggccaaggattatgaactgtatcccatattgacagggagcccacggaggctctgtgcagattggagttgtaggaaaatgaccggcatgcacgtgtgctggaggtgggaagctgctctattaggcctttaaagatgatgagttccctcatgctgcagccgtgactgtgcgatggcgaggaggagaaagccagcataaggagtccagccgctgtgcagcgcggaggagagggagggagggtccgaggcgagtctgattcccgcatatctggtggaggatggtacccagcacaggggcggggccagagctcgaggaaagggatgagcttggttttcaaggtgttgatcttcaaggctttcggctgtgtaggtggcagtgtccagtggcagttccaaccatgagcctggggctgcggcaggaggtctgcactggacgagagtgcccgtgtcatcctcttcaggtagaagtcatgcctgaaggccaggagtttggatttggaaaaaccagtggggccaccaacccctcctccctggtggggccacaccaggcctcctcacccctacaaccctgtccctagttgggctcttgtaggtcggggatggcctgagtgttgtttaaaagttgacgttttggttgaagaagtaaacagctgattttgtagttgtcaggaccacttatgttagaggagtgtatgtgtcatggtggttacaaaggtcatcccaaattgagtataattatacaccacggatgttttcatcgcagcaccatttctatttataatgcagttttccaccatgaagtgggtcttttcagtgcgtgtggcgtcatgtttctggacataaagatggtagtgttccacagtggcccccttggcctccgtcactgacatgttactcgatgccagactcaaatggagcagccctggtacacttagccacgtgataaatcatcccattcctgctctcaggagagaatcgcagatccatttttggagaaacacatagacgtcattctgtaaagaactgtcaagggagaatggctttaaagcagactaccatgtagcacctttcccttaaattctccagccagagcttccatcagcgtttttcacattgacttagaacaggctgctttccatttttatgttcaatgtaaaacaggtatcattgcctttgctattgtaactaggttctttctgttgcatagagaggatgtcacaaagggtgctaggagaatagggtggccagtgagaaaagcggctgaggatgagacttcagtgggtatcctggagactccaggcttagaggtgcagactcaagtgtcggacacccagggctgcctggtccacaccacagcgccctggagagttttcaacctgcctcatccccaaaagacagtccccctccccaccttcatcccctgtacagtatccagccacctcctcaccacatctcccaggcttgggacccagggacttgcattgatctctctgcccttcagaggctgccagcctccctttgtgtgtagcctatgaaatgcagattgtgtaggtatttctgtgtgaccttggagcctacgtaactgcatttttaaaaaattactgattcgtgtatctgcaatcccaaagcatggccctgctcaactttaagggatgtacttgaactgtggctttttcctcccttgaagggcactgtgttggcactcactgaaaataacttcgatgacaccattgcagaaggaataaccttcatcaagttttatgctccatggtaagtggctgtttaattagaaactactttgtccatgtgtactaagtcacatcatgtttttcagctcatctgccacccctccagactcaatgttgggcacatgttacatttatatgtaggtcatgttgtaggaaataaggaaccgttatcatgctcctatattcaaatattttaaacttcaatggccttaattatatatggagaatgaggctacagttatatcaactttgattatatatggagaatgaggctaaagttatatcaactttggagaaaacataaaaatggaggcaaattatgatggccatattcagttttgtggtatctgcacttttccaaatagatggcttttctttttggctaaacaatgagtgtcatgatgtagctttgctcctcggttcttttaagtactcggatttcttttgtagagaaatccagtagagtctgttagagccattcagtatgctacgcagtttcctgaacctgcatgccacgtggtcttggagaccagagcagaaatggattgcaggtagtgtgagatccagacaaccttggttctaagacttaccgtgaatgactgtatagtaaacttggatgtcctttaattcctttgaaccccagttccctcagctgaaaaatgggagtaactttttgtcttcacaaataaaacaatccatttggaaaagcagagtgttaggacaacagtagattgtttatctaaacatgataaaggcgtcacttttcttgtttgttacactccacatgttcctgagaaactaaccataggggtaaaaagttaataagcacaggacttgaacgaaccatagcaatgcctttcaaatcatttgcaacatttaaaaacctaaagctccacagatcaagtatcaaaaaagaggatcccctttggctgaaggggagccatccatacggcaggagggggtcagaagagacaagggaacagagtcgggtagaagggagggtttgaaccaaacttaatcatggccttgattctcaccccacatcgctgaagtaccaaggaggccttaaaatggttttgaaattgtgagaccataagcaatcaaatctaaaatgtctttggcattcaagtgaccttttagaaattgtgtggcatctgccctgttccctgttcctctgctcctgtgctttcataaaccagttagcacagttcaccatggcatggaaatggtctcagaatctcaacttgttttgagactggcttgcttctgtcacattatctgaaagtctaccttggatcaacttttgggttcttcatttgggataggaggaggaagagttaatgtgcacccagtgggagaatttggtattttacaaatttctaggcaattgttgactgtcccatacagaagaaacagagcttgtcttggcagcagagtgtaggtgaatgatctcgacccaggatttcaacgaagctgccatttttctcgtcttaggtgtggtcattgtaagactctggctcctacttgggaggaactctctaaaaaggaattccctggtctggcgggggtcaagatcgccgaagtagactgcactgctgaacggaatatctgcagcaagtattcggtgggtacttggatggatgcttatgggagctctcagtatgggggcagatcccaagggaactgtgcctcaaccacgataactcactctgctctcatcttctcaacaatgtggtttttatgtccctttgagttgtttgtttggagaagcaaaagagatcctctctcaaagggaaggcattcttcttcgcccgctttgtagttagtatccatgtttcagtgcaggttttcaggccttgctgtctgagtaacaaggccgtgaagtaacagaccccacgccatagactgtggggcttcccacaccgcgactcttgatgattgaccagtggtctgtagcctttgccataaatacccgagtcgctcatttttcacacataagccagcattataaaatgcagtggctgaatctaagaatcatttcaacataacctcctttctgaaagggccatgccagcaagtcggtcctgtgcttgggttaactactgccttcattccaagctgttagcacagtctgatggcctggaagatttgtcattttttttcttctttgttattcagacacttttggagccctttagatggagaatagacgtaacccagacatagtttccttatcattaaaagataccagttgttttttgtgccctaaaattcttagaaacgagttgccactgaaacatgtatcctcaagaggatcttgctctcatggtctggtctgcagaccaccagggcatcgccagggaggtcattggaaatgcagactcccaggcctgctcaatccaaatctgcaccttcagcagatccgcaggtgatcgtgtgcacagtaaagactgaaagcgtctgctttagggtaaagtcgttcctttgaggctgatctttaatgatgtcattttgaattcacaagtgaacacacagccccacggctgtgctttctaaacagtagtctgctcctgttttaatggaatatacacctttaaaaattagccacagaatttttccagccacaacggtaggagtgtatctggttttatttaggaagcaatttgcatgtgatctggaccgctggtttgcaaacttttttcttttttgttttaaggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaagtctggtctttccttcaatgttacagcaaaacagatataaaatagacaataaattatagtttatatttacaaaaaaagctgtaagtgcaaacagttgtagattataaatgtattatttaatcagtttagtatgaaattgccttcccagtacatgattgtgaaaaagacatttagaaaatattctaaaatttaatctgagcctcactttctacaagggaaatcatgatttccgttcataaacagcatgctcatccccctaacaccattcttataagctgggcaccctcattttattttcttcgttggttctaaccctgtggcgtggtatgctgtatagtaaaaaggcagagaaccactttactgaaaaggtactagagccggcagtccagaagttaatgtgctggtcaaagaaccgttctggtaaagaagaggtgagcactgccttcacgtgttacacggttacacaccccttgtagcctcacctcagtgtaatcagtctacttttggtactagcaaagagtacagcaaatggaggattgaggtgtagaaatggtatgttttggctgaaataagtgtattttcacaccaacaaaactccagcacgaacatacaacagcaatgactgagacaagggcgccccgtggagccctggctgtggcctgggctgtgcgtcctgtggacttctgggaatgaactgaacagaggcgttccccccacttccccgatttctgttctctgtaaaatctacctttgatagacagtactgaaccagctgatcctttagccaagaatacatttaactcctttgagattattttccctatttactaacaaacaccccaaatagcttgatctacagctaaaactaattttggtgggtttttgggggaggagggtaggaagagcttcacggttatgtttctgcagttaccagaccttatgctacagacatccaaactcagcttgctacagaccaacaactactcacgtcatttaccaagtgagcaaattattaatgaggtcctttaaaatcttcctgggtaataaggcactggcatgagatagtttcaaagtctcatcgtcccacctccaactgtgcttccgtgtttttttaaggcagatgtaatctaggaatccaaggcagaatgtgtgtccccagcatctggtttcgagttagtggcatccacaagctcttacaaccatattcctgtattttttcagaatgacattggagttgtcatcaaagtaaagaaccgagatggcatttagcttagttggcgcacagcacggtttggggacatactcggggttcataaggtgaacctgttccaaaacagaaggggagaaggtaccttagaaatgacacctggtcttggcttactcccacttacaaaacaaagtctccgagagctcaccaaggtctgcacaatcgcgtggttggttgcattcatgtgtgcgttgagtgggaaggagcattctccatcacagtaattggcagcatagcccttgggtgcaatgatccagtccttaatttcatgcaaaggaagcaacaaaagatgagcatgcacttctcacactatttgtgcttttcaggaatgctgtgaaaaggtatttttcacattgcacaggcaaggatacagacgcaggaaggcttaggaatttgtccaagttcacattcaagtggcaatgctgggaagtgaacctggtccatctgaccccagagccctcgctccttgcagaggcccacagggcctcagctgctacctggaagcacgtaggttgccagcaatatgtgcttggacccaagcaagcctctccaggagcccacggtgctcctgcggaagtagtgccacctgcatatggaagctaccttt

SEQ ID NO: 6807 - DNA, 17239 bp, Homo sapiens
gtgactgtggagtttgaattgggtggcggttgactgtagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgccatggctcctaggaagggcagtagtcgggtggccaagaccaactccttacggaggcggaagctcgcctcctttctgaaagacttcgaccgtgaaggtaaggggccaggccgtcgcggcctcctggggcggtcgcgggatgctggcgggtggggacacgagctgcacagattcgcccgcccgtgacccgtgtcctgtcggctctgccctcccgcagtggaaatacgaatcaagcaaattgagtcagacaggcagaacctcctcaaggaggtggataacctctacaacatcgagatcctgcggctccccaaggctctgcgcgagatgaactggcttgactacttcggtaagagctggagagcttccctgggcggaggccaggagccccttggggttaggtgacacccttcagaaagggctcgctcagatgtcaccttttaatgagatctgacatgaccacttatggaaaattgcagaccctttcactctctgtctcacttccctacttcatttttctctatgaaaaatgggggggtggttggggggcggcgggcggggcggtctctgtcggacaactcagctctgctgtttacaggtccaaaacagctgtagtgaatgggcatggatgggctgtattccaataaaattttagttatggatacactgaaatgtgaatttcacataattttcacacatcaggaaatttatttaattttttttaaacagagtctcactctgtcacccaggctggagtgcagtgcagtgcagtggtgcgatccctgctcactgcaacctccaccttctgggttcaagtgattctcctgcctcagcctctggagtggctgggattacggtcgcctgccaccatgccccgctgatttttgtattttcagtagagacggggtttcaccatgttggccaggctggtctcgaactcctgacctcaagtgatccacctacataggcctcccaaagtgctgggattacaggagtcagccactgcgcccggccagaaaatagtatttttaaaaatatatgtatattttacccatttaaaaatgaatgaataaatgacatggttagttaaccagagctcagatagaagaataacccgaagcagctccttctgcagcttatggaaattgctaacctaaaaatgggcgcatcaggctgggcgtggtggctcacgcctgtaatcccagcactttgggaggctgaggcgggcagatgacctgaggtcaggagttcgagaccagcctgaccaacatggagaaaccctgtctctactaaaaatacaaaaaagttagccgggcgtggtggcgcatacctctaatcccagctactctggaggctgaggcaggacaatcgcttgaacctgggaggcagaggttgcggtgagctgagagcacgccattgcactccagcctgggcaacaagagtgaaactccgtctcaaaaaaaaagacacatcagttttcctggccagagaaaaatcccagcctgtttctgcactcccttattaaatgtccggagaaatgcaggaggctgtacttttctgctgggttgcccttttctgttttccttattattaactatccagcatgtagtctccttcctggatagaaatgcatggtctgctcacatattagacattgaatgatccttttgacttgcccttttatttattaagccattcatttgcttatttctccaaatactgagcatgtgtcagtcacagtgctaggtgctaaagatgcactagggaataaaacagacattgtctctgccttcaggaacatacagattagtagaaaagagctattagaaaaatccacatacaattatgtaattaaaagtataggtactacaaaggagatagaatagagtagtggtcagtgagcatattgtgctttctatgccagatgggcattgtaccaagtgttttacatacattaactaatttttcttcataactaataatatccctatttttcaaaatgacaagattaaggcacagagaaattggacactttgctcaaggcctcataagctagttagtgggatagtctgtttgaacccaggtattctggtttcatagcctgagatcttaactgttttacaagatactatgagagtttctagcaggaggttctaacctaactttttattctacatgtaaatctcacaaagaccttttcattcaacacgtttactgtacatctattgactgctagatttttgccagaagcaaaggatgtcatctctggaattcagtccaaggcagggatggacatttaaacagctttgagtagttattgggtataatgagggtgagcaactaactctacactttgcagcaaactgctgagatagaaaaataagcaggctgggcacagtggctcacctggaattccagcactttgggaggccaaggcaggtggattacttgagcccaggaatttgagaccagcctgggcaacataacaagaccatatctttaagctttaaaaaaaataattaaaaataaatttttaaaaaagaaaaataagcagagggcagggcatagggtggggattcatgcctataatcctagcactttgggaggccaaggcaggagtatcacttgaccccaggagttcaaaaccagcctgggcaacatagcaggagaccacatctctacttaaaaaaaaaaaaaaaaaaaaaaaagacaacctggacaacttggcgaaaccctatctctacaaaaaaacacaaaaattagccgaatgtggtggcgcatgcctgtagtcccagctacttgggaggccaaggtgggaggatcagttgagcccaggagacagccaaggaggcgccactccactccagcttgggtgacagagcaagactctgtctcaaaaataaataaaatttaaaatatattttttaaaaagaaaaataagcagaatttttggggtgatgtttgagctgagttttgaaggatgagttagaaatttgttaagtacggaggtgaatttcaggcagaggaaatacaaagtaccatggcaacaagtcatgagagtcagtggcacatttgggatataacttggagaaagaatagattagatggtgaaggtccttgaaggttagaccaagggctggaccagttttagaaagataaatggtactattaggcaagatgatttattgttaaaatgtaatagtaactacaacgttctttttaaagcccttggaggaaacaaacaggccctggaagaggcggcaacagtaagtgacctttcctattttccagccagtggttacttaagtctagtccagtccccagatccaactaatagatgcttactgtggaagaggtttcataaagggacatcatctgtttgtgtcaactgaaaaattagagttggaccagacactgtatacatgagacccagatagttctgagccctacagaaggtggcagttctgtttttgaccaatttcttgcagtcctttgttctgaactctacagcggaagtagaaagcctcaagcccaagttcctttaagcgcctgagtcattacactatgcattggcctgctagatgataaaggtgtttcatcatgtcgtactgtagaagcagtgcttttgcttgggatgctcagtattccccaacccctctcatctccttcctcccagcatcagtgccaggattgaaggcagtaagatggggatgcaaaatagagcatttaaagctgcactgtccagtgtagtagccactgggcatatgtagctatttcagttaattacaattaataaaattaaagaattcatttcctcagacatactagccacattttacatgttcaatacctacatatgactagtagctactccatcagagagcacagaaatagaacattgctactcttgcagaaagttttatgagacagcattgggaactagtccatacatgggcttcacagagtccctaggcactctaaaataatatacaaacaatgcgtgtgtatgcacgcatttgtgtatctttctgttagtttattgtagccttgatcagatttacaaagtaaaccccaaaattacatcttttgttgagttgatcagaatcatttggaatatcagggtttgaaggagtctgaccaccaagggcacatagcagatctccgccagcttcattcagaaggtaaaggtaatgaggagccaattatcaatttggaaaaaattggagcatttgggagagaggtggggattattcacccccctacatacactgagctccaatgttttaaaagagttacctctgagatgaattatgcttactagctaatgcagttctctctttttaaattagaaatacagaactgcaaatgagaacttctaatgtaatatgagagagccattgttaccacaccaagttgagagaattctagccttgactaatatgatttaaaactccagaaaggaacgatagaaaatctataaaagctcttagttgggaagtgtgttggggctcccaagaccacctccaggtttggtgattcactaggaggattcatggggctcagcatacagtcacacccatggcgatgatttattacagtgaaagtatacaaagcattaatcaacaaaggagaaaattgcataggacaaagtccagaggaaaccaggcttctaggagtccactccctgtagagtcaaacagaacatgcttaattcaacacatatgaaatgctgtctaccagaaaatctgattagagagtcaatgcccagagttttaactgggggctgctcacataggcatcctctgcctagcacatgtcaaaatcctagactttcaggagggaagtaggtgttcagcatgagccatattgtttgcataaagtttaggcacagtgaggcatcttgttaaggaaaggtgggaatctttctgaaatcaagttcccagatgccaaccgaggccaggcttgcaacaggccctttctatgtgtatcagtctcaggcctgctctgttaactgtcctgcacagtagatgcccagtggcctgccaccactgatgactccataaaatgccagttgtttctagagatggcagaaggttggcaggaatgcccctactttctgttgcatcaagcctggcaaacatcagtaacttattacagccctatttcttgctaagcctaagacagcctcagaatccttctctgagtatgtcaagcagtccctaccagaaatgaaacctgtgccattccaaacctgtagtaattattctgatgtttacatgtgttctataaggaaaggactgtgaatcatgactgctctttgtagtgcccatacttattaccatatgaaaaaaaaacgaatttgaatggtgactggaagcctttttgaaggacccaggatcatcatagaaaaccttattgagaccctgtagatttatcgaaaaaatggtaagcttgacacaccaccaagtgttgtagaggatgtagatcattaggaacttgtattgtttgcagatgggctgtagtcaagggtaaccactttgggaaacaatttggcataatgcgaaggctgaatatttatgtaacctataatccctgtcatgtcctatccaaaggatagagccaaggggaaacttggacatgtacctcagacacatgtaagacagttcaaggtagcagtgtttataatagcaggaaactattgatggaagatggacaaatccattgtggtatattcacacagtgggatatgatatagcaatgaaaacaaattaactacaaccacaaagagtggtgaaaacagccaaaaccaaacaaaatgcttaagtacacacttgtgaaaaagcacatctgtgtgtgcacacatgtatacacacatatgcatgtatctgtgagcacatacacatgtacctttcgataaagcaagtgcaatgatatggttacccctggggaatgaaggattaggagactcatcacctttggaagaagagataagaaaatggaacaaggaatgaatacagagccagaagcaagttattggcaatgttttaggtcttgggctgtgtggtgggtttatgggagtttgctatattgtatattgtatcactaacatttaacagtcttatgtattaaataatagttttaaaaaagtttttatcttgaaatattgttcctcatattttggtggaataagcctggtgctttctggctatgtttgtcataggctgacctggatatcaccgaaataaacaaactaacagcagaagctattcagacacccctgaaatctgccaaaagtgagtacctttcaaaactccttgttgtacagaaagaactgaggctcaggttgcttggttggctgctcaggcagcgccttgttggtagagcctcttccctttaatgtctggttcttaatcttgtaaatccaaaaacttgcttttggatggtgcatttagttaattttttttcccccgaacagcaattcaaaccagaaatttagttaattttaggcaggactgctaaaaaccaaactcaagacccgtgtgcgagctaaaatgaaagtgaaaaaaggggggaaaaaagctgtgctagaaaccaaacattgttgcctgcttactttctcctgggttaaatagatgacaagatttagagaggtgttaaaagactggtaacaccaactgagacgctccctgatgtaatcaacaaagttgaaagcgaattgaaaaaggaatgactttctctgcatataattcaaaattactcaattcaggccaggtgcggtagctcacgcctgtaatcccagcactttgggaggccaagctgtgaggattacttgagcccaggagttcaagaccagcctgggcaatgtagtgagaccttgtctctgaaaaaaaaaagaaagaaagaaaggaaaggaaaggaaaggaaaggaaaggaaaggaaaaaaaaagttactcagctaggcgtggtggctcacgcctgtaatccaagcactttgggaggccgaggtgggtggatcacgaggtcaggagttcgagaccatcctggctaatacggtgaacccccgtctctactaaaaaatacaaaaaattagccgggcgtggtggcgggcgcctgtagtcccagctacttgggaggctgagacaggagaatggcgtgaacccgggaggtggagctggcagtgagctgagatcatgccactgcactctagcctgggcgatagagcgagactctgtctcaaaaaaaaaaaaaagttactcaattccatgatctatccacataaaatcatcttacatacatgtcccgcactctgagaaacactgtcttataggaaaagttgtatgggaaaccaggttttgactagtgagcaaggaatcggatcaggatgaattgtgacatggacttaatgtcactgtcattaagctatgatagtttgatgcatccaattcttataagaacatcctgacccatggccaggatttcggggctacacaccagggcacgctctacagtaggcagggcaagctcaattattcagaatgctgggctgtccctacaaagcatcatatggggtctcttaacactctggttagtttcctttgtctaaaccctctttcttaaaaagtcttctttatttttagtccatttcttccttgcagcttaagattgtgtacattttattcctataagaaatgtgaatgcacaaaactttattttcatcagaaataccaccctgttgaaactgtttcttacagcacgaaaggtaatacaggtagatgaaatgatagtggaagaggaagaagaagaagaaaatgaacgtaagaatcttcaaactgcaagagtaagtggacactgaggttggaggctgggggttatcacaagacaagcaaatacaaatgcataaaatacactgttgtacaccagagctcacagtttagtagagatgatcctactttacatggcaatgacaaaagagataattgactggtgtgcaaagtgtgtagaacacagaagaggaagctagcaagcctcccctaccccactaggacatagacaggcctttcaaggtgagtgagagtctactagctagagaagaaagggaagaggaacagtattcaggatagatgggggaggcggaaaactgaagatgaggaaaccagttagaagcctatgaattcttgaactgacatgctgacactatagaatgaagggatggtttttagataggttttagaaagaagtggcatggttggtggagaaaaggaggaatcagagacaactgcatggtttctagctaaggcaaatgctatccagtgaggtgtgggacccaggtggcagagggtgctggactgggggtggtggagcacatgccaattgcatgacatgttgaccattcattacttttccaggacatctaggctagacagaaatttcagcctggagctcagggagaagagggagatttgagagatacactgcctcccagatctttaggtgtttgtcccagtgtgggagtggagatggttgtgcagggagagcaggaagggagggagtcagggtggacactagagggagggtagagagaggagctcctaaggcagactgccaaggaagttagagaagcaggaaagacagatccatcacggaggacaagggaggagagaatatatggaagataaggagtgattcttgccagggacctcccaggccccaggaagggagcactgcagggtttgcctttgattgggcacctgggacgccctgagtgaccttcacagcagccctttatgtaaagtagtggggtacaagccaggctgcaatcagttcaaaagagatttacctttaatcttggtcaaaatcctctattttgaaaacccagccagtggaagtccttattcaattagttatgttctgaactttttaagtcattgaattctgagatacaccttattatatttagtattaactatccaaagcttgttcttaatgctttaaaaaaaaaaaaaaaaccctccttaccttcctctttgctgggttttttgtaaccttagtctcatttgattgtgactgcaggtcaaaaggtgtcctccatccaagaagagaactcagtccatacaaggaaaaggaaaagggaaaaggtagtggattttctaaagttgtggtgttttgggttttattggagagccatatatatcatggcagaaagtgaggggcagtgaaaaggctctggtggctagtgtttgaaagcagcttaaaatcactgaatccttgagtatccaagctggaggggtctctagaaatgacctaaaccaaaaccatctccagtactttaatgtacattctctatccttccccacttttttttttttttttttttgagacggagtttcaatctcgttggccaggctggagtgcaatggtgcaatcttggctcactgcaacttctgcctcgcgggttcaaatgattctcctgcctcagcctcccgagtagctgggattataggcatgtgccaccatgccggctaattttgtatttttagtagatgcggggtttctccatgttggtcaggctggtcttgaacccccgacctcaggtgatccacccacctcagcccccactttttttttttaagtatagcaagaactgcctgttatgtttcagttcctgatagtccatatgtagagctaccccatagctcgtcatagagtggctgtcacttacctataattggtttcttgaaatgttttgtccagtcctgcaaagtgaagaacctctatgggcttgagttgattatactggactctaccataagccatgtgggggaaggtacagcagcttaggagagtagtcaccgggatgcatgtctgtggaggagcgaactcatttctcttgagcagtgcagcagctgcctggcacaaggacagaattccagctgggggagccttcgcatgaagaggctgtctccttgattaaaaagtcagattctgaggctgagtgtggtgtctcacacctgtaatcccagcactttgggaggccaaggcaggtggatcacttgaggtcaggagtttgagacccgcctggccaacatggtgaaaccctgtctctactaaaaatacaaaaattagccaggtgtggtggtgcatgcctgtagttccagctactcgggaggctgaggcaggagaatcgcttgaacccaggaggtggaggttgcagtgagccaagattacgccattgcactccagcctgggcaacagagcaagactccgtctcaaaaaaaaaaaaaaaagtcagattctggaggcagactactttggttcaaagttttggctccatcctaattggatatgtgatcttgggcaagtttttaaaacttgatgcacctgagtttctgcatctgtgtatgaggatggcagcagtgctggcctcccgtgttagaagggtcacgtgagtcgatgtgtgcgaggcgcccggagcagtatctcacagtcagctctccacgtgtcactcctctgctgctgccttcgtggaacctgagagttggcatacctgatggccatttcttacctgtaggtcaagccgtgctaacactgttaccccagccgtgggccgattggaggtgtccatggtcaaaccaactccaggcctgacacccaggtttgactcaaggtgagtatcgagggaaacacttggatttgatgggactccaacattgagcactacccagagaaggagtgtctaagaaaatactcctaggccaggcacggtagctcacgcctgtaataccagcactttgagaggccgaggcaggcggatcacttgaggtcaggagttcaagaccagcctggccaagatgatgaaacgctgcgtctactaaaaatacaaaaattagttgggtgtggtggtgcacgcctgtaatcccagctactcaggaggctgagacaggagaattgcttgaacccaggaggtggaggttgcagtgagctgcaattgcaccactgcactccagcctgggcaacagagtgagactctgtcttaagaaaagaaaagaaaatagtcccgagtccttggcctgggatgccttgtcagaggacagtggccagctgggtttcctggtgtatgcctctcccttaagtgtagtttcacctatcttcagtggcaaaatgattctttaatgggagggaggtgaatattctgcctgtgatgactaggaggcctctaggtgacgtttttggccttttctgattcaaatcagaaggtttttattttatttttaaaatatttatttattatgaggcagggtctcactccaatgcccaggctggagagcagtggcacaatcacggctcactgcaaccttgacttcccgggctcaagtgcttctcccaccttagctcccaagcatgccaccatgcctggctaattttttgtttttttgtagcgatgggatttcgccaggttgcccaggctggtctcgaactcctgagctcaagcaatctgcccacctcggccttccaatgtactgggattacaagcatgagccatcacacccggcctcaaatcagttttttaaagatgagtaggcactctcctgtactcttggtagaagtaaaaattgatactgcttttttggaggctggcataagcgaggatattcttgcagcataagttaataccttccaaagaacctagttgaccaaataggagatgctgtatagccattaaaaaagactggatctgtgtgtgctgacagggaaagagcaccgtgatcacagagcatctccgagcaggttgctgaacactgtgctgtatgatcccatttggttttatatacatacaaagtttctggaaggatagataaggaattcagagtggttacccctggggaggagagcaagaagtggttatctctggtgtggggaagtgttgaagatttattttctacttttaattgccactttttttttttttttttttttttttttttgagacggagtctcgctctgtcacccaggctggagtgcaatggcacaatctcggctcactgcaacctccacctctcaggttcaagcaattctcctgcctcagcctcctgagtagctgagattataggtacatgccaccatgcccagctaagttttgtatttttaatagagacaggattttgccatgttggccaggctggtctcgaactcctgacctcaggtgatccacccccctcggcctcccaaagtgctgggattacaggtatgagccacggcactcagccagttcccacttttctttactgtttgttttctcacatgaatatgtaacaaaaggcatttagggaaaactaggtagcagtattttaactgtcttgagaaattagtataatgatgtaatatctaaatcatcctcctttgcctctgaaaaattcctcttgatggaagcagccacgcctggaaacaattaaccagcgtatttctggctttgtggatggatggatgatggcacccatatggagctttggacctaaactttatgtggataagagttggctttttgtaagatgtatgttcaataattacaaccttctttctccagctgtgtttagtcattactgctttaaaacattttttttttctaaatttagaacgtgctttcttaggaatgtatgacttaaaaactgcaacttgaggccagagtaaggttaaaatggcctatagagtttggtgtcatccaattgccaagctatcttcacagagattttcccattctagggtcttcaagacccctggcctgcgtactccagcagcaggagagcggatttacaacatctcagggaatggcagccctcttgctgacagcaaagagatcttcctcactgtgccagtgggcggcggagaggtgaagtatttccaagggaagccaggccacagtgtgctgcttagtcaagcatttcttttccctgggccctcacccacgcttcaccctcagagtcctttcagtgcgtgggtcctgatctccacacttctgcgggactcagaacccagttttctctcccaggttagaggcccagactgcaaagatcgttgctcagctctgggttctgtttttctgttttttggttttgtttttgttttttgtgggttttttttttttttttttgagatggagtcttgctctgtcaccaggcgggagtgcagtggtgcgatctcggctcactgcaacctctgcctcctgggttcaagcgattctcttgcctcagcctcctgagtagctgggactacaggcacacgccatcatgcccagctaacttttgtatttttggtagagatgggggtttcaccacgttggccaggatggtctcgattgcttgacctcgtgatccgccctcctcggcgtcccaaagtgctgggattacaggcatgagccaccgtgcccaccttttttttttttttttttgagatggagtctcactctgtcgcccagcctggagtgcagtggcacgatctcagctcactgcaacctctgcctcccaggttcaagtgattctcctgcctcagcctcctgagtaactgggactacaggcacatgccaccacacccggctaatttttgtatttttagtagagatggtgtttcaccatattggtcaagctggtctcaaactcctgacctcaggtgatccacacacctcagcctcccaaggtgctgggattacaggtgcaagccaccacacccggcctccatctgttcatcaactaacatttgcccatccgattgtagtaggcccaagaagtagacatggggcctgcccttagaaagcagctcagtggtcaagatgggtttgcaatcatggtacctgtgatatgcgcaataatagagatgttaaagggtggtgcagaggagggcaccaccgaggtatgcgcttagtctagaacccggaccatgagctgtgccttcagctttgtataacttaagggattctgaagcaagctgagctcagtgtctctgggctgcatggagcgagttgctgacctcagcccctgtgaggggaggacggtttgtttcagacatactctgcagggcatttcttagatgatgtgcgtgccttttgtgcccaggtaatccagcctccaccctagtgatagtgctgatgaagtcattgtctccttagagctaatatccttcctgcctgtcttgccacttctccatcccagccattccccaccactaagtgcaggatatcaggggaacctaggggttccggccctaagggccatggccagtttaacccactcccctttctattcagagcctgcgattattggccagtgacttgcagaggcacagtattgcccagctggatccagaggccttgggaaacattaagaagctctccgtaagtctcatattcatctccacacataggatgcctccagtagctttcttgggctacctttatttaggattgtcttttgggcctgggctaatactttctacttaaatttgtgttgtcttccttcccccaagagattttgactcttaccctacttagatagcagcagttctgttcctcagttgatgttgagttttgttcaatcccagggtgcctgccacagaagttccactgcaaaatcaaaattctgcctcattcaggcagttagtgctaggggtatgttaggtcactattggccaccagaaagtgaaacctagagtagctcaagaatgagggtcggggcttgttatcaggaatcttacagaatcaaagagcgagctgaacggccaagcctctggagtggtggggcccatcagctggggcctgtgtgctcatttctctcacacatcttcattcctccctcagcagataaccttctccacaggctccaggttctgtgcttacttaacattgttttgcatgtggctttgagtaaccacacctccaatcccaactttattgctctattgcccaattgttcaatttcttgtcttggtttaaattctgaagagggccaggcacagtggcacacacctgtaatccctgcagctcaggaggctcaggtgagagaaattgtttgagcccatgagttcaaggctgcagtgacccatgatcgtgctgctgcactccagcctgggtgacagagaaagacctcagctctaaaaataaagtaaattatcaatttaatttaactgaagaatgtaatggctccgccagggatgaacctccttggtctggtcagccatcatcttgggtggtggatgaagcacttagtgtaaacatggcaaccttaccctcatccttctgtggggtctgaagggtacatccaaggaaggggacaaggcggggctggtttcctaaacctgtctttctgaacataggcccagtgctgagatcccacacacacctagccacccaaatcttgtgactgtcatcctctagctagatctattgcaatgttcttctcaaatctatgatacctttactgtctcacttgagttgttattttactcccttgttcagatgagaaacaggttcagaaaggtgaattcatgtgtgatacagatagagaatggaggggctcaggctgactgtgggaggccaaggggcaagcctgccaagtgacatcttctacaatgacctctctccttttctttttagaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctagtcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggtgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttttgtaa

SEQ ID NO: 6808 - DNA, 7960 bp, Homo sapiens
gtcaaaaggtgtcctccatccaagaagagaactcagtccatacaaggaaaaggaaaagggaaaaggtagtggattttctaaagttgtggtgttttgggttttattggagagccatatatatcatggcagaaagtgaggggcagtgaaaaggctctggtggctagtgtttgaaagcagcttaaaatcactgaatccttgagtatccaagctggaggggtctctagaaatgacctaaaccaaaaccatctccagtactttaatgtacattctctatccttccccacttttttttttttttttttttttgagacggagtttcaatctcgttggccaggctggagtgcaatggtgcaatcttggctcactgcaacttctgcctcgcgggttcaaatgattctcctgcctcagcctcccgagtagctgggattataggcatgtgccaccatgccggctaattttgtatttttagtagatgcggggtttctccatgttggtcaggctggtcttgaacccccgacctcaggtgatccacccacctcagcccccactttttttttttaagtatagcaagaactgcctgttatgtttcagttcctgatagtccatatgtagagctaccccatagctcgtcatagagtggctgtcacttacctataattggtttcttgaaatgttttgtccagtcctgcaaagtgaagaacctctatgggcttgagttgattatactggactctaccataagccatgtgggggaaggtacagcagcttaggagagtagtcaccgggatgcatgtctgtggaggagcgaactcatttctcttgagcagtgcagcagctgcctggcacaaggacagaattccagctgggggagccttcgcatgaagaggctgtctccttgattaaaaagtcagattctgaggctgagtgtggtgtctcacacctgtaatcccagcactttgggaggccaaggcaggtggatcacttgaggtcaggagtttgagacccgcctggccaacatggtgaaaccctgtctctactaaaaatacaaaaattagccaggtgtggtggtgcatgcctgtagttccagctactcgggaggctgaggcaggagaatcgcttgaacccaggaggtggaggttgcagtgagccaagattacgccattgcactccagcctgggcaacagagcaagactccgtctcaaaaaaaaaaaaaaaaagtcagattctggaggcagactactttggttcaaagttttggctccatcctaattggatatgtgatcttgggcaagtttttaaaacttgatgcacctgagtttctgcatctgtgtatgaggatggcagcagtgctggcctcccgtgttagaagggtcacgtgagtcgatgtgtgcgaggcgcccggagcagtatctcacagtcagctctccacgtgtcactcctctgctgctgccttcgtggaacctgagagttggcatacctgatggccatttcttacctgtaggtcaagccgtgctaacactgttaccccagccgtgggccgattggaggtgtccatggtcaaaccaactccaggcctgacacccaggtttgactcaaggtgagtatcgagggaaacacttggatttgatgggactccaacattgagcactacccagagaaggagtgtctaagaaaatactcctaggccaggcacggtagctcacgcctgtaataccagcactttgagaggccgaggcaggcggatcacttgaggtcaggagttcaagaccagcctggccaagatgatgaaacgctgcgtctactaaaaatacaaaaattagttgggtgtggtggtgcacgcctgtaatcccagctactcaggaggctgagacaggagaattgcttgaacccaggaggtggaggttgcagtgagctgcaattgcaccactgcactccagcctgggcaacagagtgagactctgtcttaagaaaagaaaagaaaatagtcccgagtccttggcctgggatgccttgtcagaggacagtggccagctgggtttcctggtgtatgcctctcccttaagtgtagtttcacctatcttcagtggcaaaatgattctttaatgggagggaggtgaatattctgcctgtgatgactaggaggcctctaggtgacgtttttggccttttctgattcaaatcagaaggtttttattttatttttaaaatatttatttattatgaggcagggtctcactccaatgcccaggctggagagcagtggcacaatcacggctcactgcaaccttgacttcccgggctcaagtgcttctcccaccttagctcccaagcatgccaccatgcctggctaattttttgtttttttgtagcgatgggatttcgccaggttgcccaggctggtctcgaactcctgagctcaagcaatctgcccacctcggccttccaatgtactgggattacaagcatgagccatcacacccggcctcaaatcagttttttaaagatgagtaggcactctcctgtactcttggtagaagtaaaaattgatactgcttttttggaggctggcataagcaaggatattcttgcagcataagttaataccttccaaagaacctagttgaccaaataggagatgctgtatagccattaaaaaagactggatctgtgtgtgctgacagggaaagagcaccgtgatcacagagcatctccgagcaggttgctgaacactgtgctgtatgatcccatttggttttatatacatacaaagtttctggaaggatagataaggaattcagagtggttacccctggggaggagagcaagaagtggttatctctggtgtggggaagtgttgaagatttattttctacttttaattgccacttttttttttttttttttttttgagacggagtctcgctctgtcacccaggctggagtgcaatggcacaatctcggctcactgcaacctccacctctcaggttcaagcaattctcctgcctcagcctcctgagtagctgagattataggtacatgccaccatgcccagctaagttttgtatttttaatagagacaggattttgccatgttggccaggctggtctcgaactcctgacctcaggtgatccaccccccctcggcctcccaaagtgctgggattacaggtatgagccacggcactcagccagttcccacttttctttactgtttgttttctcacatgaatatgtaacaaaaggcatttagggaaaactaggtagcagtattttaactgtcttgagaaattagtataatgatgtaatatctaaatcatcctcctttgcctctgaaaaattcctcttgatggaagcagccacgcctggaaacaattaaccagcgtatttctggctttgtggatggatggatgatggcacccatatggagctttggacctaaactttatgtggataagagttggctttttgtaagatgtatgttcaataattacaaccttctttctccagctgtgtttagtcattactgctttaaaacattttttttttctaaatttagaacgtgctttcttaggaatgtatgacttaaaaactgcaacttgaggccagagtaaggttaaaatggcctatagagtttggtgtcatccaattgccaagctatcttcacagagattttcccattctagggtcttcaagacccctggcctgcgtactccagcagcaggagagcggatttacaacatctcagggaacggcagccctcttgctgacagcaaagagatcttcctcactgtgccagtgggcggcggagaggtgaagtatttccaagggaagccaggccacagtgtgctgcttagtcaagcatttcttttccctgggccctcacccacgcttcaccctcagagtcctttcagtgcgtgggtcctgatctccacacttctgcaggactcagaacccagttttctctcccaggttagaggcccagactgcaaagatcgttgctcagctctgggttctgtttttctgttttttggttttgtttttgttttttgtgggtttttttttttttttttgagatggagtcttgctctgtcaccaggcgggagtgcagtggtgcgatctcggctcactgcaacctctgcctcctgggttcaagcgattctcttgcctcagcctcctgagtagctgggactacaggcacacgccatcatgcccagctaacttttgtatttttggtagagatgggggtttcaccacgttggccaggatggtctcgatcgcttgacctcgtgatccgccctcctcggcgtcccaaagtgctgggattacaggcatgagccaccgtgcccaccttttttttttttttttgagatggagtctcactctgtcgcccagcctggagtgcagtggcacgatctcagctcactgcaacctctgcctcccaggttcaagtgattctcctgcctcagcctcctgagtaactgggactacaggcacatgccaccacacccggctaatttttgtatttttagtagagatggtgtttcaccatattggtcaagctggtctcaaactcctgacctcaggtgatccacacacctcagcctcccaaggtgctgggattacaggtgcaagccaccacacccggcctccatctgttcatcaactaacatttgcccatccgattgtagtaggcccaagaagtagacatggggcctgcccttagaaagcagctcagtggtcaagatgggtttgcaatcatggtacctgtgatatgcgcaataatagagatgttaaagggtggtgcagaggagggcaccaccgaggtatgcgcttagtctagaacccggaccatgagctgtgccttcagctttgtataacttaagggattctgaagcaagctgagctcagtgtctctgggctgcatggagcgagttgctgacctcagcccctgtgaggggaggacggtttgtttcagacatactctgcagggcatttcttagatgatgtgcgtgccttttgtgcccaggtaatccagcctccaccctagtgatagtgctgatgaagtcattgtctccttagagctaatatccttcctgcctgtcttgccacttctccatcccagccattccccaccactaagtgcaggatatcaggggaacctaggggttccggccctaagggccatggccagtttaacccactcccctttctattcagagcctgcgattattggccagtgacttgcagaggcacagtattgcccagctggatccagaggccttgggaaacattaagaagctctccgtaagtctcatattcatctccacacataggatgcctccagtagctttcttgggctacctttatttaggattgtcttttgggcctgggctaatactttctacttaaatttgtgttgtcttccttcccccaagagattttgactcttaccctacttagatagcagcagttctgttcctcagttgatgttgagttttgttcaatcccagggtgcctgccacagaagttccactgcaaaatcaaaattctgcctcattcaggcagttagtgctaggggtatgttaggtcactattggccaccagaaagtgaaacctagagtagctcaagaatgagggtcggggcttgttatcaggaatcttacagaatcaaagagcgagctgaacggccaagcctctggagtggtggggcccatcagctggggcctgtgtgctcatttctctcacacatcttcattcctccctcagcagataaccttctccacaggctccaggttctgtgcttacttaacattgttttgcatgtggctttgagtaaccacacctccaatcccaactttattgctctattgcccaattgttcaatttcttgtcttggtttaaattctgaagagggccaggcacagtggcacacacctgtaatccctgcagctcaggaggctcaggtgagagaaattgtttgagcccatgagttcaaggctgcagtgacccatgatcgtgctgctgcactccagcctgggtgacagagaaagacctcagctctaaaaataaagtaaattatcaatttaatttaattgaagaatgtaatggctccgccagggatgaacctccttggtctggtcagccatcatcttgggtggtggatggagcacttagtgtaaacatggcaaccttaccctcatccttctgtggggtctgaagggtacatccaaggaaggggacaaggcggggctggtttcctaaacctgtctttctgaacataggcccagtgctgagatcccacacacacctagccacccaaatcttgtgactgtcatcctctagctagatctattgcaatgttcttctcaaatctatgatacctttactgtctcacttgagttgttattttactcccttgttcagatgagaaacaggttcagaaaggtgaattcatgtgtgatacagatagagaatggaggggctcaggctgactgtgggaggccaaggggcaagcctgccaagtgacatcttctacaatgacctctctccttttctttttagaaccgtctcgcccaaatctgcagcagcatacggacccacaaatgagacaccaaagttgacaggatggacttttaatgggcacttctgggaccctgaagagacttcttcccttcaggcttattgtttgagtgtgaagttccagagcaaggagccatgttcctctaagggaattcaggaattcagacgtgctattcccacaccagttaggtagagctgtctgttcaccctcccatcccagctgatcccagtcactgcttgctggggccatgccatggaagcttcccatcagtctcccagctgaatcctccctgctctctgagctgctgccttttgcctcctgcaactcaacatcctcttcaccctgccctgcctgcagttgagagggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggcgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttttgtaa

SEQ ID NO: 6809 - DNA, 442 bp, Homo sapiens
gcagccccgcgctgcgcacccagtcgaggcgccaacacgcgaactgggcgggagtggccggcccgcgggggagcgaggaacgacagggttccccccactcgctgcccagactggccgcgggatagcgcgccccccccaaagcctgcacccctgccctgctcctctatcattccgtcccccttgctctgtcaaaccctgccggggctgctctgtctctgccgacccgccacttgcccgaagttcggcctgaggagcttggggccctgaggagcgccgacgtaggcagccagccagtcaatcagtcagagggtcacggcggcccctcggctactcagtggcagccaggccagaaagaagcagccgccaaccctggagcagaatcctacagccgacctgacctagtaggcccccagccctccagagcttggggtattgcagagcc

SEQ ID NO: 6810 - DNA, 638 bp, Homo sapiens
acatctgcttttctcagatgtgaaaacctttgctttgggcagattcattctgatatctgaaagaggggcttactacaagatccagagcatcggtaccttcaacccccagcagagcgcccccaacaccttcattccatgagctagaaatttgtgtctgggaggacaacacctagggtctctgtaatttcccagtatagtagacttttcttggccaggaacaaagcggggcaagagtaattcggtgatcatgagtctcacttcccaaagtttctgaggccctggcagatctgccttcccggaactctctaggctgaaaatgatcaacctagagctaatgatgcaagagggttctgcctaaaagaagacaacctgggggcatacttagccaggttattgggtattgacaatttatagactaggaatcttctggtagtgacagcatttggaagaatggttactcagtgcaaataagcaacccagactatatgtcatcaggcctaaagagcctgacaccaaggaaacacttaggatccaacctgctttacccagaaccaggttcatcctgtttcattccatctgcaccactgcctaaatcacctagtaggaaatgcatgttatgtagcaggtgcctaattaac

SEQ ID NO: 6811 - DNA, 472 bp, Homo sapiens
tggagatggttgtgcagggagagcaggaagggagggagtcagggtggacactagagggagggtagagagaggagctcctaaggcagactgccaaggaagttagagaagcaggaaagacagatccatcacggaggacaagggaggagagaatatatggaagataaggagtgattcttgccagggacctcccaggccccaggaagggagcactgcagggtttgcctttgattgggcacctgggacgccctgagtgaccttcacagcagccctttatgtaaagtagtggggtacaagccaggctgcaatcagttcaaaagagatttacctttaatcttggtcaaaatcctctattttgaaaacccagccagtggaagtccttattcaattagttatgttctgaactttttaagtcattgaattctgagatacaccttattatatttagtattaactatccaaagcttgttcttaa

SEQ ID NO: 6812 - DNA, 638 bp, Homo sapiens; identical to SEQ ID NO: 6810

SEQ ID NO: 6813 - DNA, 1044 bp, Homo sapiens
gaagagtcagccttcttcttttcctggcctaggtagtagagctcatatagaaaaagtgagacaatattggtaccaaactacattatttattgcttccactgaactggtcaagaggcagcaggtgaggcatgaagatgggcagttctcagaagttttcctgaacctacaggtttatgttaatttttttatgtataatttgtcttccttgtttatgatctcattctagtctgccatgtaaccccttctcaaactttaaaaggacctcccttgagctggagctaacgagaccatttcttgtctgcttacaattttaaaaaaaaagctatttgcaagtaatttttctcattatgatgctgttatcataaagtgagattccagtagccagggtgtcaagggatggtatatggacagtgcaactttgacttactttactctacttagtcaaattttaactattttctggttcctttcatttgaatataatagttaaaataatgcagaccattcacagttcatatgttctccctttgtttttctctgactccacatgcactgacatgtatagtttctgctgaatttattaatttggtccagtttattcctgctgttaactttgatttcttttcctcctcttatctaatatttttcactatgatcagtatgttccatgaaatatatatattccttatttttctctcctaaagtataaacaaattgtcattgggaaaggagaacacttttctctgactcacataatgtagtagtaatcattcatattttacttatttgtggctgcataattgtaataggaagagtgtgtggccaggtgagcgaagccagaaaatatgttgcttggtagtttttccacattgctctcaaattttcatatattttgcttatttactggcccgtgtgtgacagtagtcacacaaatagtacctattattgtctaacttggggatgccatggggaaggtgtagattttcttggcactggattctgcaacacttgattaatcttaattctatggcaaaaaaaaaaaaa

SEQ ID NO: 6814 - DNA, 1047 bp, Homo sapiens
gaagagtcagccttcttcttttcccggcctaggtagtagagctcatatagaaaaagtgagacaatattggtacaaaactacattatttattgcttccactgaactgtcaagaggcagcaggtgaggcatgaagatgggcagttctcagaagttttcctgaacctacaggtttatgttaatttttttatgtataatttgtcttccttgtttatgatctcatttctagtctgccatgtaaccccttctcaaactttaaaaggacctcccttgagctggagctaacgagaccatttcttgtctgcttacaattttaaaaaaaaagctatttgcaagtaatttttctcattatgatgctgttatcataaagtgagattccagtagccagggtgtcaagggatggtatatggacagtgcaactttgacttactttactctacttagtcaaattttaactattttctggttcctttcatttgaatataatagttaaaataatgcagaccattcacagttcatatgttctccctttgtttttctctgactccacatgcactgacatgtatagtttctgctgaatttattaatttggtccagtttattcctgctgttaactttgatttcttttcctcctcttatctaatatttttcactatgatcagtatgttccatgaaatatatatattccttatttttctctcctaaagtataaacaaattgtcattgggaaaggagaacacttttctctgactcacataatgtagtagtaatcattcatattttacttatttgtggctgcataattgtaataggaagagtgtgtggccagggtgagtgaagccagaaaatatgttgctttggtagtttttccacattgctctcaaattttcatatattttgcttatttactggcccgtgtgtgacagtagtcacacaaatagtacctattattgtctaacttggggatgccatggggaaggtgtagattttcttggcactggattctgcaacacttgattaatcttaattctatggcaaaaaaaaaaaaaa

SEQ ID NO: 6815 - DNA, 1047 bp, Homo sapiens; identical to SEQ ID NO: 6814

SEQ ID NO: 6816 - DNA, 1721 bp, Homo sapiens
gaaggcttaaattaagtatgttgacaataccccaaactactggatgatatttgtaatgaatttcaccctatatcagtacagaagggtgtcacagttcagcaaaacaaaagagaatacgctttgttaaacctctactttctgaattttaggacagtgaggaaatttaacattttcaatttttttttcttttcttgactgaaaagaaagtcaagccagcaatatgtttctgagagagcagtgatgcatttcacaacactgttaactgtctgcttggctttttgaggcttccagagttcagaattgtcttctcttgaataggtcagtgcatttttttccttcagtttttctccttaagcagcaaaacagaccatttaacttccaaatatttacagcttgcaaacagataaacttcccaaatctgtttttttttatgaaaaggaaaacgatcagccacaataatctataatacgatatatttgaatcaaagttattagatgccctagggtcttttcatggcagattttatatatcaccaccattaataaatctgttatcagaattatgtctttctctctgttgatagttatttttagactaacatattcatacctccttctgatgaaaaacattaaaatttgaataaggcatattagaaaaccctaaagctctgtatttacacaaaggagactcataaatattggtttttcagggtgaagcattgtgtgttattccattttgtaccacagggaaagcctagtcacacatggggcctcattaaaagaggatctaaagaaatatttaatggttgaaatataaggtcttattctgaatatctaccttcactttataataatagaaactgaactgaaaagattcagtaagtgatttagaacatccactcattttaaaagtaatgtctaggcctaggaaagtgacatcatgttccaaatgttacaaatccagcgtttttccttgatgtctttataaatacattgtttacagtttttattctcctccatatatgatgccccttttctaagattatttcgtaggtatatcctttaatgagagaacctcataaataaacttcctgaatttgaaaacgagtgagaggagacttcaagtttgtggactgagctaaacatgtgtctactctcccttcaaacatcccatggaaatggcagtaaagacagaacaaagagaatacatttctgaatatactgaggaacatatactccagagagcagaaacaggaagaggggcctctgctaaagctgaaggagtcttcaggagggaacccagctgggctctgtgttctggttggcagatacagagagtagccaaggtcaaaagcagacaaacagaaagtgaggtgattggccacaggtttggaaatggctcaggtttgctctttccaaccccttgcatgtcactgcacatttacctccagaagtaaagcaggagaactctgcaaagggaaccaacaatctgcatgggagggcattgcctccaagtgtgtgggctggcgaccaagtgcagccctctgccctagttatgggagttggagagggacttactggtttgcatgttccatgcaagagctaaagcaaagcacatctcggagaagtgagccaggaaagtggatcaatccatgccaacaacctatattaattaacctgataattaatatgtatataaagtgaaaaaaaagaaagaaaaaa

SEQ ID NO: 6817 - DNA, 2743 bp, Homo sapiens
ttgaggcaaattattttgcattcatgttatttggggctaggtattgcttaggttcgtgaatgctgttcttacagacacagatggtacctgagcccctcagacacctgccctttcagggacgttagcatgacttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgatactgttggactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctggaaatatgtgtcaattttatctcttagaattgtggattttattgtcaagacagaatggctgttcatttattttataaaagcatctccttctataactcaaaattgtctttaagtgtcatataaaagtgtacattttacttttaagcaactaatttagatacctaagaaaaactatgtgcattaggaaaagtcatgtttttcttctcagaaaggttgatcacatgatatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacaaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaattaggtagtgaggagattgtgccaggaaaataagtgggaaaggccacagttatgtttcctttgaatggaagagagacaaagctatcagctatagatcattgttttcttaagacagccaaactggccctttgaaaccattcaaattaccccagtttagctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctatatagaaagtggtttttgttctttgagtttgttttatttcttgaagattacaataaatatctaagagactatattcctgaa

SEQ ID NO: 6818 - DNA, 2743 bp, Homo sapiens
ttgaggcaaattattttgcattcatgttatttggggctaggtattgcttaggttcgtgaatgctgttcttacagacacagatggtacctgagcccctcagacacctgccctttcagggacgttagcatgacttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgatactgttggactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctggaaatatgtgtcaattttatctcttagaattgtggattttattgtcaagacagaatggctgttcatttattttataaaagcatctccttctataactcaaaattgtctttaagtgtcatataaaagtgtacattttacttttaagcaactaatttagatacctaagaaaaactatgtgcattaggaaaagtcatgtttttcttctcagaaaggttgatcacatgatatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacaaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaattaggtagtgaggagattgtgccaggaaaataagtgggaaaggccacagttatgtttcctttgaatggaagagagacaaagctatcagctatagatcattgttttcttaagacagccaaactggccctttgaaaccattcaaattaccccagtttagctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacgctaatgccacctggcagatgtgtacccagagatttttctgtagctccatgtttcccataaagggcattggaaatgcacagatgaagatcttcctttggaaccaggcacatttggccccttctcagtgactgcactgtggactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctatatagaaagtggtttttgttctttgagtttgttttatttcttgaagattacaataaatatctaagagactatattcctgaa

SEQ ID NO: 6819 - DNA, 377 bp, Homo sapiens
gcatgtaattaatttcctccaaacagagagagtggaggggaaataaattttgcaagcattctagataacagaaatgagtcattttaaaacctcactcagagctcgagttaagatcagaccatctagctagtggacaaattgaactttctatttgcagttctcttttactttctgactttcttttaaattactgcagtttttcaaaacactatcctcatggaatgacaggaccaagaatagaaaatgagactcaaatttcaccatttacttcccatcagcaaccattactggtggagtttcaaacagtcattacttgctgaaatgaggtttgaggttacctgtgtatttcattcacctgtgttaatatttccttcatc

SEQ ID NO: 6820 - DNA, 377 bp, Homo sapiens; identical to SEQ ID NO: 6819

SEQ ID NO: 6821 - DNA, 45 bp, Homo sapiens; identical to SEQ ID NO: 6221

SEQ ID NO: 6822 - DNA, 102 bp, Homo sapiens; identical to SEQ ID NO: 6224

SEQ ID NO: 6823 - DNA, 4529 bp, Homo sapiens
cgcagcacagtcacatcctactgaacatcatcctgttctctggggtgagtgctgtcctggaagttggggggctcagaagctgttggtgcccacctgggaggtcgcccttgcagctgctatcctgaatctcttgcccaagggcttcctctggccacaagagtgtgggaagcaagtgagagacccctgccagtagaggtggggtctgtttgtccccccactcagcttccttgcttctggctcaggggacagtgggaaggtactttctgcgagttgtcccagaggcctctagggggttgggctcctgttgcccactgaggagacctgctcatctaccttccttgtgtcacttcctcactccttcccagtgtttctagaatcacctcccaaatatcccacttgcacccaaaaccttgtcttgggtcagcttctgggagccgacctaagccagcagctataatgctcagggcttaagagctttggaatcagatggacctgagtgtgaatcccgcccctgccacttaacctgagtgtgaacttgggagcctgccccacctctcggaacctcagttcctccatctatgaaaagggaacttacgtgcagaaaaccaagtgactatgagggggatggggcagtgtgagatgacgggaccagagcacgttcctggctgcagaggccacaagtcacgctgtctctgagaggtatggggacaggggcgcagaggaagaatgatcgcgagtcctcagccctgtttggctgacgggggacagggatgggtgggaaagaggtacagcgtttttccaccttccccacccatcacccctgagattccaaatgaacatcgggaccaaccccgggagcccagcggatgttcagggtagggcaaagaacaggtgccaagtttgctccctggggtgtgagactgggcagcctcaagagctgcattggtaggactttcaccaggtagacagcaggcacctcgcccctgcagatcacagcttccagggccacctgtccacagaatcccttcactgatctgtgcttgaggcaggggtgtgtggactgggagtccttcttttactctgggtggggcctcatgctcagagggagctctgtctacccccaccacaaacctgcagtttccctgctacagcgatggcaacctcagccacctggctgcccaggcccccaacctgggttctccctcttgttcccatggtcagcccatcagcaaactcatccacatgtccaagggtccacccccactaccctgccctgccctggtccagctaggatgtttgcagtcgtctcctcattggtctccctgcctcctctctcgccttcctaagccagaggaattctgtaagagctcaagttagatcctatcccttctctgctcagaaccctctatggctcccaactcactcagagcagaagcccacagggcctgcaggatctctgccctggccccgcctgacctcactgcctctcccttctctgttcacccacagccacggtggcctcatctctctgccataaacttgccaattatcctgctgctgcctcattgacttcgcacccactcttccctctggaacagaggacactctcgccagctctccccatggcggatccttgtctagggtcaggcctctgctccaaagtcacccctggggacaccttctctgaccagcccctcattcctatggcctcatgctgtttttatttcttcctaggacttagcacgtatcctagaaattaacctgctggtatatcctgtttcttgtctgtctctttccagtggaatgtcaccatcgcccaggtggggatttttgtgtgttttgttcactgctgtacacccagcccccagcacagcgcctgtccaggacaagtgcccagtaaacacttgggaagcaatgcaagcgtgcgtgcatggataagtatttctttggcagatgagggggctaaggttcagagaaggccctgggggtctcagactcatagcccagtgctctttctgctgacacgccctggtctctggggcagtttgttgcctgttcagcaacaaagagggtgtgcctcgttaggggtcctgcgtgcgaatcgcagtccctgcgtgtcttggctggaggtcaccaccctctctgctccagggcctgtaattaccacttaccctggtcaatgggtccgagagattacccttgtaggcagggctgtggccagggtgctcacctggcccccagcaggtcccatgggcactgtctggccgggcttcatggctgacattccaggtacatttctagccctgggctgccatgggcagagggtggggagagggtcgtgggcttcaggctggacaaaccagtcagccttcccagctgggccgcctgaccacccacttcctgtggggctccttgaggcctggagggtggagggggtctctgttcaacccccacccatgccctcttcccttctctccctcggcaggtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtcttctggggttgcagaggagattcaatgtgatgaaattgatgagagtgccctgcagggagccggaaactcagggagcatcgataatgagtcccccaccatcagcagctggcttaaatataaaaactgtcatggcctctggagaaatgacaagaattcgaaggagcttccctgcactggccaccctacaccctacacccttacttcctcccctcaacttgcctggatttatcgacccccactaccccactggttgccttctctccacctggcacatttcgtatgaatttgcttgttggttcttgcctatctccccagtagaacattagctccttcaggacagggacttttgtctaccttatgcacctagtgcaatgcctggcacacagtcggtgcttaataaatgtttcttaaaagaaccaataaa

SEQ ID NO: 6824 - DNA, 3030 bp, Homo sapiens
tcacccacagccacggtggcctcatctctctgccataaacttgccaattatcctgctgctgcctcattgacttcgcacccactcttccctctggaacagaggacactctcgccagctctccccatggcggatccttgtctagggtcaggcctctgctccaaagtcacccctggggacaccttctctgaccagcccctcattcctatggcctcatgctgtttttatttcttcctaggacttagcacgtatcctagaaattaacctgctggtatatcctgtttcttgtctgtctctttccagtggaatgtcaccatcgcccaggtggggatttttgtgtgttttgttcactgctgtacacccagcccccagcacagcgcctgtccaggacaagtgcccagtaaacacttgggaagcaatgcaagcgtgcgtgcatggataagtatttctttggcagatgagggggctaaggttcagagaaggccctgggggtctcagactcatagcccagtgctctttctgctgacacgccctggtctctggggcagtttgttgcctgttcagcaacaaagagggtgtgcctcgttaggggtcctgcgtgcgaatcgcagtccctgcgtgtcttggctggaggtcaccaccctctctgctccagggcctgtaattaccacttaccctggtcaatgggtccgagagattacccttgtaggcagggctgtggccagggtgctcacctggcccccagcaggtcccatgggcactgtctggccgggcttcatggctgacattccaggtacatttctagccctgggctgccatgggcagagggtggggagagggtcgtgggcttcaggctggacaaaccagtcagccttcccagctgggccgcctgaccacccacttcctgtggggctccttgaggcctggagggtggagggggtctctgttcaacccccacccatgccctcttcccttctctccctcggcaggtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtcttctggggttgcagaggagattcaatgtgatgaaattgatgagagtgccctgcagggagccggaaactcagggagcatcgataatgagtcccccaccatcagcagctggcttaaatataaaaactgtcatggcctctggagaaatgacaagaattcgaaggagcttccctgcactggccaccctacaccctacacccttacttcctcccctcaacttgcctggatttatcgacccccactaccccactggttgccttctctccacctggcacatttcgtatgaatttgcttgttggttcttgcctatctccccagtagaacattagctccttcaggacagggacttttgtctaccttatgcacctagtgcaatgcctggcacacagtcggtgcttaataaatgtttcttaaaagaaccaataaa

SEQ ID NO: 6825 - DNA, 713 bp, Homo sapiens
gggagaggagccctgagctcacctcctgcccccagcccagggctcttaggtgcttgttggtgtcaggcccaggcccccctctcatcaagcagccaataaaactgccctggttggcgttctcatttcacagatggagagactgagcccagagagggagagtcacctgtctgatgtcacacagaggtcagcatctgggctgggattccagcccaggaccatgtggggtggggggcagtggatcaatcttttcctggagggagtcaatggtgatggtgggaatgggtcaggggtgctggcaaggagggtccaaggcccccaggagggagggaggcatgggagatgagtttgtccctcttgagttctgtctctctctgtgtctctctgtttctgcctctttctgtctccttgtatttctcagtccctgtcttcgtctatacctctttctctcttccttgtgtatctgacccactgcccaggaggggatgcaggcagagacccctggcttgggtcctggagttggggcccacgaggggattgacatctggggttgagctgggaatctgaagccagaccctgcagccagggacagcattccagtctcggctccacactccagggatagccttggaacgccaggcagttcagagagcctgaggtctggtcttggagacctgggttccaatcccagctttgccacattccagccatgtggc

SEQ ID NO: 6826 - DNA, 1063 bp, Homo sapiens
gggagaggagccctgagctcacctcctgcccccagcccagggctcttaggtgcttgttggtgtcaggcccaggcccccctctcatcaagcagccaataaaactgccctggttggcgttctcatttcacagatggagagactgagcccagagagggagagtcacctgtctgatgtcacacagaggtcagcatctgggctgggattccagcccaggaccatgtggggtggggggcagtggatcaatcttttcctggagggagtcaatggtgatggtgggaatgggtcaggggtgctggcaaggagggtccaaggcccccaggagggagggaggcatgggagatgagtttgtccctcttgagttctgtctctctctgtgtctctctgtttctgcctctttctgtctccttgtatttctcagtccctgtcttcgtctatacctctttctctcttccttgtgtatctgacccactgcccaggaggggatgcaggcagagacccctggcttgggtcctggagttggggcccacgaggggattgacatctggggttgagctgggaatctgaagccagaccctgcagccagggacagcattccagtctcggctccacactccagggatagccttggaacgccaggcagttcagagagcctgaggtctggtcttggagacctgggttccaatcccagctttgccacattccagccatgtggccttgggcccttagcctttgttcctgtaaaatgggaccactgagagcccgatctcagggttttatgaggaggaacgatgagagggctgtgctgggcttcctgaagccctgtgtggcctggaaagcactcaatagatgataactcagtgtaatgatttcttctagcagatggggaaagcgagagttaaagaggcccgatcatttcactcactcattcctcaaacgttattaagcacctgctatgcaccaggtgctttgttttgtatccattaactcagggttcagcaaactacagcctccaggccaaatctggttcacagcctgtttttataaataaagttttattggcaca

SEQ ID NO: 6827 - DNA, 10292 bp, Homo sapiens
  misc_feature (2498)..(2498): n equals a,t,g, or c
  misc_feature (9168)..(9168): n equals a,t,g, or c
tgcagcagaaagatctcagagtaaagaagaacttaaagaaattcagatatgtgaagttgatttccatggaaacctcgtcatcctctgatgacagttgtgacagctttgcttctgataattttgcaaacacggtaagtgctgcctgagaataaacagaattgagtctgcagtgctcaaaatgccccagatgctttgtgcgtgattaaaactgcttgctttttgcctacatttctatacagccgttatgaaaatacagtatgcactataatttcatttcactttttgctgtggttctaggtagtaattgttggaggtagattagctacttattctatccttttgaaatgtcgcctaacctaacatgcatgatgatttgccataacaactcagaaatcatttgtaaacctctgaaccatttttctttgtaacaaaagctgttctcttgtagtgcacttgtaaatgtgatttgctctctgcacggtttatggaaaattggttcttgaaaaagaaaaaaaatgcacaaccgcatttatttatttattttacagaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatggtgagttcgagaatttcaccagtttcaagaagtaagatacatttagaggcatgacatatttttagaaatttttttcttgtgattttgattttagtcatgccagcagactttgttgaccttttaaaaatttttagtgttttcttcatgtcttaaagcagtgtttactaatgtagtcggacttacaaatcatgaacattttgtaggctctgaaaatttggaaactggtaagataaaattggccaatctccagattttcgtttccacaaaaatccagcctaatcaggaagcacactagttctaaatattatctacatttgcatttaagttcaagtgcccagcctagtgcctgtcatagagcagacctttgataaatgttggtctcatagtagatctgtggctgcatcttgaaaacctgtgataacttacgtgcaggagctccattgcagataatgacattgagggcccttcctgctgctacttttgctccttggttggcttttcctatgcacgctaccttcctttaactgccgctgccactgttgtgctgtgcctcggtcccactcttctgagcatactgcttaattctgcacacattttcctgttccaaagactttcttgacaaaggaagcagtgcattcactgataatcaagtgcatgctcttcaactcactggtctgacatggatccactgcctgaggttcatggtttgagtaacattgatagaagtggcagtgcctggccaaggagtgttttggtccaaatcagtgcatactggagtttgttgcagggggtccagtctgcagatctggatgcgacacaaacattgtcaatagcctgaataatttctgggcagtgtttcagttctttgaagatactgtcatgattaataaaatgccaattcattataattgttaggaactcatgaaaggtttttgttgttttgtactctctcaatccatggacactaaaagtacaaaaagctgtttgtgggcatgtaagacttttgagacagggtcttgcactgtcaaccaggctggagtgcactggtgtgatcatggctcactgcagcctccacctcctgggcttaagcgattctccctcagcctacccagtagctgagactacaggcgtgtaccaccatgcctgggaacttttaaaaattttttatagagatgtgggctcactttgttgctcaggctggtctcgaactcctaggcccaagcaatcctcccgtctcggcctccaaaagtgctgggattacagccaagagccaccttgctggccttgataaatattttaatgttaaaactgagtctttatgggtgaaattctgggatttatgggtgatttttttcttctctctctctttttttttaacctgcaaccattaccatagtcaattttggaataactttatgaccccaaaaaatgactctgtacccattaacagtcactccctattctttcccaacacccccagctcctggcaaccatcagtctgctttctgtcgtcatagattagcccgttgtggatatttcataaaaattgaatcatgatatgtggtcttttgtgactggcttctttcacttaggataatgatgtcaaggtttatttatgttgtggcatgtgttagttcttcattttattgcagaatattctgttgtgtgaatcagccacatttgatttacccattcatcagttgatggataagntgggttgtttgcacttttttggctattatgaataatgctactgtgaacattcatgtacaagtttttgtgtagtttttgtgtatactcttaggtatatacataggaatagaattgtgggtcatgtagtaactgtttaaccttttgagaaatagacaaagtggctacaccagtttacattcctaccagcagtgtgtgagggttacagtttctccaaatttttgctaatacttttttttattttccttttgctttttttttttttttttgagacagagtctcactctgtcacccaggctggcgtacagtggcataattttggctcaccacaacctccgcctcctgggttcaagcgattcttgtgtctcagcatctgagtagctgggactacaggcatgtgccaccacacctggctaattttttatatttttagtagagacggggttttgccatcttggccagactggtctcgaactcctgacctcaggtgatctgcccatctcagcctcccaaagagctgggattacagatgtgagccaccatacccagccttcttttgctttttagctctactatgaagtggtgtctcactatgttttgtgtttttttttatttttatttttcggagacggagtcttgctctgtagcccaggctggagtgcagtggtgtggtctcagtgatctctgctcactgcaacctccgcttcctgggttcaagcgattctcttgcctcagcctcccaagtagctgggattacaggcgtgtgccactgtgcctggctaatttttgtatttttagtagaaacgggatttcaccatgttggccagactggtgtcaaactcctgacgtcaggtgatccgcctgccccggccttccaaagtgctgggattataggcatgagctaccgcacccagccttgcattgtgattttgatttacattaccctatggctaatttggataaatttttaatgatgaaaacctatattacttttggaatctggaaatattttcattttgaacttctaaaagtagattagagaagtacctagagaagtcaaatgtatagacagaaaataggatgatggttgccaggggcggagggaaagagggaatgaggaattactgtttaatgggtatggatggagttttagttggagaagatgaaaacattctggagatggatggtggtgatggctgcacaacaatgtgcatgtatttaatgccattgacttgtatacttagaaatggttaaaatgataaatcttatgtatattatattatatattttttaaagtagagaattgagatctgttaatataatttaatattgccataaacattgaagccatatttataggggaacacatttttttccctttttttttttttcaagacagggtctggctctgtaacccagccctggcatacagtggcacgaacacggctcactgagcctctgccccctgggctcaagccatccacccacctcagccttccaagtagctgggaccacaggcatgcgccaccatgcccagctaatttttgtatttttttttgcagagacggggtttcaccatgttgcccaggctggtctcgaactcctaggctcaagtgattcacccgcctcagcctcccaaagtgctgggattacagatgtgagccactgcacccagccaggagaacacatttgttcttgtcagaattcttttaaaatacataaagatctgtttctaaagaaatgaaaagcaggtggtaggaattttaacattttaaaaaaaggctcagaaccacaggcctagggactatgaaaatagcttataacagtgtggtccagatgggctacatggaattaaactgcactctgttgatgtactctttgtggttcctgattttgttacccagaggtatcaatgttcagttaaaattcatttcatacaagtgtctcattgaaaagggactttgtagttatactgatgcagcttgtctgctgatcaagtcctaatgactcaattgttgtgattagaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatggtaggtatctgactttgtgttagaattaatttttcctctctaagcgactcattacttaaatctgttccatcacgcaaaagttatttttttctgttacatgaataaaaagttatttttgtttacctgtgaagtcttcaatgtgtgcctcaaaatgtgtttctttccctgaactactttttttaaatctgttaaaggcctggttaagtgtataggggaaatcagaaactctgaatgtgtcagcttactatcaaatataaaaccatgagatgtacttgagtattttccagaagttagttgctcattttcgacagttattctaagccaatgatatcagtttaatttcctccctttttagcttgcaaaactcatgtctgaattagaaagcttccctggctcgttccgtggaagacatcccctcccaggctccgactcagtaagtaccagttcttgtttatatacagtagtgttttgggcacacctaaggtcgatctgtgttgtatttaaaaatctaatttctttatttgtgtggccttctagacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcaggtaatgaagattgaaaacttttttctgttctccagtgtgagcacattcctcctacatggtagatgtgcaatagatgtttttaaaattggagaatgaaaataaaagaagaaaatcacaatttcttatcaagttgtagcttggtatcatacacaattgcattctgaggaattaaggtggtacaacttagggagatttggtgtgtctgctgtgatagaaaagatttctttttcctggctttccctgaggaaaggaaagatggaaagagggaagccatacagatatccctctattttgcagtgtagaaactgaatgtgtttctacagggtcaagagacatcagagaaaatttttttttttagaacagaagatcatttcttacatcttcattaagtaaaagaataaatagctcatctctcaagttgaaagaaactgggcttggtattacaaaagcaaaattaagatggccatataggttttaggctcattttgccatgcattatgcaaaggacaaagaaaaagaaaaaatagagctctctttacttaaaacatccttaaggagaagctatgaattccccaaagtactacttctctttattatggaataaatggattcccttatacgtgctttgtttagcaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgtgagttctccgcattggtacttgctcttctgattctcatcttcggtaggcctggcatcatacacagcacaggtacacgcacatccttaacaccaggcgatccatagtaaatgttttcctctaaccattcagaactgtaaacgtcacataagcttacttggtaattttattagcaggcgagaattgggttttcttcatctcttcttaattgtaggcatcgtttccaaaatgtccagttaggctacagtaagcgtatggcctgttcccctaccataagctctaggagagatttccaggttgaagtttgtgtgaagaaattacaagtcaagtatctgagattcaaagctggggagagccagttttgaatctctgtgtttcatatttgaatctgttttttcagttttgaatctctttcagtttttcagttttgaagttctgtgttttgtattccttgtaatgcaggaagatgacctgcccagaagccgtcgctccagatcatccgtgacccttccgcatataattcgcccagtggaagaaattacagaggaggagttggagaacgtctgcagcaattctcgagagaagatatataaccgttcactggtgagagcctctaaattacacctgagaatgtaaacatctgtgagaggaagagagcttctgtccctaagcgttgcccaggttctaaagggcctagcatgtgaaatctgtacctatatgtttttttcacacaaggaaggaaaagttttacagtatccctgggatttagccctctttcacagtggaattatctgcttagtaagtctgtagtcatggtaaatcttttctcctaatttagaaatcaattcattcaacatatatttactgcatatctattatgtgtgtatacatagctaggtgctggagtgtggtggtacaccaaagataaaagtggatttgggtaggttattttttaataagaccttttcttaaagggaaagcggttttaccacaccaggctaatttttatatttttagtggagatggggttttgccatattgcccaggctggtcttgaactccttggctcaagcgatccactctcctcagtctcccggaatgctggggttacaggtgtgagccactgcacctggttgagttatttttcataccctggcatatacatgtgtatgtagagattcatagacaaaatgtaagcctatactacgaagagggacattctgtaaatatgccatttcctctgttgaaaaacagtggttttttttgttttttttcttaatggcttatttgtagggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccggtaggtgcctgccaggggttggtcctgtgggcttgaaggtcagccacaaactgtgatgaggccagaaaaaggcattggtgaaggggtggagccctttctgttatggggtgctcttctttttttttaagatggagtctcattctgtcgccaggctgcagtgcagtggcgcgatctcagctcactgcaacctcctcctcctgggttcaagcgattctcctgcctcagcctcccaagtagctgggactacaggcacgcgccaccacacctagctaatttttgtatttttagtagagacggggtttcaccacattggccaggatggtgtggtggtacaagatctcttgacctcgtgatccacccgcctcggcctcctgaagtgctgggattacaggtgtgagccaccacgcccggcccagggtgctcttaattcagaacacaaatgaattcagagggatggtgctgcataggcatgagccgcttctacgatactcgggtctgaactgtccctgggaagttgctgctccatttatccctggtagctgcttgtaacttccactcctggaaggaagcattaggcattaggaaacattaggcatgactaatgcctattaatcatataaatttttaaccataaagaaggggttaaatgtaatgtagataagttggtgggggaggtaaggtttaacttaattgtgccgtttgacaatcctccttcagaactggcattgcccgccttgtcgaggaatctgcaactgcagtttctgccggcagcgagatggacggtgtgcgactggggtccttgtgtatttagccaaatatcatggctttgggaatgtgcatgcctacttgaaaaggtagtgggtgtttttttttcccttccacatctgaattttatattcatttatgtcttaatgagaagatgatagatgtcagaagagtggttatctctggcggggtggagactgactggaacggggcacactggaagggatgggaacattttctgtcttcacttaggtggtggtaacccgggtgggtgggtgtgtatgaaaaagtcaggtaatatacttgaagatgcgcacacttgaccatagtgatgttataactcaataaaaatggttttaaaaatgaattaggctttcaaaagagaattctttggttgaaaactatgtcctgacacatttccttttgtttttcacagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagttttttctntgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 6828 - DNA, 14150 bp, Homo sapiens
tcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccggtgagggctgggcgggcgaacccgaggggcgggcgcggtgggtgctggacgcaggcgggcgcgggccgaccctctccaactccgcagcctagcgctgccttaactggtggcctgcctaggcgttgcccgcttgggcaagcccctgattttgtgcacctgggataactgagggccatggggacgttcctgcgtggcgtgcgcacccgaagtgcgggcggcgtggagacttgagtcgtttgcaggatggctagcagcgctggaaagccctaggcacgtgcgtccgccaaaggccggacagcggccgggagcgctggccggtcccgattttgcctgccaggcagagccagcctgcctgccccctgggaggttgtcccgcagcggcccagccctttcccgcacacaactcggagccagtgcgtggctcgccgcgtctatacccgcgctcagtgggtggcccttgggcgcgcaccccgcccggcaagagacgcgtccgcttctaaccgctgagggccagcgcgtctgaggtttaaggtcttgcgaaccggtctcctagaacttgggctgcgcacgcagtgtgaagcgaccgtagtcccgggcggtggttaagtgcatttaaagggcttggtgggtcaaagcgttcgccgaccatttgctcgtttcctacttcctccaccccaacccccaaccccccaccccccaccccccagccttactcttagctgcaggacgttgctctgagtggaacgttactttttgctctaacggaagccagaacgtagggtcgggctcctggagagggtagaagagtgggggttgggtgaaacggaagacaatgacatgtttaaaataaatatcaggggttagggaccctcgcgggggtgggtgcgatggggcgtggtttcagagctgagtcgccgccccggtggagctgggcattggctttccggatgaagaaaaccatgtgtagctggtcttggaacctgacatgcctgagttcaaatctgagccaccatgggacttgagtaatccatttcgctttcctgagcctcagtttcctcattggctaagtgagaataacgatagcacctttgttgcaaagaattaaacctgacgtgaaagtgtacttaacatagtgcctggcacgaaaaacgcctactataaatggtattagttattacttacctgccaaagaagttcatctccgtcttgactatttgccttgctgcttttttgtggcttttcctccaaagatacgtttgcctggtaaataactcttggcttgtgctgacttgttaaagctcagcctgtatttctcggacagcttccaatagaatgccgcctttgaggctgtctggggcctctgactgcttgcaggtagattgatgagtaaagggtggtaattcctgcagtaatgcgatgaacactgctgcttaagaagatggcagacttgagttctccttcctgcccctgtgatcttgcagtctattacaccttcctggggccttgaatatcctcatctggaaaatgggatctgagatccttttcagctcccaacattcattgtgtcccaggctggagtgcagtggcacagtcacggctcactgcagcctaccgggctcaagcagtcttcccacctcagcctcccaagtaactgggattacatgtacgcaccgccacatccggctgatttttgtgtttttagtagagacggggtttcaccatattccccacgctggtctcgaactcgtgggctcaagtgatcctcccaccttggcttcccaaagcgctgagattacaggtgtgagccacccccctacacatacacctaacctttatatttagtagctctaccttttacacgttgtcctgccttgttaagagggcaaaagacaaaaacttcctaagatgattgaacggagtttacttaggggtatagggatgttgggagtgccatcatcatgaaaataactttatctgcaagagactgaaatgcgtaatgttaggccaagaaggagggcaagaatgttctggtcacctgacatcttacatcttagcatattttgtagaatctataccagagcttgccctttcaaagttttcagtgtaaggaatcacttctgctattccatggccccatttaaggaataaaaacacaggacctaatgcaacacttaggaaatctcgttaaatattaagaaatgacaaaccactatcctttttttatacaagatagatgccaattacattttctgagagcagtgccaggctgttcagtatttatgaatgaatgaagcatttctatgtaagtaatttgcactttataaaaggacttttaaaaacttaagtcttgtatagcaaagggacagcaacaagaactgaatgacagcctcaagtaatagagtgctaaaatggaatccggtatcccacctgcatttggagtgctatttgatctttaacttggctccttgtaccatttgttgaagcgtttgatgtatttgctttgtaaggacttctgtggaaatcacgatagccctcttgattggaaaggggcctgcttggaagcctgccatcttgaagtagaggtcctgcccagtttttgtagtttgtgaaattagcatcacagtacatagcccaaagcttacataaaaatacctcattagcttgattttggctgagggagaaaatctttctccccttttgtacttttgaaatttccttttagaagtacagtttaatttttttaaaaaaacaggttggattttaggagtttagcattaaaatctcctgtggggctcagtataatgctaagagctaaagattaggggctcataaaggtgggttgagaggtagctctacagatgtttgaataaattgataaatgtctttacaattttcctgcaaagggatcccttcttagaatttgacctggttttggccgggcgcggtggctcacgcctgtaatcccagcactttgggaggccgaggcaggcagatcacgaggtcaggagattgagaccattctggctaacacggtgaaaccccgtctctactaaaaatacaaaaaattaaccgggcgtggtggcgggcgcctgtaatcccagctactctggaggctgaggcaggagaatggcgtgaatccatgaggcggagcttgcagtgagccgagatcgcgccactgcactccagcctgggcgacacagcgagactccgtctcaaaaaaaaaaaaaaaaagaatttgacctggttttaaagatttttgggtccagatacagtagctaatgcctgtaatccaagccctttgggaggctccggtgggaggatcacttgagcccaggagtttgagaccaacctgggcaacatagcaagaccccatctctaaaaagaaataaaataagttagctgggcatggtggcacatgcatgtagtcctgtctactcaggaggctgaggcaggaggcttgcttgagctcaggagttccaggttgtagtaagctatgatctcagcactgcactttagcctggaagacagagcgagatcctgcttcttacaaaaaaaagaaagaaaaaattttttgtagcagttaacaaacttccttttctatgtagggtatgataaatggacatatctactctgtgctgtttgaacctactaaactaaaaaaaaatgatgtctttagttaaataaagtaagcatcacgcttaataggattgctatttccatttgcagcagaaagatctcagagtaaagaagaacttaaagaaattcagatatgtgaagttgatttccatggaaacctcgtcatcctctgatgacagttgtgacagctttgcttctgataattttgcaaacacggtaagtgctgcctgagaataaacagaattgagtctgcagtgctcaaaatgccccagatgctttgtgcgtgattaaaactgcttgctttttgcctacatttctatacagccgttatgaaaatacagtatgcactataatttcatttcactttttgctgtggttctaggtagtaattgttggaggtagattagctacttattctatccttttgaaatgtcgcctaacctaacatgcatgatgatttgccataacaactcagaaatcatttgtaaacctctgaaccatttttctttgtaacaaaagctgttctcttgtagtgcacttgtaaatgtgatttgctctctgcacggtttatggaaaattggttcttgaaaaagaaaaaaaatgcacaaccgcatttatttatttattttacagaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatggtgagttcgagaatttcaccagtttcaagaagtaagatacatttagaggcatgacatatttttagaaatttttttcttgtgattttgattttagtcatgccagcagactttgttgaccttttaaaaatttttagtgttttcttcatgtcttaaagcagtgtttactaatgtagtcggacttacaaatcatgaacattttgtaggctctgaaaatttggaaactggtaagataaaattggccaatctccagattttcgtttccacaaaaatccagcctaatcaggaagcacactagttctaaatattatctacatttgcatttaagttcaagtgcccagcctagtgcctgtcatagagcagacctttgataaatgttggtctcatagtagatctgtggctgcatcttgaaaacctgtgataacttacgtgcaggagctccattgcagataatgacattgagggcccttcctgctgctacttttgctccttggttggcttttcctatgcacgctaccttcctttaactgccgctgccactgttgtgctgtgcctcggtcccactcttctgagcatactgcttaattctgcacacattttcctgttccaaagactttcttgacaaaggaagcagtgcattcactgataatcaagtgcatgctcttcaactcactggtctgacatggatccactgcctgaggttcatggtttgagtaacattgatagaagtggcagtgcctggccaaggagtgttttggtccaaatcagtgcatactggagtttgttgcagggggtccagtctgcagatctggatgcgacacaaacattgtcaatagcctgaataatttctgggcagtgtttcagttctttgaagatactgtcatgattaataaaatgccaattcattataattgttaggaactcatgaaaggtttttgttgttttgtactctctcaatccatggacactaaaagtacaaaaagctgtttgtgggcatgtaagacttttgagacagggtcttgcactgtcaaccaggctggagtgcactggtgtgatcatggctcactgcagcctccacctcctgggcttaagcgattctccctcagcctacccagtagctgagactacaggcgtgtaccaccatgcctgggaacttttaaaaattttttatagagatgtgggctcactttgttgctcaggctggtctcgaactcctaggcccaagcaatcctcccgtctcggcctccaaaagtgctgggattacagccaagagccaccttgctggccttgataaatattttaatgttaaaactgagtctttatgggtgaaattctgggatttatgggtgatttttttcttctctctctctttttttttaacctgcaaccattaccatagtcaattttggaataactttatgaccccaaaaaatgactctgtacccattaacagtcactccctattctttcccaacacccccagctcctggcaaccatcagtctgctttctgtcgtcatagattagcccgttgtggatatttcataaaaattgaatcatgatatgtggtcttttgtgactggcttctttcacttaggataatgatgtcaaggtttatttatgttgtggcatgtgttagttcttcattttattgcagaatattctgttgtgtgaatcagccacatttgatttacccattcatcagttgatggataagtgggttgtttgcacttttttggctattatgaataatgctactgtgaacattcatgtacaagtttttgtgtagtttttgtgtatactcttaggtatatacataggaatagaattgtgggtcatgtagtaactgtttaaccttttgagaaatagacaaagtggctacaccagtttacattcctaccagcagtgtgtgagggttacagtttctccaaatttttgctaatacttttttttattttccttttgctttttttttttttttttgagacagagtctcactctgtcacccaggctggcgtacagtggcataattttggctcaccacaacctccgcctcctgggttcaagcgattcttgtgtctcagcatctgagtagctgggactacaggcatgtgccaccacacctggctaattttttatatttttagtagagacggggttttgccatcttggccagactggtctcgaactcctgacctcaggtgatctgcccatctcagcctcccaaagagctgggattacagatgtgagccaccatacccagccttcttttgctttttagctctactatgaagtggtgtctcactatgttttgtgtttttttttatttttatttttcggagacggagtcttgctctgtagcccaggctggagtgcagtggtgtggtctcagtgatctctgctcactgcaacctccgcttcctgggttcaagcgattctcttgcctcagcctcccaagtagctgggattacaggcgtgtgccactgtgcctggctaatttttgtatttttagtagaaacgggatttcaccatgttggccagactggtgtcaaactcctgacgtcaggtgatccgcctgccccggccttccaaagtgctgggattataggcatgagctaccgcacccagccttgcattgtgattttgatttacattaccctatggctaatttggataaatttttaatgatgaaaacctatattacttttggaatctggaaatattttcattttgaacttctaaaagtagattagagaagtacctagagaagtcaaatgtatagacagaaaataggatgatggttgccaggggcggagggaaagagggaatgaggaattactgtttaatgggtatggatggagttttagttggagaagatgaaaacattctggagatggatggtggtgatggctgcacaacaatgtgcatgtatttaatgccattgacttgtatacttagaaatggttaaaatgataaatcttatgtatattatattatatattttttaaagtagagaattgagatctgttaatataatttaatattgccataaacattgaagccatatttataggggaacacatttttttccctttttttttttttcaagacagggtctggctctgtaacccagccctggcatacagtggcacgaacacggctcactgagcctctgccccctgggctcaagccatccacccacctcagccttccaagtagctgggaccacaggcatgcgccaccatgcccagctaatttttgtatttttttttgcagagacggggtttcaccatgttgcccaggctggtctcgaactcctaggctcaagtgattcacccgcctcagcctcccaaagtgctgggattacagatgtgagccactgcacccagccaggagaacacatttgttcttgtcagaattcttttaaaatacataaagatctgtttctaaagaaatgaaaagcaggtggtaggaattttaacattttaaaaaaaggctcagaaccacaggcctagggactatgaaaatagcttataacagtgtggtccagatgggctacatggaattaaactgcactctgttgatgtactctttgtggttcctgattttgttacccagaggtatcaatgttcagttaaaattcatttcatacaagtgtctcattgaaaagggactttgtagttatactgatgcagcttgtctgctgatcaagtcctaatgactcaattgttgtgattagaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatggtaggtatctgactttgtgttagaattaatttttcctctctaagcgactcattacttaaatctgttccatcacgcaaaagttatttttttctgttacatgaataaaaagttatttttgtttacctgtgaagtcttcaatgtgtgcctcaaaatgtgtttctttccctgaactactttttttaaatctgttaaaggcctggttaagtgtataggggaaatcagaaactctgaatgtgtcagcttactatcaaatataaaaccatgagatgtacttgagtattttccagaagttagttgctcattttcgacagttattctaagccaatgatatcagtttaatttcctccctttttagcttgcaaaactcatgtctgaattagaaagcttccctggctcgttccgtggaagacatcccctcccaggctccgactcagtaagtaccagttcttgtttatatacagtagtgttttgggcacacctaaggtcgatctgtgttgtatttaaaaatctaatttctttatttgtgtggccttctagacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcaggtaatgaagattgaaaacttttttctgttctccagtgtgagcacattcctcctacatggtagatgtgcaatagatgtttttaaaattggagaatgaaaataaaagaagaaaatcacaatttcttatcaagttgtagcttggtatcatacacaattgcattctgaggaattaaggtggtacaacttagggagatttggtgtgtctgctgtgatagaaaagatttctttttcctggctttccctgaggaaaggaaagatggaaagagggaagccatacagatatccctctattttgcagtgtagaaactgaatgtgtttctacagggtcaagagacatcagagaaaatttttttttttagaacagaagatcatttcttacatcttcattaagtaaaagaataaatagctcatctctcaagttgaaagaaactgggcttggtattacaaaagcaaaattaagatggccatataggttttaggctcattttgccatgcattatgcaaaggacaaagaaaaagaaaaaatagagctctctttacttaaaacatccttaaggagaagctatgaattccccaaagtactacttctctttattatggaataaatggattcccttatacgtgctttgtttagcaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgtgagttctccgcattggtacttgctcttctgattctcatcttcggtaggcctggcatcatacacagcacaggtacacgcacatccttaacaccaggcgatccatagtaaatgttttcctctaaccattcagaactgtaaacgtcacataagcttacttggtaattttattagcaggcgagaattgggttttcttcatctcttcttaattgtaggcatcgtttccaaaatgtccagttaggctacagtaagcgtatggcctgttcccctaccataagctctaggagagatttccaggttgaagtttgtgtgaagaaattacaagtcaagtatctgagattcaaagctggggagagccagttttgaatctctgtgtttcatatttgaatctgttttttcagttttgaatctctttcagtttttcagttttgaagttctgtgttttgtattccttgtaatgcaggaagatgacctgcccagaagccgtcgctccagatcatccgtgacccttccgcatataattcgcccagtggaagaaattacagaggaggagttggagaacgtctgcagcaattctcgagagaagatatataaccgttcactggtgagagcctctaaattacacctgagaatgtaaacatctgtgagaggaagagagcttctgtccctaagcgttgcccaggttctaaagggcctagcatgtgaaatctgtacctatatgtttttttcacacaaggaaggaaaagttttacagtatccctgggatttagccctctttcacagtggaattatctgcttagtaagtctgtagtcatggtaaatcttttctcctaatttagaaatcaattcattcaacatatatttactgcatatctattatgtgtgtatacatagctaggtgctggagtgtggtggtacaccaaagataaaagtggatttgggtaggttattttttaataagaccttttcttaaagggaaagcggttttaccacaccaggctaatttttatatttttagtggagatggggttttgccatattgcccaggctggtcttgaactccttggctcaagcgatccactctcctcagtctcccggaatgctggggttacaggtgtgagccactgcacctggttgagttatttttcataccctggcatatacatgtgtatgtagagattcatagacaaaatgtaagcctatactacgaagagggacattctgtaaatatgccatttcctctgttgaaaaacagtggttttttttgttttttttcttaatggcttatttgtagggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccggtaggtgcctgccaggggttggtcctgtgggcttgaaggtcagccacaaactgtgatgaggccagaaaaaggcattggtgaaggggtggagccctttctgttatggggtgctcttctttttttttaagatggagtctcattctgtcgccaggctgcagtgcagtggcgcgatctcagctcactgcaacctcctcctcctgggttcaagcgattctcctgcctcagcctcccaagtagctgggactacaggcacgcgccaccacacctagctaatttttgtatttttagtagagacggggtttcaccacattggccaggatggtgtggtggtacaagatctcttgacctcgtgatccacccgcctcggcctcctgaagtgctgggattacaggtgtgagccaccacgcccggcccagggtgctcttaattcagaacacaaatgaattcagagggatggtgctgcataggcatgagccgcttctacgatactcgggtctgaactgtccctgggaagttgctgctccatttatccctggtagctgcttgtaacttccactcctggaaggaagcattaggcattaggaaacattaggcatgactaatgcctattaatcatataaatttttaaccataaagaaggggttaaatgtaatgtagataagttggtgggggaggtaaggtttaacttaattgtgccgtttgacaatcctccttcagaactggcattgcccgccttgtcgaggaatctgcaactgcagtttctgccggcagcgagatggacggtgtgcgactggggtccttgtgtatttagccaaatatcatggctttgggaatgtgcatgcctacttgaaaaggtagtgggtgtttttttttcccttccacatctgaattttatattcatttatgtcttaatgagaagatgatagatgtcagaagagtggttatctctggcggggtggagactgactggaacggggcacactggaagggatgggaacattttctgtcttcacttaggtggtggtaacccgggtgggtgggtgtgtatgaaaaagtcaggtaatatacttgaagatgcgcacacttgaccatagtgatgttataactcaataaaaatggttttaaaaatgaattaggctttcaaaagagaattctttggttgaaaactatgtcctgacacatttccttttgtttttcacagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttctaaaaaa

SEQ ID NO: 6829 - DNA, 303 bp, Homo sapiens
ttggccgggcgcggtggctcacgcctgtaatcccagcactttgggaggccgaggcaggcagatcacgaggtcaggagattgagaccattctggctaacacggtgaaaccccgtctctactaaaaatacaaaaaattaaccgggcgtggtggcgggcgcctgtaatcccagctactctggaggctgaggcaggagaatggcgtgaatccatgaggcggagcttgcagtgagccgagatcgcgccactgcactccagcctgggcgacacagcgagactccgtctcaaaaaaaaaaaaaaaaagaa

SEQ ID NO: 6830 - DNA, 4387 bp, Homo sapiens
tacttcaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaaggtgcgtgggggccaggtggggccacgggggcacctggactcagtcttcagggctttaggggaaggggctcctgactgagcttttcaggatggacttgcagacctgaaaggtgcagagtaggagggtggcagcctcccctgccaggccctgcccactgtggggaaactgaattctccctcataagtggaagctttttcctaccttggtttttagagaggtctcaaagagccaagaggcctacccaagccctagagctggcaggggcaaagctgggaagggggaagtatctgttcctggggcctggggttcctctggagacggctagggggagaagcctgcgtgggaggaaggaccaggcccggagagaggcaccccagccagccccgccctccctacagcagaccccagtccaatacctgctccctgaggccaaggcccaggactcagacaagatctgcgtggtcatcgacctggacgagaccctggtgcacagctccttcaaggtgggccctgctcaacagccctcagcccgggtctcggggggcatcccccaccctggcctgggagggaggtgtgtgctggaccccatgccctggggctcctcctccaactccagcagctcttttccccccacagccagtgaacaacgcggacttcatcatccctgtggagattgatggggtggtccaccaggtgagggccaggaagaggcagtggtgggcttggcatctgcctccagaccctaggctcttcccaccaatccggagcgcctcggatgggaattggatacatgtggaatgtcagaggcccagagagggtgtgagacttgtcccaaagtcacacagaacctcaagggcttgtgctgactccaagcctgcagagtgggctcctcctctaggctcccccgtgctgtgctccctcgccccaccctgcccgggacccagttcaagtaattcaggataggttgtgtgctgtccagcctgttctccattacttggctcggggaccggtgccctgcagccttggggtgagggggctgcccctggattcctgcactaggctgaggttgaggcaggggaagggattgggaattagggacctcgtgaggtaggactggccagtggagtggaagttttgatcgttttctggcggggggtgggtacagtttccccagcagtggtcagggtagctggccaagcggacgctgcgggcccagtctccttcctgtgcgcctctgcctccctggcccatgccctgccagccctcggccacccccacactgccccactggcccgcagccccctcactggcccgccccccaggtctacgtgttgaagcgtcctcacgtggatgagttcctgcagcgaatgggcgagctctttgaatgtgtgctgttcactgctagcctcgccaaggtgagccccacaggggtcccggggcaaccctgccctcctacctacctcccgcatgcagcccaatgaacctgcgggccccaggatgacccacctcctgctcccagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtgagtgcgggctggactgggactgggacaggagctgagacccaggaaggggtcagtccattcaggccaccttggcctcttggatccccagttggggggtgggtgccctcccagtccttcctgcattcattgcctgtgcctgccgcccactcccctcatccacctgccctgtagccatatggtcttttcccctcgcacaaagcagagcatctgccatgcacaggggcccccacagggcaacggagtttggaaagtttcaatttttcgaattgccagttgtgacctactgatggcccacagaattaatttagtgggttctgattgggaattttaacaaaatgaaatagaatagaaaatatccggtcgggtgcagtggctcatgcctgtaatcccagcactttgggaagctgaggtgggcaggtagctgagcccagtagttcaagaccagcctcggcaacatagtgaaaccttatgtctacaaaaaatacaaaaactagccaggcgtggtggcgcatgcctggagtcccggctatgcagaaggctgaggtaggagtatcacttgagccctggaggcagaggctgtggtgagccaagattgtgccactgcactctagcctgggcaacagagcaagaccctgcctcaaaaaaaaaaaaaagtatccgagtgcttcgcacagataaggttaggaattgtgaagcttttgcattgttacgttataaatgtgttttcctggggattgctgtcaaaaaagtttgaacactgtgggtgaggggttttcagaaactgcatgatctgagtagtggctacatagggctggcctggaaattctgcacccaggaccacctgcccccctcatcttcctacacccacttccccaggtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagacccctat

SEQ ID NO: 6831 - DNA, 276 bp, Homo sapiens
tttttttttgagacgaggtctctgtctcccaggctaatgtgcaaaggcatgatcatggctcactgcagcctcaacctcctgggctcaggccatcctcccgcttcagcctgtaggagtatttgggactacaggcatgcaccaccacgcctggctaatttttaaatttttttttgtggagatgggttcttactatgttgtccaggctggtctggaacttctaggctcaagcgatcctcccacctcagcctctgaaagtcctgggattgcaggtgtgag

SEQ ID NO: 6832 - DNA, 1226 bp, Homo sapiens
gtatacatccatacacacacttgaatattttgtcaaaagaatgaaaacttcttataaccatgttttgaagatcttttatacctcatagaatctccccgtggctcttgttttcaacaaatgcctgtggattggttaaggttctactgaatcttaagtattatttacagcagagatggggccaggagtagaatattcactggacagatcccaagtctgtagtagaaaacagcttgttcattatcctctgaatttcctttgccagaagagttgtagggaagaaatggggtggtcctcccattggtctaacttcttgagtgtaaggctttggttctcaactttggctatatgttgaagccactcttgattcctaagtctaatccccagggtttctgatttaattggtgtagggtgtggccaggaccaaataattgtaatgtgtagccaagattgagaaccactgccttaggagatgacaacccccagtctcagttaagaaattagcaggcttattttgcttaactctaggtaatatacgtactgagaaggtctgggaaccatcccaatagtaatgaggatccatagctccctgatctttgtttcaaaggtctattctatacgaaaagataccagagatcctcagagaaatagctgtttttaggactggagcagggaaagaacaagatgtgcctggaatatcttgctgtgtcagaaagcaaagaaataatcagagattattgtcagaagaacataaaagtctgagggagttatgactggtcaaatctgggatttttttttttttcccccgagacagagcctggctctgtccctcaggctggagtgcagtggcacaatctcagctcactgcagcttggacctcctgggctcaagtgacccttccacctcagtctcccaaatagctgggactacaggtgcggaccatcaccctggctaattaaaaaaaattttttctttttttggagagatgaggtctcattatgttgcccaggctgatctggaactcttgggctcaagcaatcctaccatgttggcctcccaaagtgctgggattacaggtgtgagctaccacgccaaatctgggaaaatctgagaatcaaaataagtaattatagtcatggattataactcattgaacaaagtaggaatcctttaatctgtactcatacaggtaaataaatgaaaaaaatgaaagtttgataagaaatgga

SEQ ID NO: 6833 - DNA, 2837 bp, Homo sapiens
agacacgaatgcagagtttgagtccagatcccaaagcccagtacacaagtgtctacggagccctcaagaaaatcatgcggaccgaaggcttctggaggcccttgcgaggcgtcaacgtcatgatcatgggtgcagggccagcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttccgaagcctggggagaaatcagtgacagaggtgttttggttttattgttatgtgggttttcttttgtattttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgaaggaaagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagaggtatgccctgacctacccctgattttatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtggtgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttcttttgcccagttttttttttttttttttttttttaaagcctggattgtaaccagattttcttttttcccccttctcagctgtaaatatgatatctcctttcagggccccagcttaagggcaaagtgagttaatgtgtagacaaaggcgagggacaagagagagttaacatctaaacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctggtagtacattttgcttcttaaaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaaggtaatgtttcatggtcccagggaggggcagtaggggatgtgcaaaggggcacaaaaaatggttgtgggagagtggagaggactgaaggtgggcagagcggctcctattctccagtcagagcagacaggagaattgaattttttactacgttatcaaaggcctcaagaaaggacgtgaacataagagtttttggtattcctgtgctcggagctactcaaagtgtgttttacagaccagcagcatcagacatcttgaggggtgttggaaatgctaattctgaggctgggtgcagtggctcatgcctgtaatcccagcattttttgggaggccgaggtgggcagatcacttgaggtcaggagttcgagaccagcctggccaacatggagagacccccatctctactaaaaatacaaaaattagcctagtgcggtgtgtgcacctgtaatcccagctactggggtggccgaggtgggagaatcgcttgaacccagcaggcagaggttgcagtgcaccgagagtacgccactgtactccagcctgggccacagagccagactccatctcaaaagga

SEQ ID NO: 6834 - DNA, 2201 bp, Homo sapiens
agacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtatttttttttgtttgttttgtttttaaacattcaaaagcaattaatgatcagacataggagaaaccctgaatagaaacaaaacttttgaatgctggattcaaaaaaaaaaaaaagttatctggacagcttctttgagactatttaaaaactggtacaacaggtctctacaacgccaagatctaactaagctttaaaaggtcaagaagttttatggctgacaaaggactcgcgcaacgcagaaggcctttcccaccttaagcttccggggatctgggaattttacccccattctcttctgtttgtctgagtctcatctctctgcaagcaagggctgaaatcattttgtttggttgttttgagggagagaggcggggtgggggggtgcaaatctgccagcagctcttacgtaaggcatgttttattggggagggctgagcttttattttctcctctccagtggggttggcttttattgtttcttgtttgggtttggaatggaaatatggatagcagcataaagtacttttattttgacaaaattcatttttttcaacaatggagacatagatttgacccacaataacttctccccctctctttttactctgctcaaaaagcatctctcctcccattacccaaccttggtcataagtgtgcctggctggtttgcagatatttgttctgctttgtaaaaattggccattagtgcatttattgagatgatctctaaagagctatgccctgacctacccctgattctatgacattggggcccttcttttgctgaaactgccttacgtaatggttttactccttgaaagagatttgacggaatccattttatgccaagtgctgccctgcactgtttctgcaatatgtggtgtatgctgtggtgatcttgctgggaatgattataagtgtgtgtgtggtgggggagtgggtattacatgcattgctgaagagtcatcctggtgttcctcattcctcccaccttcccgtggtcattttaattacggggcagtgtcaccgcaaagggaggaaactcaaagccgaaagcaaaattccaggcctgattctggcttttgaggttcctggttcttgaagccaggcctgacccgactctcagatggggtcagtcccgtcgctttgcagactgaccctggaaatctacaaaatgcagattttcctgatttcctcttctcttgcccagtttttttttttttttttttttttttttttaaaagcctggattgtaaccaaatttttttttttcccccttctcagctgtaaatatgatatctcctttcagggccccagcttaagggcaaagtgagttaatgtgtaaacaaaggcgagggacaaaaaaaagttaacatctaaacagtggaaaaacccatggtgtggggtttctgggaaccaccaacacttgcaggtttagctttttcccagggttgactacaaaaaaaaaaaccatgtttttgcaaaattaaaatgtggttgagtgtgcctaaattaaccatccccatttttatcatatttccaccatcacttcagggttttaaaagtcagtgctcacctgggcggagctggtaatacattttgcttcttaaaaagctaagtcctgggttccgtctgattttaggttccaggaacttcctgaaaacacccgatcgcaaagggtaattttctg

SEQ ID NO: 6835 - DNA, 462 bp, Homo sapiens
ggagatttagggagagctgatgttacagtttgagtctgaaggcagtctggaggcacaatttcttccttgagagagaccccgtttttttctcacgaggccttcagctgattaaatgaggtgtatgtacccacagtatacaggttaatctactttattcagagtctactgatttaaatgttaatctcatttagaaaatcccttcatacatacatctaaactagtgttagatcaaatatctgggtactgtggctcatccaggctgacccataaaattaaccatcacacctgtgcaagcgcttttccctcctggatggtgtcctagggatgacagaggaggggaaagccaggtctctgcttcaaggagacaaaattatgcatacgaagaaattaagaatgctgctgtgtctgtggagtagccattcttttattcctttactttcttaacaaacttgcttttactta

SEQ ID NO: 6836 - DNA, 836 bp, Homo sapiens
gcaaatctcttgaacccaggagttcaagaccagcgtgggcagcataatgagaccccgtctctatgaaaaatacaaaaattagccaggtgtggtggtgcgtgcctgtattcccagctgttcggaaggctgaggtggaaaaattgcttgagtttgggaggttgaggctgcaatgagtcatgattgcaccactgcactcagccagggcgacagagcaagactgcctcaaaacagaaaagaaaacaaaggctaattctcaggctctacaccgaaactactggatcagaatccctggagctagggaccaaaatctgtttattggtgattctgttgcatgcttttgcactattctaaaacctatgtgtgcatacacacacacacacacacacactcactctcttagcccttgttaacccttatcgatcctaagacaaatgtatggggaacccatcagaggctattctttagggctagtgttcaatttgactgtttttaatatgaaagattatggatcacatttcaaacagatgtgaacgtggagagaataatacgatgtaccgcagtgtgtccatcactgttcttcagaaattcacattgggtcattttgttttagccatctctttccacattatcttctttttgttcttttaaatttcgggggtaatatgaagcaagcctcagctgggcagaccagagtctgttccctttttatatatcccggcgtcttagccagctcgtgtctgaatagtgagtaccttttgggcctggcactgggcaggccttcagctgggtcattctctacctggcgatggctttaggtgagttgtggagctcttttc

SEQ ID NO: 6837 - DNA, 462 bp, Homo sapiens
ggagatttagggagagctgatgttacagtttgagtctgaaggcagtctggaggcagaatttcttccttgagagagacccagtttttttctcacgaggccttcagctgattaaatgaggtgtatgtacccacagtatacaggttaatctactttattcagagtctactgatttaaatgttaaactcatttagaaaatcccttcatacatacatctaaactagtgttagatcaaatatctgggtactgtggctcatccaggctgacccataaaattaaccatcacacctgtgcaagcgcttttccctcctggatggtgtcctagggatgacagaggaggggaaagccaggtctctgcttcaaggagacaaaattatgcatacgaagaaattaagaatgctgctgtgtctgtggagtagccattcttttattcctttactttcttaacaaacttgcttttactta

SEQ ID NO: 6838 - DNA, 522 bp, Homo sapiens
cttcctcaaaagtatataaaatttgaaaagacctagaagtgatctagtggaatgaagacgctgaggtaccattgaggttggggaaactactgggacgtgcttacaggataaactgcaaaacaaaagcacaagtttgtaatcatggaatgacatgccttattctgaaaacttaacgtttgtagcgtaccttataattcataagacatttaaaaatggtattgaatcccaataacctatgcgtagggttggatcttgttgttatccctgttttttaatggaaaatctgaggcctgaagatggtaggccatgtatatgcctgccccgccgttgagcctggctcctgctgttggagaaactttcccagtctgtagagagaggatgtggtcctggcaagcctggctcctgcctgattctgtatcttctggtaacacacagccgtcatttaaaaaaaaaaagacaaggtctttccctctgacagactaaaagctgaatccgcttatttcgaactctgccttgaggcgg

SEQ ID NO: 6839 - DNA, 607 bp, Homo sapiens
ctcaaaaatacttcatccatttgagcaatatgaaagaataggctagagagaaacagatttggtttttcaagctaaaaagaataacagaaagtgggcgagtcttcagtgagctgtctgcctttgaaacctaggaagtaaacttaatttggatgtgcatttaggagatgaagcactacaggtggtgaaatgctctagcaatgaagcagggaagggagaggggggaaaggaaatttgagccaagcaacctgaaggtcaggggaagccggtcttacagatgttaagggaggaatccaagtaggcaaaggggatgaacagcagtgcaaaggctctggggcagcaggttgcccggtatgttccagaacaggaaggaggccagtgtggctggcatggagagctaaggctcaaaggagaaagtgaagagaaagaggtagtaagggaccaggaggaattgagcccggccagccgtgctactgatgttagcccacatgtcacagtgtgtgagggagatagagtccttgggaacaataatatgcagagcttttaaaaactttcatactgtagccatcaattccatcatcatggtggtggtatccctgggtggtggtgg

SEQ ID NO: 6840 - DNA, 741 bp, Homo sapiens
tagagatcctggcttcacaggaaagagccaagggcatgggttttgctgagggcgtaagagcttggggaaggtgagggctaggtgtgtacgggtgccctgatgtcctcttagcctgctggtgaggaaagtgcatgtttaataaatgggctccagccaactgtgtgcagttatttgtagcctgcataattttaaaaatgtggttgagcatttaggtctatcttcagaatttaggctccatttgacttagttttcctgaaatatgtagaaaactaatggtgaaagaggacctaattcttgaattatctgcttgaactgtgttgctagttattccaagtagaatttgtaaaatggtccatcattctctaagcaaaatgagggaaataacaattattttctagaaatttcatatatattgaatattacaaaatcatgtaactagaaatgtttaaatggtcacactgggccaggcacggtggctcacgcctgtgatcccagcactttgggagaccaaggctggtggattacaagatcaggagtttgagaccatcctggccaatatgatgaaaccctatctctactaaaaatagaaaaattagctaggtgtggtggcgcatgcctgtagtcccagctgcttaggaggctgaggcaggagaatcgctggaacccgtgaagcggaggttgcagcgagccgagattgcaccactgcgctccagcctgggcaacagagcgagactccatctc

SEQ ID NO: 6841 - DNA, 1423 bp, Homo sapiens
agcagaggtaattaataggcagttacaatgtggaagattctggaaagtagagttctgttgtctgaaatttagtctgacagaggaatattagcaagataaatgtatttggaccaagcactcccgagaggaagggcatgctcaaattgtttctgtaaaaagtctctggcggtgtttggctcccttctgcgtccttcatgaaacagttctccttgagtattacggttggcaagcatgtgggtgggggagatgtcacacgcacccgctccagctgtacaagcaagccactgcgaggattagacgcttgttagttatgaacttaggtgtctggtctgtttctttgcctttcaaaggcacttcctggcagagaggtacaatggtgctttgcaggaaaccctgtgcccacagcatctgttctgcagcttggcagaccgcagctggccctgagcatggcctactaattctctgggtcaggtgtggctgtggtgagatggatctcagccaggtaagaccctctaatctctgttttctttctcctgccatagatacactgatgattggagggtatgacaggaattcttgcctgcctttgggtcgtgagggaaacagagacagcgtaatggctttttggagtgccaggagcagagtccccagagttcattcttagaaaactatgaagctgttctttgaactccaactttttctcctatattcattcagggctctttcctctacaaccccctcattcttgctgttgatagatgcctctttcctactctctaaatgtccaattttatcttcctttggaatgccatcaaattcttcctccctttttctgtaccccacctccaaaaataatcccaacacccacctcgtcagagtgtccatttatttcctcagggctaatcccagaaggagcatacaagttggtgaactcatactaatatgtgaatgattgttgcccttggatggttagaaaatcaaggtagttgtccactgtagaagattgtttaaagccaagtggttaagaatattctatatccttccttttgcatatattatctcgttcatccttgtgaagcagataatctcaccatctcaatgtacagaaaaggaaactgaggctcagaacattttgagtagcctacttaaatagtctaggcagagattgaacccccacgtctctggccccaagaggtcttgataattccctcacaactgctgcctaacagcagataaaatatatttggattcttctcacctttaagaaaacctagtaagttaatctctaaaaatcagcaatctgctcaggggatacagggagaactaggactattgtcccaaatgtgtagtcatatttatctgcttaccaaatgaccatgtgttgaatccctgaaaaccatgggagaaataccaattaaaaaaa

SEQ ID NO: 6842 - DNA, 11445 bp, Homo sapiens
tgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaaggtaaggagtaaagtctataaacagatatatactatctagttccaggcgtggaatcttggtctgtgtttcaagcaagtgagtaatgattatgaaataatacattgaaattatattgttattcttagcagcgtaatgggtttctccctaccagtttgtttactttgtttttgattcagtaatcaaattccttacaaattcctggttccttacaaattcctggttccttacaaattagagtaaatgtatggaatgaattgtgcatctgtgacaactttattatgaaattgggaattaagctgagaactaggagcccaacactgatccatgtcattgtttttcccaattctagttggaggtaatgcttgaagataatgtttgcttgcccagcaatggcaaattatatacaaaggtaatcaactgggtgcagcgtagcatctgggagaatggagacagtctggaagagctgatggaagaggttagttttaaagtaaatgggattcaaccatttttaaaaattattttgctataacatgaaggattccctttcacttttattttataaccatgaccctaaagaatttaaattttgctataggtacccctaagctgagaaacagggggggtgtccaggtgagctgaatgaactgttcagtttggtcttctgcttttctttttttatttctttgcttattatgtgctgttaactttctttaaagtagcatgtaatttgctttagaaatgggaagtggtactgaaattttctgtagattcttaatttttcttcacaggtttttgctttaaatttgacaagtaggtaaaagcttctaatggttgttcctccccattgatttatctccccataggtttattaacaaaactaggatacccaagactgaagaaacaagaagaaacctcaagtgtattgacacgtaaagaagcagcagtcctgccccagttctcctaagaaaaatccgctgtgggcagagaacgatgatgatttaatggtgtttactcctttacaggattcttgtctttaaagctgtgtgtttttcaatggtgttgttcatacatatagtcactcacttaacttgggctacttttaaaaaaaatacacaagataaaattgatggagaaatggtgggaattgaaaacacgcaggtggagcagtggagtaaccttgagtttctctctccacttaaacctttcggagttcctttatgagggcttaccaaatctgttaggcctgcagaaacactgtcatcattatggtctaaaagggctaacagattatctttaaattctatgattcccacttgaaagtcagatgcatttgccatgtatttgcatctgtctcaatggagatgactctacagcttgcttgaatttttgcatttgttttttctttgtttttcttgacattgcttacaggaaggaaatatgtttatgcaaaccagaccacttatctgcaaaggtgtaaactatattcagtattttattgtaaatatgtatattctttaagagtatatattgtactagtgctttttttcttactgttatatgatagaagctatgaaaaaaatgaagatttctttcaagccaatcaagccaacgactcttcagccagtattggaagattttgtatttgattttggttttttgtttttgttttttaatttttaccaccatgacatgtatttttctttacctccggatcctgccagagtaatatgtcaagaagctcaagaagcacactggaggttaccttgaggcgtttgtgtaatctgcatactagtggagtagccatggtgaccgtagccacatgggtgttctgttgctgttttgcaggttcaaaccttgtactactcagctgatcacaagctgcttgatgggaacctactagatggacaggctgaggtgtttggcagtgatgatgaccacattcagtttgtgcaggtacacattgcacagtctgaggtaacctcaggttaaaatttgactagagaatttgatagcatacttaaattttcctttaataaaggaaagtggaccaatttcattggtataactggacagaaacatttttgggagaaaacaagcatatcttagagttagtatttttgccacatgaaaagatattaacaaattaggaaaccctattgaaatttttttctcataaagcaggaattacaaacagtaaaggccaataagatggaacaatatagaaattatttgggaagattatgaaaagcagttgtttgtgtcaggcatgactgatagttttttttaaaaaggggcagggggacttaaattgttgatggctatgaaagaaatttttggatgttaccttaactactgagctgtcttactggaaattagaaatggtatagttaagatggactatacaatgtaataagtctaaaagtggtggatcatatgttaaaacctgatctagatgtttctttaaccaagatgaattaaaatatagtagagttccactgtgctgattgagttactttgccttttataaaatccaatttcatttttcccctatgagtaaacacataattattcagacacattatcaacaattactagagaacaaacttctcaagtataaattttttaagtttatggacaaatacagaaaagtacacaagtcataattaccacatagtgaacctaccagtgtaaacactacccaagtcaagaagaggtttctagcatcccggcagcctttctcttgcctcttcccaaccgtttccgtatagtgctcccaaaggaaaccattatcctaccttctgacacattaaattagtttggctatgcttgaaaaaatttatataaatggtcatatagtatatatttttatttggcctttagctcaaattatgtttttgagggacaagctataaagcagtcgactcagcccagactaaggaatgcttttctttaaaaatcagagggtaagtggtagacttagtagtagcctatatggttacaaattatcaggtgttagctctctcaggtgtcctgtggcaacagtgagtgaatatttctaaaagttttggaatttgaattagttgagaacctatgtttgtgcattttgaatatattgaggatattttcccccttaactctaaacattttgagttaacattttaaaagtacattttcaacatgcagaggttgagtgcccaataagtggcaggccataatgttcggtatggcaacacaaaaatgtgtaagagacagtttctgcttgtaggaccttctaagagtgggcaaaacaatacaggcttataagaggtagctacgaaaggcctaaaggagaggacacagtgagacaggagagaagccagggatatttcacacaagaggtaacttttgagcagtgttaggatttagaggagtctgcatagcagataaagggagaggtgttagcaaagagtatctgtgaggatgatactcttggaattgcaggtcataagactgggaaagtaggtaaatgctccctgaatggggcttatactttatcctataggcagtgggaagccttaggtaagaatacagtgatacgaaagttttgcattcactttagtaatggtgaaaaactggggaacagtctattaggtggcagtctttgggctggaatatcccaactgatttctggttttattttctaaaattgttgccttggacccttcctatttttataaccagacacagaaaatcaataaaagtttgagcccagtttatagactattgccagcagtagttcaggttttaaaaaaatgatgagggattaatctaggggcatgaaggagaaaggatagattttttatttatgtctatatataaatagacatttatatttacaaaggttgacttagcaggccttagtgattgcttagcaagattagggaaaagaaagaatttgagaataagtgggattctgacatgtgtgactcattagaatgtgatgccatgaatagagatcatgaagaggatgcgagggacacatgttagacttcaggaatagaaaaaggaggttgagaagaagccattagaaaagtcagaggacaataagaatctaatcatgttgtaaaagctacctaaggtaggagaagaaagtttgaaagaggactaaacactgtcaagttctctgggaggtcatgtaaaataaggtttagggatatattctttacatataaaggatttaatcagcatttctatattaggcttgttattaggcattgcttttgggcctttctctttcacagtcattttctcttaattatagtttgtacattagaacagtttttttacttcagtacagcctcaatgtaagcatcatccatttgtgatatttggatcccttcttcccataggttgggatgaggttttatgtaccttgtaattcataataatagataaggttagataagtctaaccttattttttattcttaatattcatagtataaaagtgatatgaaagatgcattcacaactttagtaacagtggaaaacagcctgtcatagtgtaaatctgttttatagtatgacataacttgtcatagtataaaaaggatggggtttatcttcataattcctaatctttattttagttgtattgccttgggcaatgcatatcttcttgagtttcaatatttttatctataaaatgggtagataatatcaccctcactggactaaaagagatgatgtaaataaagtacctagtaatacctaggtacatagtaaacatctaagtggaatttaatcataaccattgataatgatacattccctgccttttctcaaaatagcctacgtatgttgtaaccacactcaggcctaacttttgatatagctttttcttaatagcttcaagtagctagcaaaatctttttctcaattacttgttatatggctttttgcttccactagcaacagaaatttccattagaaattttacctatccatgtgttctggccatctggaccagcacaagtgggatgagcaaactaggccaggtgctgaagttgctacctgttcatttggcagttcctctcagagtagtctttactcttccaattccatatgatcatatcctttggaagtggcaaaggctaaagtaattggaaggaagccatcaaggaaaactcatacatgagaacacatgtgtaaagtagttctcttacaatcatttggaaattggcagctttgttcatttctccctctttagtattcctgtatattctacttttgtgaatatttggttgtttttagtaatgtttcatttctgattactattttcttgtgttttgatgtaattttgtctagaaaaccactctataatacctataaggtaatcctaaagaaatattctttaagtgtttcttgtaattgccacttttttcctgtcaagtactttcagagaaactggatgaatctatatctgcttacgttttgctggcattgtatgaaggatacctgtacatatgatttagttaggtttgacaatttcatgaaaatagtgggttaaatgtattctctgttaattcacactattttaaatttatagcattcttttaaaagattctatacttaatataaaaataattatagattggttttttcttctgctgaggtcttgatttgcaacatgtttttcaaattgttaaaactgagctttttcttacctaggctaattgtgtaggcgtagttgtctcatcattgagtggagatggaagtatgccagtaatttgtgtcatttggaaagtgttggcttgagttaaagttagtgtcctataaatgtcatatataggtgaaggatactcagtgttgtggaatagctcaggaacaaaggtacatcagatgtggtctttggctaggtttctgtagctaccttttgattttgcagaaaaagccaccacgtgagaatggccataagcagataagtagcagttcaactggatgtctctcttctccaaatgctacagtacaaagccctaagcatgagtggaaaatcgttgcttcagaaaagacttcaagtaagtatatgacacttgccagattgttttcagcttacctatttttaagaaggagtgttgccaatttaatacctcttaaattgactactcgaggaaaaaactcagaagcaattaaatttggaaaacgagagcagattgttccagtctgggatgtggagactggagtccaattcaggatcatatacacaaaccaaaagtaataattacatcttaaacatggaactcttgtgcttacagataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtaagaacagaagcattcaactggctaagcatgtagatgggcatttttgtgacatgcaaactttcaaagagagggtttaatatgccatctttcacggcaatccaataagatagggaaataacaatactattgaatatggctaaccttcagttcaatgtctgtatctaatttttaaaaaaattatgtcatggctaaatttttctaatattcaagccaagactaagcagtttatttgtactgataatgcgatttttcagctattacaagcacttagttaaaagatcaactaaggcatccttaaaaagttttaatactttttctcattgtgcagatttcttaaacttacaggactggaaaccgtggtccagtttaatattttaaacataaatctttatggttttattttttaccaggtggctataacagagaggaatgtcttcgaacagtcgaatgctataatccacatacagatcactggtcctttcttgctcccatgagaacaccaagagcccgatttcaaatggctgtactcatggtaagcgcattatgttgcaggagcaacccctatttagctttttcctcgtaacttcaggatgttagaaattctcatctctcacttttggcatagggccagctctatgtggtaggtggatcaaatggccactcagatgacctgagttgtggagagatgtatgattcaaacatagatgactggattcctgttccagaattgagaactaaccgttgtaatgcaggtaataatagttttctcctgagatatccagtatttaaatatgataattaaattatcaatatgtaactttattttatacttacataggagtgtgtgctctgaatggaaagttatacatcgttggtggctctgatccatatggtcaaaaaggactgaaaaattgtgatgtatttgatcctgtaacaaagttgtggacaagctgtgcccctcttaacattcgtaagttgattttttttcctttttttttttaaagaccttcaaatcaacagtatgtgtagtatacacttagagtctgggagatgtagcaataatcttgacttgacttttcttgtagggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggtgagtgttgggatttggagaggtgaagagtagatagtggcaagactttgttctaaaactctgagagaaaaggccaatgactatagttgtacagttaagaattcagaagcagtcatctcttttgatgcaatggagattagggtgatttgtcctttagaaatatattttctaatcaaagacttataatacttgatatataacttaattcaccagtcttttgatgggtgcactgagtgaatttccaagtcattttcttctataaaacatatccttaatgcatcatcttgaattttgagtttccccttctttacagccagaatttaaagaatctgatctgcaaaacaaaggcaaatccctagtcttttccaactgtctactccatacctaattggaaatacaacctttagactattttaacaagtttccaaagtattaaactttttaaatgtagacatagctttctttccacctccattttattgacttttaatgtctaattatataatcataatttaaaagttagcattgtttttggtaccaggctgaaccttagcaggcttatggctcaactggtgaaggcttaagtgtagacacagcctgttggcctagagcattgtcagcgtgctttacagatacatagaatgcaagctggttaagtgatggtcaaatgaaaaaataatgaatttgagaatcagtaataaaattttttctaagctacggagtatttattgctaacattttatctatttgaaaataatcataactctgtttccagaagaaatttctgtaccacaatcattttatttttttaattgagacatggtctcactgtgttgcccaggctggtctcgaacccctgggctcatgcagtcctcccacctcaggctcccatagtattgggattataggcatgagccaccgcatctggccccaaaatcattttatacagttggaaagccctaagatatttttctgctttcctataatctcttctgagtcttaattctgtacattgggctgatataaagtccagtgcacagaactattctggtttgctacttagtagctgcatctgtaggataattgtccagcttcttcctgcttttcttcttctctgaaataataatagtaactaccacagagttggtgaaaattgtacttatttagatgctgctactgcttcctctccctcccccttttaagttgcctaagttccacgtgggaatggtttttttattgatttgattcccagctcttagagagtatttgtcatattaggcatttaataaattctttttgacaaaatgaacaggcatttctatttttaaaaccactgatttttaagcaaaagacagatttaggggagttttaccttattacactttaatctctggatttaccccatctcatttctcttttaggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctcatttcataagtgacatgcttaatgcaaataatatatgggaatactttgggtcaaagttttcctgcattaccttggatgccaaagaggtagtttggtggccaaaaagtatctttttttaagaagctgttgtagctagtctgcatgaacatgagaagtttcc

SEQ ID NO: 6843 - DNA, 535 bp, Homo sapiens
taataccacacttctggtcaacttaataaaacactctaaatttcctaaaaaggtagaaaagctataaaatatctaaaccaaatattattggttatactcgggtggatcttttattatgaactttaaatgtagggttctgatttttggcttctagtgtgtcatgtactttaccactgctcaacatgttttcaaattcccaatataataatcatattttagggaaaatccaggatttgagtatgtgatatatcattagaatccttgcttaattaacaaattaggtgtgtgccctattacctctcctgacctcagaattcttaaaattgaagtaggcaaaggaggagccccagtaggacatttctgtaactgcatgcagagttgccttcagaaaagtgaatatgattcatggaaaattcagttgctgtcgtaatttacacgcagctgctttttgttccaaaaaaaaaaggtctgaagagtcagcaagtgagacataagatacaaggttaattaactaggtgtaaaggagaaagaaaaa

SEQ ID NO: 6844 - DNA, 197 bp, Homo sapiens
agatactgcgtttcatgaagccttaccaaattattctacttgaaaatacttatgtgaacttacatagcatttcaatttgttgtacctctccttaaactaaaacttacatatctgtatggcataattagatgtttatcatttgtatacgtgttattaccactattaacatttgttgtattaagacagtgatttttgat

SEQ ID NO: 6845 - DNA, 913 bp, Homo sapiens
tgtacacattttatttccttttcatgtcttgttgcactagctagaactttcagtattgaaagtagtaaaagaagccatgcttgccttggtcctttgtcttagtgggaaagcttccagtttctcaccaacatgatgttagctgtagtttctttgtagatgttctttaagcagttgaggaagttcctctttattttcagtctttggagagtttttatttttatcccatacttcatttcaaaatgctgagaggtttctttgttgttttgttttgtttgatcatgaatgggtgttggattttgtcacatgctcgttcagcatctattggtatgatcatgtgatatttctttagtctgttgatgcgatggattgcattaattgatttttcaaatattgagtctgccttggttgtggtatataattctttttattaaattgttgcattccgtttgctaatattttgaggatttttacatctttatttatgacagatactttaatatccataggatttgcagtgatgcctgctctttcatttcttactttttttttttgagatggaatctggagcccaggctggagtgctgtggcgaaatctcggctcactgcaacctccgccttccggttcaagtgattctcttgcctcagcttcccaagtagctggaactacaggtgtgtgccactacgcccagctattttttattcttttttgagacagagtctcgctctgtctcccaggctggagtgctgtggggcaatctcggctcactgcaacctccacctcccaggttccagcgattctcctgcctcggcctcccgagtagctgggactacaagcgcccaccaccacgcccggctaatttttgtattttcagtagagacggggtttcaccatattggcctggatggtctcgag

SEQ ID NO: 6846 - DNA, 406 bp, Homo sapiens
atttctttttattgctgattaatatcccattgtctgaatataccacagtttatttattccttcatctactgaaggacgtcttgattgcccacaagttttggcaattatgaataaagctgctataaacattcatgtgcaggtttttgtgtgggcactaagtttcctctcctatggatgaataccaaggagtatgattgctggatcatatggtaagagtatgtttagttttgtaagaaaccaccaatctgtcttccaaagtggctgtcccattttatgttctaccagcaatgaatggagtttctgttgcttcacagcctccccagcatttggtggtgtccgtgttctgaattttggccaatctaataggggcatagtggtatcttatgttttaatttttatgccccca

SEQ ID NO: 6847 - DNA, 297 bp, Homo sapiens
ggttttctttcgtttttgagacggagtctcgctctgttgcccaggctggagtgcagtggcgcgatctcggctcactgcaagctccgcctcccggattcatgccattctcctgcctcagcctcgcaagtagctgggactacaggcgcccgccaccacgcccggctaatttttttttgtatttttagtagagtcggggtttcaccgtgttatccaggacggtgtcgatctcctgacctcgtaatccgcccgcctaggcctcccaaattgctgggattacaggtgtgagccaccacaccc

SEQ ID NO: 6848 - DNA, 313 bp, Homo sapiens
tttttttttttttttttggagacagagtctctctctgttgcccaggctggagtgcagtggcgcgatctcagctcactgcaagctccacctcccgggttcacgccccacgccattctcctgcctcagcctcccaagtggctgggactacaggcgcctgccaccacgcccggctaattttttttgtattttttagtagagacggggtttcaccgtgttagccaggatggtctcgatctcctgacctcgtgatccacccacctcggcctcccaaagtgctgggattacaggcgtgagccaccgcgcccggcctaaa

SEQ ID NO: 6849 - DNA, 47567 bp, Homo sapiens
ttaataatttatcttttattgaaattgttgaatactttatattacagtaaagttgattgaaaaaaaaatgaagagaaaaatcaattttaaaaaatacactcatgttgaaatcaaacaagccagccaaaccggtacaggctgagggatgctgcagggcggtttgcttctcagcaatagaacaccagagtctatatacaattctacaatgcgagaaaagtcattcactaaacatggcaggaaaggcgctgccgccagaataagaacaccagcagcgcctccctcctcctccatgctgtgaccgcccggcctccctcctcctccacgccatgcccgcctggcctccctcctcctccgcgctgtacccgcccagcctccctccagcatgaggccaagtgcaatgctagggccgaggctctggcccatgatttttcatgcagtttctgtaagtcacacactgtgcaaattaaggcttcttataggtcgaatggttgatcaacacttttttcttaaaaaaataagcacagtaaaggtggtatcatgagaacctgaagagatgagacctataccccaaatctggaaaaaattcattttctctgacacctcaactccactcacacacacacacacacacacacacacacacacaaacacacaaatcaatctttgggcaggttgtttgaattcaccagccggcaaaaatactgacaaatgtgctctgtacgcccaggcttgaagatatcatgcaaaaaggtgcagccattcctgactaaaggcatagaacaggcaaactctccaaaacctaggcactcggggaccctgtgcacgtatgtgtgtgtgtgctcgcacgcacgtgtgtgtgcccttaagaaacagaaagcaaaagagaaaagagacagaatgagctccaactcaggggacacattaatgaccagttcaacatcccgccggaagctgccccatacactgacagcctcaccatctcaagatggacaaactggtacatcacacccctgctggcaggaagaaacggtggctgtttttttttcctttttctcaaacctgagtaattgtcaaagtcaataaatagggggagagaattaaaatgctaaaatatatcggggtcaaataccctatcgggactaaagcagcaagggtttcttcgaatgcagccctctgttttgagatgcgtccggccttatgcttttaaatgaggacttggggcaaaaccctgggcacaaggtaccgccctgtggccgatctgagccatgccttattccaatgactgtaaacaatcaggaaggagtggggcctgacctccttcaccctctcccccatcacaaaaactcttcccttttgaaagtttctgttaaaggcaaaattatagaagcatcatcgagtggaagtcttatttggttggaggtgcttggctgtcccgcggctccgtgctcccctgcaggcactgcggagtcagatgtgtaagaggtcctcgtcgctgtcgtcatggaaggacaccagcttggtggagctcactgtcttctgctgtgcagagctggacttccctttcctcgccttctcacccctgaccagccccaccctatcgtcctcacgctcctgaagggcattgctctgtgcgtttctcactgggtgggagctctctgccccagctcccctgcccgagtgaactttcacctctgggatggtcagaacctcatcctcactgtcctggtcatccccatgcagggagctgagggctttcactgacttggtggtaatatggccgttctcctgcccttcctttccctgccgtggaggaggcagctggatctcttccatcagccactctgtttcattctcatctgtctcttcttccttattcacctgccagggatcaacagcagagaccacgtgagccccctaagagaccccattctgctccaccatccaccacatcagggatgctctctgctggcacgagctggggaagaactggcccactgtcctcacagtcactgcatctccagttcccagggaaaggaagacgagggctggcaacaccttcctgttcctaatgagactgcaccaaggcaggagggtttgggagggtggcagtggggtcatttggcaggagtctcacagccaagggtgggaccaagcagaaggcgttcgggatggcctggaccgaaaagcagaccagtgatcccccagcgcagctgggggagaaggggctcttccgggctactcatagactgaaaggtgcccactgcatggcaggggaggaatgtcaaaggagggactccagtcaaaagcctagttttagagagcaattcatcattacccatcgagaccacaaacattatgtcctttgatccagataatgcctcttttctgcaaatttacctgaaagaaatcatccaaatgctacatgcacaactatcttcactactgtgtgtgtgtgtgttttgttttttttttaaagaacagccaaaaacagtggaaacaacctaattattaaatacttcaaggaaatcagttgtaaccacgagagaaacttgagggaaaaaaataacaaaaaaatgtgctggcgtaagtggctgaggcaacgggtgttgctttcctttctggattccagtcagcctgtgactgctttccttggcacccctgatgagaacgacatggacagcgcagcacagggggccggggaggcaggccttcaagagactcgccacagaaaattacctttgagtatttgtaggacacgttggaacttctcctacagcaagtggtcagcttacttatcactgtttccctataaaaaaaaaggagacaataattactccagtgtagagagggcatgggcaggagccccacccccgccagccccacccccatctgcaccaccagggggctggtggtggctgcatttctcccacattctgaatgacaaatgagtagccgtgacaggttatatataccctaatgtatttgttgtgattgagtggaaagaagatgggctttggaatccaacagcagagggccctctagagcaacttaacattagggcaaggactttttcacatgactaacaggaccacaccagtccgtcgccactaagcctgcccaatggtggctcgcagagacagacatcacatgcccttcccggcccagaccttcttctgccccattctgcattttgggtgtagagggccacaatcggtactttttttttttttttggacagagtctcactgtgttgcccaggctagagtgcagtggtgagatcttggctcactgcaacctccatggttggtactttctgaccacctctctcattggcctgtggctcagctggcaaatgacagtggcagcagggaacgcctgagctggccagctcctgcccccaggtcagagccactaacactgacgcctgacgtgaaaatctgcttgaccgtcacatggagagtcctttcacccagcaaagtggcgcaaaaggatggcatcatacctggtacatagcaggcgcttaataaactcctgcatttatgatgtgaggagggcagaggggtcagctgctcagtgggaaaaggcacccatgaaaggtgccgtttaatgttctactcatctttggacacaaaggaccacggtcctagaagccgcaggcacgggtgatgtgcgagggcctcggccttggtcagacagaaatgcaggcatttaaaaaccacaacgctggggactgcttccagagagttttggactaagaacctcgagccttcgctgctgtagggcttaaaaacaaataaataaaaccccacaaaactgaccccaagattagctatgggaggcatgcatccacccgccccacctcgccctgccacccgcttacctcctctccttcttgtagagcaacagggccagcaggcagcaggtgagcgccaccagcagcaggctgagcaccgcgccgactgcctggctccgttctgacagccccttgtgcatctgcccgtcgtccccgggattctcgctgtcaaagcccaccctgcaaggacgtcacagaaaaggagccgtgtcacagggtggtcctgctgccacagccacaacctgagacctgagtccccaaggcaagagcagctctgactttcccaacaccatgtgattcttactcctgcccagaaaacaaggccacaagtcccactccacatggaagagggctgcaaaaagttcctgatgatgagtttgtggcagggttgtcagaaagcagacaagaaggcactgcttccagctccatgaactatcattcacccaaacacagaggagacaggcaggagggacgcggccccctctaggtggcccaatccacggcaggactaggctggggcagaggctgtcccgaagcaccacacttctctccagggtcagagctctttcctctcagaatttcttctggaagcagtgagcgcagcccaccatgagacaccatctccacacgaaaggggcccagggggccttagaaacaggccaggacggggcccaggggcggccacagaccagggtggggcccagggagcagcagagcccagcacagcccccgacgggtctcctctctccaagcctgctccatcccaggagaaggctcttgagcacaccagctgcctcaccagcggagttcaccattcccacccaagacccacatgcacacttgtgggaaaaagcagtgcgtttccatgacatcgaacactcaagcagagttgggacaataatagaaaatgagaaacaaccacggagacttccctttgcgcttagggagcaagatgacactcaagagtgtaacgacttgacacttctaatctctctggccctctgtcacttggggccacacacacaggaacaggatcacataaacagaaattcctcctgtgctgctggtgataagaggcaaccccagcggggcgcatcttgtgctgctgaagatgccggctgctcaaagaactgaggttgagggcaacaggccaacccgcggcccagccgcaagggctgccgctctcaaagttcagcttaagccaaacaatctaaaacatcagcaagacaagaaaccacagggacagcctggcgtccagttctaggtgggcctgcaagggttgacctctgctcagaaagaagcaccaccacactccacagacaggtctgagagctatgcagacctctccctccaagccagaaacccactcacccagaagcagctccagccactcaggaccactcgaaatgcatccaagagacacatcatcactcagttctaagcgtattttactttctacctttgatttcttctttggaccatagattattcagaagtgagttttagtcttcaaacgtatttctatttttcagttgtttgttcttggttcctaacttaattgcatcatgtatgtagttaattgcatcagtcagaaatctgctgacttaggccgagcacagtggctcatgcctgtaatcccagcactctaggaggctgaggcaggtggatcacctgaggtcaggagtttgagaccagcctggccaacatggtgaaaccccatctctactaaaaatacaaaaattagccaggaggtagtggcacacgcccataatcccagctactcaggaggctgaggcatgagaatcacttgaatctgggaagcagaggttgcagtgagccaagatcgcaccactgcactccagcctgggcaaaagagcaagtctctgtctccaaaaaaaaaaaaaaaaaaaaaaaaaaaaaaaaaaaaaaaaaaaaaaaaaaaaaaaaaaaaaaaaaaaaaaaaaaaaaaaaaaagggaaattgctgacttgcctgctttgtggttaatttttgctaaagttttctaagtgtttgatgtaagcttgggcaaacagtgttctcccaacgcagggaacagtgttctgcgcatgtctattaaatcttgcttttcactgtgctgtctcaatcttccaaaaaaagctttactctttgtctactcaacccagcaatcactaggcttgtttcttgtgtgtggttttgtcaatttctgctttacatatcaaggcttttttattaggtagatggaagtttaggattcttgtatcttcctaggaaattagcccttttaaaattataatgaccctctttattctttatccctaatatttttctttaatatcctattttatcttatattaacataactactgcagctttctttcagattattttctggtatatcttttcttctcctttgactttggtcttttctgtatccttgttttaggcatgttccctgtaaacagagttgtttttgaaatccagtttgacaacttgttttttagctgacaagtttagtcaagctatacttatgattatagatatatttagatttatttctaccatactgggctgaaatttctacttatctgatttttgttttatttttctccttgcttgtcttctttggggatttaagtatttttacttctccttttcttctccgctgttttggaagttacatactatatttatattattttagtggttattcttaaaatactggcatgcatactaagacaggaagtctaacagtatgtcttccaaacaattaggaactctaccttttcttccttccttcatttctttcaagaaaatggttttactttcatatgatgctatcactgtaagaaattttaaaagctgggaactctgccacccctctcagcttagacaccactgttgtccagtacagtgtgtcctcatagggtcgctgacagtttccttcaaactgcaaccttccgtgaagcgactatgggaggtcctcgaatgacatcatttccttcaaaactgtctcattataaagttgatgaggccgggcacggtggctcacgcctgtaatcccagcactttgggaggctgaggcaggcggatcacaagatcaggagatcgagatcaacctggctaacacggtgaaaccccgtctctactaaaaatacaaaaaaattagccgggcatggtagcgggcccctgtagtcccagttacttgggaggctgaggcaggagaatggcgtgaacctgggaggcagagcttgcagtgagccgagatcgcgccactgcactccagcctgggcgagagcgagactctgtctcaaaaaaataacataacataacataacataacataacataacataacataacataaagctgaggaaaaaaaactggtttcattatacatcatttcacataaagttgcagtttccaagaacctatcgatgatataaagtgaggatttaaagtattttaacctttcttgaattattttctaatacaacaaattagcctcccctaaagcttttacagtcttttctttgtatctgctctcctggtatttcataagtgggtgggtcttgtcatcaataactgtgctgggcacatagcctgccccttccatctgtagatgcctgtcttttagctttgtgtaaattttttgactttaatcaaatattgtgaaagaaccatttttgtaaagtaggaggaaggtgtaagacagctctatcttcatctactattgcaggaagtcaacagatgagatataggatgttaatttaaaatactgaggtaaattccagaagaaatagctaaaagaactaaaaatggtaatctattagggcgaacattgctacctgtttgttatagttacatgattttttttcctgagatctagtctcgctctgtcacccaggctgcagtacagtgacgccatctcggctcactgcaacctccaccttccaggttcaagcaattctcctgcctcagccttctgagtagctgcgattacaggtgtgcaccaccacacctggctaatttttgtatttttagtagagacggggtttcaccatgttgcccaggctggtctagaactcctgacctcaagtgatccgcccaccttagcctcccaaaatgttgggattacaagcgtgagccaccgcgtctggccatatttacatgattctacaatgtacaacactgataacatttggggaaaaaaaaatctcaggcactattccacgtcacccccgggtggtacctgcatccctcaaaatccaccatctgagtttttgctcttggtttcaacttctgtttcttttttttaaagtccttattaccttgtcagtgtgttaagggatttaaacagctcccaatcctgatgttctgaacatcatgaaaccgaggtttcctggagaatcttcctctctggttttagagtcaaacaccaaagccctataaacagtgcttttcctactcacagaagtcgaactctaaacattcaacatggacgggatcctagcctggcctggtccctcaaacccacacagaagaccagctgccatgtcaggaggcaggattcatctcatggcagctgtagcctctccatgacagagaatgcagggaaagttcacttctgggttttatcttttataaaaattcacattttgcttctttcaggaagaacttccagtttcaatcctttcattttgtaatgacgtcaccggaacaccataaacattcaaaagctgaaaataccacaagtgaaatttcaaccaaaagcctctttccctgactgtgcagctgaggatccctaagtacacaggcctgaacagcacaggacaaagctggtttttgctgagctcatgtccactgttaagggtgggcagggggagtgctgatttaagatgtaaaatgtgtgatcttcattcccccatgacccccaccactgtcgtctgctgactctacggtccctttttcaggacatgaaggaaacaattacatggcaagaattcatgttcccccaatcttaaagtctcaggacagagaatgaaaagcttatgtaaaatggtgggccaggccgggcatggcagctcacgcttgtaatgccagcactttgggaggccaaggcaggcagattatctgaggtgaggagttcaagaccagcctggtcaacatggtgaaaccccatctctaccaaaaatacaaaaattagcagggcataatgacacatgcctgcaatcccagctacttgggaggctgaggcaggagaatcgtctgaaccaggaggcagaggttgcaacgagccaagaccgcaccactgcactccagcctgagtgacagagcaagagtccatcccaaaaaaataaaaaataaaaataaatataaatacaatgatgggtgggggtaacataagaagaaaataaatccaagaggaaagcaactgacaacatgttattcgtggcaaagtataaaacggctgtgggacacaagacaaccaatggaggtgccaccttccttcagagcagaaactgctccctctgttctcatgctgattctcaaaatctggagagtaagcttttcattcattcaaacaaacgtaaaaatactgcactcaaatcaaagtaaaaatactgcactcaaatcaaagtgaaactttaccaaacaatcatttgtattacgacacaaaagatgttccaggattacacagaggaggcaccaccagtacttgcctcccaggagctaaggagagggaggcagcaatgggaacagggtagagggacagagctggggtgccctgactggaccctattcggggcatggtacacacaaaggaaacaatggcactgctgctgggggtggtgggaggtgacgcagccatggaccaaaaatcagtggcaggatgctgacaagcaacggagcggggcactgactatgtggggtccgcttctatcattttctctattttttggtgcatgttctgaatatttcacaagaaaacattggggaaaaaacacacatacacttattcttaagggaagatgtggggtacaagtgctaagcttccggatgtcatactcaccccagaggacacacggctgaggtgtaccaagagaagaggtactggcagtcggcagtctcgtgactgaactcggggatcccgtcctccaccagagggtcacagtggaagaagatggtggaagaaacagacttggtcttatcctttccgcacttagaggaagaggcaaacacgacatcgagatcgccgtctgtcaaacgggaagggcacacatggcatgtcaccatcatttttcacgagcagactgagcttagctccttacggtctaaaaagtttgcaaagacttaaaatcaggcagaagagacttcatcccacgtcccacaggcactctgttcacagcttacgaggccactcgatgcacatggatagagccctgcccttagtcagcatgcagtaaagaatttttgttttgttttaaccacgagtatttattgatggactgaagacacaattttaatggaacaataaggcacaaccgtggattaaaacagtctgctgtacagccaaaagaagggaaaagctacaattttaggaactttaaatatgcaaatcaaggagcctctgaagtatctaacagatcagtatcagatattcttccctttctatataattcctgtattacatcactcaatcacaaagtccaactgacacttcataaagaattcctcattcatttatatttgagccatccagcctggctactcccctgttctccactgttttccatcgctttgcagtgtattttttagcaatccccttcctaaagaattatgtacacatcttcaatagctttccaaagcaaggaaacaagcaagcaagcagcgagtcaagaaagtcagccaacggcagatatgtgaatgaacagactcacagagacatacattaggatggcaacagcctgattcactgaagtctaaactaagctgactttggcagaaaagttgctgtgacttgcttaaagacttggaatgccaccttaggttgtgctactagtgccagacctcttgtttctaagggattagcagtggtctacacaaggagctgggaaaccagtgtaaccagggagctaatgatacaacagtcaacgctttggacttgtataagaagcggactatggcttctagcattaacatttgccaagtgtaaaattcataaagaattttgtgcaaaacttcaagacacagagaacaatctttaaatattttggactaggatacattaggcacttccataacactaatctttctaacttggaaacgtatagtgaaaagcattccagtgcacataacactgaggcataaaccatgcagcagaggtgtgaatgcaggaggcttcacagggtgcgcagcctccttgttcaaaaagccatgagaaagtccccaagcatattgtctgagcagccgttctggtggtaaccgtgtcccaagactaagcaaatctgcaggcatattgctactttttgaatagtcaacactgcactaacaagagacgccccataggtacaaagttgagaatcagaggccagaggtagagtgacgtgggcaagcaacctaaaagacttgactccacacctctcaccaaggccacctttcaagaatatctccacccagcagccctttgatgacagagaagagtgcagaggatgatctcatactcccgagagaagtgttggttaccaaaaagctcctggagaggcaacatcccagagggcctttttttttttttttttttgagatggagtctcgctctgtcgcccaggctggagtgtagtggcacgatcttggctcactgcaagctctgcctcccaggttcacgccattctcctgcctcagcctcccgagtagctgggactacaggcacccgccaccacgcccggctaattttttgtatttttagtaaagacggggtttcaccgtgttagccaggatggtctcgatctcctgacctcgtgatctgcccacctcagcctcccacagtgctgggattacaggcgtgagccaccacgcccagctccagagggccttttaataatgaaggtagataaaaactgccagaccaccgaactatcgagccaagtcagaaatacaataccaggcatagcttggggtgccaagtagaacagaggagattctgaggcttcacaaaaagcagaaagactgcatgactacgtgaacagtatgttgaatgtacacagaagtgggaagcaaaggacatataaaaaggatggagaagcatgctggcagactcgccagagggaaggcagcaggtgcagtctacatccagtgaaagagctttgctggcttgttcctcggcaggattccctatcttactttctcagactggatggatgtgtggcattcagcagcagaacagaggaagacgatatttataaatgaagaactggcgaatggatactgagaagaaatagactgggtgtaccattctgtaacgccctgtttatagaccaaaagcaggtttgtgttgacagaacatatttggggttgttatgcaacagcagtagtactttgggagaaggggaatgatggggtggaggtagggctggtggacaggaggactgtcaagttccagtacttaaatactagactgcaaggaatagtttgctgtctgtcctttagtgaagaaatcagatgctcattttctgttctacatccaccttctccaaaaccttagcaaagtctgtgataaagatatggcactgtccccatgctgatcagcctcctgaatggtcctgtctgcgatactgcccagctgcttatctgagatatttatttggaccatcatgcacagcacccttaacagctcatcacgagagatcttgttatctttatccaaatcatatagtcgaaaagcaaactgcagtttgttgcttcggctgttgagtggttcaggtccattcacaactttgctcttttcattatcctcaatggtttggaaatgagccagagtttgcaggaatccacggaagtttacctggtcctctccctctggaaggaaggcattgatgatccagtcccccactgggttgatggcaagttctggaatcccctggaaatcgtcctgttctctcctttgtccaggttgctgaaccggctgtacagacgtgtgatttgactgtgggaaaagccagtctccttcttgatctcctcaaactcttcatcgtgcagtaaggtggaggcctgagaccccatcactgtgccaggagctcctccaggaacagaagcaacggcaacaagagggaaggcaagaatttaaccttgcccaaaaagagggctggccttgctccttggctaatgacaggatacggagcaggggctggccatgcagtacctgagtgatcaatggaccaatcctgcccatgtcagagccccgggaaaaactctggacaccaaggcttggggaagcacctccggctgatgatactccatgtgcactgccacacgtgggtgctgggaacacaacacatctgattccacgggagagctggtgggaactctgcattcaattccctcctggactctgccctgtgtgcatcttggttgattttaacctgtatctttttgctgcagtaaatcataactataagtgtaactgcttccagggagctctgtgagttatggtgaaagggtaaatctgaagttggcttgggaaccccttcagtgtgctgttgctgtcagaagtgaggaacccttgtgtggactccttgcatgaactctgctgctcccaacctttgtcactggctgaaaatctttgtggctggtgctgctgggtgccaggaatgcagaggcgagagtgcagggtaggagacggacatgtccacacacagatggggcccagagacaggcggtgcggctccgctccgggagggccccacattctcgcttgggagtagctgaagcaggggctgctgaatggactgttccacagggctgatgtggggaagcaaaccgcccagcagctccacgtcctgatgagagacagctctgccctcccgaaggaatggcaagcctcaggaagagatagaaacttcatttcttcatgaaagatgaaaagatgtcttaaaactaaagctacttcctggggctggtgaatgaagaaagtgaaaaggtctgaaagggattttatttaccaagaatgactaaatgcgcatgcacaagcactctgaaagctggggatcctcaaaggtctgctagacataccacttgtgaacgtggaggtcttatgtgtaaccagacaagtggccagtgctgcgcgatggagcgtgaagactcctgcagacacaccagcagtatcacctgctatgagaaggtgggccttcccaggaggggcactggaggtaggtttggaatcctgcagacacaccagcggtgtcaccctgctatgagaaggtgggccttcccaggaggggcactggaggtaggtttggaatcctgcagacacaccagcggtgtcaccctgctatgagaaggtgggccttcccaggaggggcactggaggtaggtttggaatcctgcagacacaccagcggtgtcaccctgctatgagaaggtgggccttcccaggaggggcactagaagtaggtttggaaggatgaggaaggtgggccaaggcattccagcaccaagagcagcatatgtaaacccaccaggttacagggtgactttgggaactagtgaataacctgatggctgaggcatgtgtaggagcagcagcttgcaaggctaccctggtacatgggagcctctcagacatcttcaagctgtgtcagagagagcctagactttccttctctgcatgatagggcccctgaaggcttctgaaacaatccttccttccttcctttaatcaagatttaccgagcactgggaaagaggacagcaagagaaggcacaacctgtgacatgcaacatctgattctgaatgactgaaggattcaccgaagtgtgaggaaggcagagaacagagaaacacagagtgctagctccgtgctgtggagttatgcaagtgaatgaggctgatcaactttcccatcatcaactcacccagaaagcagaacattcactttcccagttctattcaggggccacaggtgctatgagcagatgcaccagggcgctgtctacaatctgtgaccaggagcagcgatgctgacccagcttccctccatcaggtgctgccgtcgtggagatgcactcagcaccagggcacggagcacctgctccttctcggcgatgcgctcagcaccagggcacagagcacctgctccttctcggcgatgcgctcagcaccagggcacggagcacctgctccttctcggcgatgcgctcagcaccagggcacggagcacctgctccttctcggcgatgcgctcagcaccagggcacggagcacctgctccttctcggcgatgcgctcagcaccagggcacggagcacctgctccttctcggcgatgtgctcagcaccagggcacggagcacctgctccttctcggcgatgtgctcagcaccagggcacggagcacccgctccttctcagccgcaccagggcacagagcacccgctccttctcagcgatgcgctcagcaccagggcacagagcacccgctccttctcagcgatgcgctcagcaccagggcacagagcacccgctccttctcggcgatgcgctcagcaccagggcacggagcacctgctccttctcggcgatgagctcagcaccagggcacggagcacctgctccttctcggcaatgtgctcagcaccagggcacagagcacctgctccttctcagctatcactactctcccctcccagaggacatgatcggcagctctttgacatcagagcaggctggggttttctttaaacacacttcatttttttttaaagagttattacatccacacacggttcaaaaatcaaattatgaaaggtatatagttaagactagctgttcaaaacaaaagcagcctttcacgattatgtgagggaacaaagggcaacacccttattagtgccagtttaaaaccttccttcacaccctggactctgccctatgtgcgtcctggttgattttaacctacatcctaacatttaggccagtttcctttcatccttcttacaaatataaaatctcttacccttctctaatattatttggcattccaaaataaggaagtgtcatggttaaaaccaaatcaaaggcaattctgactgtgcacagctcagcctccacccaacctcagaaccactggatcagaccaggttttagtttttttgtacatttacttgataactaagacacaatttgcctacagtgaaatgcttagttctgacacgtatcgctcaatccactgtcaagaaattcataacaaagtaaagaattagaccaaggtttttgttttaaaagtggtccgagatttcaactgaagggagttagttgaaaattttaatccccttccttggaggaagttaaatgtggaactttgtgggaagccacggattaccttgaaggtagtacttggtcttgtcagaggttccaactttccgactgaagtgctgatcgttgggcttcacctggcatatgttggctccagagcacgccgggtttctggagcttgtgatggaggaaagttggatctcatacaggtagttgtccccattggtcctcatgtccccagaggctctgaacagcctgaagagacagaaaagatcacagtgacatggaagtccttcaagaaggcattcatgacataaaccctcagtcctcagaatcactgcagggccccaggatgcttcctttcctagggaaaggaagcacggacacgctagggcagcacgtctgtgaccccacagcaattctgaggacaccagtttccctctcaagaggctttctccccaaccagttctggcctctgagtgctaatccaccttcctcaggtgccgtatccagcaccacacggccctcgccctgtctgtgcacctcggccaccacccccaagagcagccccagtaacactgctgagaaacttattttctaaacactggtaagcccagaagattcctgctcaaacatgtcagaaggcttcggcttcaacccctgagattatcatgaagagagggagaaggacgggggatttatttttacactcatgagaattcaccatctttggtgttaaaacttaatgattgagtaacgcttttcctcagtttaagcaaaagatgacgatgactccagcaacagtaactaaaacacagacctatttatcctgcagtgctccccgatagggaaagagcggcattgctggtttaattttgaacacatttcacagctcagaaggaaaacgttttacttacttaaaataaatatctccgaggctgaagctcttgccatttatagggttggtgatggtcccattcaccatctgcacctcctgaggcttcacggcgcaggcagcccgggagtcccagctgaagtagtaagtgcagctgtcgatatcaaacctaggaggagggaagcacaggctacagtcacttccccagccagacataagggaagactgcaaaacaatgaacactgcggagcccttgaagcagctcactggctttcagtcaaggtgctgcgagacttcagttgggtcccgaggcccccactccccgggctgcgcaggcctaggcagaatttcccgactcaacactgacggcagctcggagcgagggtggttattttactcacttcttttcatcaccacaatggacagggaagatgactgtggtgcacacatcagtaatgtgacaaagcaggcaagcattcaatataaattttttaaaatttgtaaaccgtgcaacattcaaaacctggaaaatttgctcctagatttttagatttttgtttaagcttctcagactcatacattcataaatcctttggcaatttctgagtcaccccttttccaaactcagcgtctggaaggaatcagttctgttcacaaacagcagctcacatgcaccctctgttggccaagctctccctggcaccagatgcaatgtggccgggaaaacttgaatataatccaagcacatcccaggtccagatgcaggtcccagctgctcgagggtcccagccaggctgcttgaacacctcgggtgggacaaatccacgcccctttgtttctactatgacattcaaaggtagaggtcagttaagtactgctcagccagtgctaaacctagttcaagagacaagctagcccagagaagttgcactggtcttgtaacagtgtctcagcactgtatctggaggtcttccctgcctggagcagccccgcccaatacagcacaatcagcggctctggccctgagctcctaagactcagccaaaacctgcccatgaaaaccccaaggaggaattccctccagtatgctcactgcacagtcccgctctgagcccccagtctcctgacctcttgaatgcaggtctgcccaccgtctttgtacaggtcaattctatcacggaggatgcggtcttatttccaccacacggataacctttggagtacgtgacaacaactttgtcacctgaaacacacaaatgattgaactgacattatttctagtgcattataaaaagcctcaggcaggcgcagtggctcacacctgtcaattccaacactttgggaaaccaaagagggcagatcacttgaggtcaggagttagagaccagcctgaccaacatggtgaaaccccgtctctactaaaaatacaaaaattattcgggcacggtggcaggtgcctgtaatcccagctactcaggaggctgaggcaggagaattgcttgaacccgggaggcagaagttgcagtgagccaagatcgagatggcgccattgcactccagcctgggcaacaagagcaaaactccatctcaaaaacaaaaacaaaaaacaaacaaacaaagcttcaatgttaggagtaaaaatctggtttaaaggccagaagaaaataaattttgggctccctaaaggtttatcgacctgttcttgcattcccacactcaggggtggtcacctggcccactgcacaattgtcacagcctaagacctggggtcaaacccaaaccctcctactcccgtactttgtggccctgggttgctgagcttctgagccttgagggccttacctgcagaacagggcactgtccaaagtgggcaggtttcgggcatgtatagaaagtgcccaacaaactcatgtgaacagtgggaccccgggtaatggcagccttcattatcgctccaattgtgtaaactctctctatcatattaggtgctttcctgacaggtaccctcatgtgagcctcccagtaataacagagcacagaatggaaaaagtgaaaagccagaaacagaaaccaactgtggttttctagggtcttctagctttcagtcgagcactgtctgcttttaaaagtgacccattaaaagaaaaacctgagccctcgaacccgcagggtctgagagaaaagtgagtacatgctttaagctgcaggtatcactggggcagcatggccgccaggttccaactctcaagccaccaccaagaggctgcttgtggctgcgcagggggctgttctgggaacggtctgggcccagcctggctgcatggacagatgatgtctccagggcatggcgcagggtgtccaggggaagcaggtgccttccaccctgaccacacacacacagatccttccaggcaggggcatgcggtggaggcaacatgggcacagtgctcacttcccgagtgttttccacaggacacaggctgaggtactgagggctgctggatggtgaggtgggaggtgggactctaggctctcaggcctgccccaaactcaaagctgctccagctgaatttgttttaaatattgggcttctgtgtaaaattttggaaaaaagaattccactgttttacggaaaatttttaaaacttctggcatatgggatcaaacaagaaaaaactttaatagtgtagacagcccttactgattgggcaggaggctcaacctcctcggctcaggggcccagcctgtgaaacggatgacaacgctgccccatggagtggatggggattaaacatatattaagcacagctgcttgagacatgttggttctgaaaacaaaaagtctacctcccaccccaacaggggtccattccctaagcggacaatgggggcaccgtggttgtccttagatgctgtcttgttggcgccaaagattaagagctcatttggtgtcagacaccagattatttctcgttccggtcagcaggtgctcaggatgccaaatgccagtcccaggagaaagcatgagctcttcccgccaggcgaggctggacttgcaaaatggtgctctccaaatggaggtggcctgcaggtcaccgctaagaagtcagatgatctagttccatgtcaccccctgtgttcactactctcttttgctcctcctgcctcaaacttttaggaagccttaagtgttttagtcatttcagttggctgaagttggggaaagactagtcgaatatccatatatactgcaagattacaggggaaaaagcaaccctccacgaccttccctccttcccccttctggggcagtgtgggagtggcagcaataactgacctctaaagcagtaagaacctcccagggagggcgggtctcaggctggcggtctgggcgccacttcctgtatggcagctctccctccacctaccaacctgcagagtctgtgtgtgatttttatcaagggtggcagtagttttctcggaattctctttctccatctcaacatctcaagctaatctgaagtagccctgtggctgaatcaggacaactcgggaaaccccactccagcctaagaggcaaaggtgaatattttcctttactggtccctccaacaaatcctaattgctcttactaagaaacctctattttcctcctttaaataatgaaagaaaacaactttcactcagcaaccaagtacaagatcaatttcccgtgaaaaattgttaagacattttacaaagatgtacctctgaactacctgtaccaagtcctcatgcaactgtttggctttcctaaacaaacacgtgtgtttatgccaatttaggcacttgatctacagctagaacgtgaacttcagaggaactctgaacattctgagacttcctcctggatagacgcacttccccgagatagcccaacccctctaaacacacagactaggacctgcagtctcatataatacaaagcagcacttattttaatgtgccaggagagccaaaatgcctgtgagacagtgacaggcaatcatatctggaggtttccaccaaagcacatgctcactctccttgccatcctgagaacaccctcaccttcccggttcagatgctgctccttgaaccaaggaccaggacccacaggccttacctatgacacccagcttctgcgtgtgaacgagtcccaggacctggacgtcaccagttgtggtccttctgcaaatgctggccctttcagagcagcccaggggccctttatatattttctggcacagatttatatagtacctagaaaacgacacaaaggggcaggtaaaaggcatgcaagtgacgtctctgccctgacacaggagggctcttcactttactttcagagaaaggttctgataactaagggctccattccatcactgaatgtagcactaaaatagcttttccaattaaaaaaaaaaagggcaaaagaagtcttcactgaagaagggagctcaccaaccagacacacgcggagtggaatgtccacacctgcggccaccctggacacagcgtggtacagtagaaagaagggctccggggctgggagaggcagtggctagaatctcggcaagtttcccacctcacttagaaccacttaaaccctgtgagtccatgcccctgctcctcggtgatgtcttgcaggagcacctggccaagcgggcgctccccacgcagagtggtcaggaccatgggctgaccccagccagcaaagcctaaggagctcctgccaaagacccgagaaaacccacacgcctcccacaacctgagctacacacaaacgcaaatcaaacccagcctaactcagtccgcccaggttcttccagctccagaggctccgtttccagtcaccaaagctcctgcccccactctgacctcagaaccaccctctgtgccaggattgacactgcgggctgcttccaggaacagtcacaactcaaccaccatcagcctcacatgggcatagtattcccatcttgagaacccaaaagagccaaccatcgtcaagcagtctgaagttcacatgctgagggtgtggcgccgcgggtggactgggaaggcactcacgagactccgttgtggacgagggaccaggacccggtgagagaggagagcagccgcaggtcgtaggttttgtgtttctggacgaatttgcactccaacttctttggagggcagacaacttttgttttccactcaaatgtcacatcacacccacgcacttcactgaagacttgtggcctcccaatgtcctcatcttcatcacacttaaatatgatgctggatgtccggtagctgtttgctggggagtgtagggaaaagagagagagatcagactgtcactgtgtctatgcagaaagggaagacataagagactccattttgaaaaagccctgtactttaaacaattgctttgctgagatgttgttaatttgtagctttgccccagccactctgccccagccactttgacccaacttggagctcacaaaaatatgtgttgtataaaattaaggtttaagggatctagggctgtgaaggacgtgccttgttaacaaaatgtttataagcagtatactcggtaaaagtcattgccattctctagtctcaataaaccaggggcacaatgcactgcggaaggccgcagggacctctgccctggaaagctcggtattgtccaaggtttctccccatgtgatagtctgaaatatggcctcgtgggatgagaaagacctgactgtcccccagcctgacacccgtaaagggtctgtgctgaggtggattagtaaaagaggaaagcctcttgcaggtgagatggaggaaggccactttctcctgcttgcccctgggaactgaatgtctcggtataaaacccgattgtacatttgttcaactctgagataggagaaaagctgccctgtggcgggaggcgagacacgtttgcagtaatgctgccttgttattctttactccgctgagatgtttgggtggggagaaacataaatttggcctatgtgcatgtccaggcatagtaccatcccttaaacttaattatgatatagattcttttgctcacatgttttttgttgaccttctccttatcatcaccctgctctcctactacattccttttttgctaaaataatgaaaataataatcaataaaaactgagggaactcagaggccgatgccggtgcaggtccttggtgtgctgagtgccggtcccctgggcccactgttgtttctctatactttgtctctgtgtcttatttcttttctcagtctctcatcccacccgactagaaatacccacaagtgtggaggggcaggccaccccttcaggggagcagaggcgggagaatgtcagaccaaggcctgcaccagggcacgttcctgcacgccttccccatgctgcctcaggagcacctgcagactccatccgccatctggcaacacaccacgtgctgccctggccacatctcatgttgattcactcatgtgtatcctgactccaaatagacccagctccttggcacacagcctttcatcgtacttcttaataaccccacagccctaggtgattcctcacacgggtattcaatatttgaccaatctactaatgatcacgaaaaaaaataagatagctgggcgcggtggctcacgcctgtaatcccagcactctgggaggccgaggtgggcggatcatgaggtcagcagttggagaccagcctgaccaacatggtgaaatcccatctctaccaaaaatacaaaaaaattagctgggtgaggtggcgggcccctgtaatcccagctacttgggaggctgaggcaggagtatcacttgaaaccagaaggtggagcttgcagtgagccaagactgcaccactgcactctagcctgggcaacaagagcaaaactccatctcaaaaaaaaaaaaaatttaagataataatgtaatacctacaagtacttgaaaacaggagtgtgattcagaaaatagggaataacgttttgtcaaaataagcctcaaaacaaagctatagcaatccttcgtaaatttaacacgtttggttccttaatacatcccattttggtccctggactattgcgggaagtcagggaccatgaacggagggacctgctgaagccgtgacagaagaatatacattgtgaagatttcatggacatttatcacttccccaatcaatattataatttcctatgcctgtctttactttaatctcttaatcccatcatcttcgtaagctgaggatgtatgtcgcctcaggaccctgtgatgattgcattaactgcacaaattgttcgtaaagcatgtgtgtttgaacaatatgaaatctgggcaccttaagaacaggataacagtgattttcaaggaacaagtgagataaccttaaagtctggctgactgtgggccggtgaggacagagccatatttctcttattaccgaaaacgggtaagagaaatatcgctgaattctttccccagtaaggaattttaataattaacagccctgggaaaagaatgcattcccgggaggaaggcaggggcgcctcttaaatggccactctaggggtgtctgccttatgcagttgcagataagggatgaaacacgccctggcctcctgcagcgcccccaggcttgctaggatttggaaattccagcctggcgaattctagttaaaccggttctctgctcttgaaccctcacaatgtgtgcacagtgggacatggaagttatttagtgattctagtttcgcgctgaccttgtgatcctgccctgaccttctgccttgtgacctcttgtcatccttgaagcatgtgatctccatgacccacaccctattcgtacactccctcccctttgaaaattgctaataaaaacttgctggttttgcggctcgggggcatcacagaacctgccaacatgtaatgtctcccccggacaccagctttaaaatttctctcttttgtactctttccccttatttctcagaccggccaacacttagggaaatagaaaagaacctacgttgaaaaatcgggggctggttcccccgatactggacatttatgaaaattagtaatttttcttttttttttttttgagaccgagtctcactctgtcacccaggctggagtgaagtggcatgatctcggctcactgcaagctccgcctcccgggtacacaccatcctcctgcctcagcctccccagtagctgggactacaggcgcccgccaccacgcccagctaatttttttttttttttgtatttttagtagagacggggtttcaccatgctagccaggatggtctcaatctcctgacctcgtgatccacccgcctcagcctcccaaagtgctgggattacaggcgtgagccaccgcgcctggccaaaaattagtaatttttcatgcatttccctcatctcacggtccgtagacacaagtcacagcagttggctcctctcatgaaacttcctgagcaccgcaggggcaaggcactgagtgtggctcaccaagaaacctccatccccacctgggctgccacatggcggaaagtcaataaatgagtcgcctggtttaccggaatcctcactagcttcagaatcctgaagacccatagcagacattcattttcctgaggcataatctgaaccaccagggctaaaacctggtatgtggacacaaggccctccagctagtgagtgggcctagccagccacccagcacagcatctcacggcagctctaccacggtctgtagatacggttacccagcaatcccacagagcaattcaaacgtttctctgtgggaaacagcccgagtaagaaaatattttatgcaagagaattcctgccactgactggggcatccacaaaggtctcagtgtgaatcgagccttgacagtatcaaggccccaggccatgtggggacgcggagccgtcctactcacagtgtctgcagaagccccactcgtggtctctgtcgtagtccgcagttgtgctacaccacagcttcgccctgctctctatgatgcactcctcgtagctcttcccattgaatatgaaggggaagacacaggggacgccgtcatcggtttctggaaagaagaagaacattatcagtgtggcagctgtgcctcgccaggcacaatcacctcagaatgcagcagcagtccctaaggaagctgcccatcctaaagcacctacgtgacaaccggcattcacctgccaaaactcaccaggcaactgagagaacacagcgtgattcacacaccagcattcacaccgggggtgtacagaggaacagctcacattcacgcccaaggttacagcactcataggaccgtggagctccactccgcagcttctttctgctgctatgtctaatttctagtttactatgagcttgaagtttatttacctcattgcaaatatttacctggagggcaacgatcaccattcacgtaacttaaaacgaccgcttcatcctggtgcctgtaatccagtttcattgattgcagccgtccaaaggatgcccccttggtgcctgagagcagacagactcctccgtccttacagcctccttgttctggcccgactgcaaaggtgcacaccccaacgctgtaggtgcgcgagtcgcgagtcacctggacaaaaaccatgcgtggccgtcagcagagtggcagcacccaggtctcaaagtgaagagagaaccactattgcagctgatgctggaggcaggttcatgaggaagagcaaagactcctctgtgtgcatcagagccacgcaatcgccttggccctaggctttccctggggggcctcccccaacccctaggcccagcttgcttgctcctcctgctccctgctgggggcctcggccacccctgccagccagccactgctctggctgtcgtctccagtcagagcccagtgagaagggacccagcagtggggtcaccccacctccctcacctgtgtaataagacattgtgcgggccaagtgagtgaatgagcagagccgacgctgcacgctgaagcatggacctgactctcctggcccacccagcgcccagaaggctcacacctactgcacacctgtcgggaggacctgtacccaggcagagggctccatcacaggagccagggtgttgacacctgggcccaaaactccaggctcatcactcaccagccgccgtgccacagcaggtgctggggttccgtaccccagtccaggcactggcatggtaacatctagatatctaggcttagggagtcaggggcccccaggcaccagtgaccacgacaccacatcagtaagaccagcagcccaaagaatcagcacacgccagggctctggcatggcatggaggcacatgcccaagtgcctctcaattccagggcacctcctacctccctcttcccaaagctgccacaatcagcaaacaactgccttgatcatcttcaaccaggttggaggaattaaatccctgtagatttcagccacccaggagctggccctgtccccatggataccttacattcatgtctccgggctgccccacctgccctctgtctgatacaaagggtcccactacccgcctcatgaggttacttatcatcaaaaagcgttaagtgcagagccatgaggtacaacgcaagtgtcagctgcgctgagttggccacgcaatccaagaaccttcctgagacctggcatgccctacgagagcaccaagatgctgcccagtggccacatacaccctctcagctcacaggtaccacattatccaaaacactcccagcagcctcacagcacctggcacctggtacacctgcaccagcaacgcccagggtgaacgcattaccttaaaggtgctcgtggaaaggctggacaagttgaagctgtagaggagctgctcatctgtcagggtacagccatccatcctcacttcatcaggacagacgacaggagtctcccattcgaacacaaagtcgcactcgctggtccttaacagcttaggcgttccctgttgccaggaagagcacgggtcttaaaaaccccatggcatagggatagatagcagtgacacaccacgtccctacaggggctgtgcataacccacagcggcctctcagagggaagggatgctagacaacagcagctgaaagacccaatgccatcttcaaggcacagacatcaccctgcccttgccccctacacatcctgtgagctccctggctgaatccaggtcttgtcttctacttagagagaaagcctcaatgttctgtgctacgggttcaaaggaagaaagggggagggcttatatgtcatgagagaggtctgtgaaactgagaccctgcctcacaagtgctccaatctactgtctctagacacgggagacatttattcaaggggcaagatgccacatggccagatattccataggccaagtattgtagaatcactttatttattccctccctcattcaacagcaacaaaaaaagatgaggcagctctcaggaattccatttgtaattaatgttaagcatctttttccctatgattcagtggtaaaagtacttccattgaaaatgaaaactgctggggaagaaaaatcttctaaaaatctttctggaacgctagaacacacattcagcataagatgcttcatttctaaaatcaagtaaacactaatcaccctcaatgtgcagctgctgagaattaactaaaatcacattagctaattcgatttgtcacgttggcagcagagtcaaagcaaggcatagttccacactctttagctggtggtgtagataacaaagcatcactcatgatgaggtgggtcttagaagtgaagactgtcctttaaagaacgaagaacttaatgcagaagccccccgcaaggcaaaatccacgttgccccatgctgtgtgcatctacagaggcacacccagacacccctataaaaatatgccaatacgcttataaacagatgcaatgggtggactgaatacagctctgcctttccttactaactaggactgtcactacactctaagattcatgaacacatccaagggctttgaggtgctctgggcccctgtggagtagccccaaacagcaggactgtttcctcctccttctcaaatactgtctctctcactggtcaggcggctgccaggtcactttctgtcactgtcagcacacccatgtctaacagtccctttacaaacctgctccaggcccaaacatcagaaggatgtctttatcagaattacaagacacccaacagatcctaatccatcacctgaactcctaggggtcagatgagccttggaatccaacatctttattaggattttaagaggcaattctcacacccccagatcctgtgatcaaacatattaatatttctgcagctagatgtatcaatatccacattaggtgggacaaatccacaccataaatagcctcagtccattcatgtcaaaggagccccaagttttcagagcttcagagatttcagaagcacagacgacaggctgtggtgctgtgtccctggagcaaagagctgttcccctgtgcagtagctgggacctggctctgcccctgcagagctactctgagtccctgtggaataggggccataatctaccaatttatctcacagagcagggatcaaaagaaaacgtcctcaaagactataaccaataccgaactcattataatggaagctggtattctttttttaatgcacataaaatggaagtcaatacctcattataagtaaaaggtgccactttgttgtagctattctgattccaggggtcttttgttacttgttaacttctgggctatgtcctgagtgactatagctgcccaaatgtctttctgacttcccagttagaataaaatcagtaattgttaaagtaaaaacaaaagttatgacacttttatgcatcagcagtcaaagctgaatgtcatttctatacttgtgttctatgtttttaaattacagcaagtttctatatgctgttaactgcgggggagctcactcagccctcaatcagtggtttaaattattcagacacactactagcgtaccatcttacccaaggcagacattttgaataagagtatccttggacctgacacgcactttctggttgtctagccttggctcactaacccgcagttgagcatctagatcgtcacaggcccacacttaccatgctcacacctctcttacagtgaaacgcgatgagcgaggtgtagttgaaatgcttgtccgctaagcaaggagtactgctttcaaaattcaagtaaatctcatttgctattggattgagtattggtggtcctgctacccggccgatatcctaaacaaagagcgagggcaaacagtatttcaggaaattaaccattcccaaggttagtggaattaagaattgatacagaattgcaaaaaccagacctcataggttctgagaatgagcagcatctaaagaaactgggtttataccaactccagttggaaggcttgacagatgctgtgtaacctccgtatgtcagtggttatcgttttgatcctaacgttagttctaaggttggttctatttctaggtatcttcaattttcaaagatcctaagcaataggaatctctccagtcacatcaaggagactacagagtcctcccatcagctgatgagggaagcccggaacctgaaaaacctctaaggatgctacacggtcctcccaccacctgacaggggaaggccggaacctccatgctgacctgccaccctcactgcccagtgctgccccgggactgcccactgacgtggcccagcagtaaccactggctatgtccttgggagaggggacaggaggtgttcactgttcattttcattgcttagcacagcacctggcacacagcggctgcccaagagatatttttgagtgaataaacaaataaataaaagaccagtctgagtattatgagaaaaaaaacaaaaaactctttttttatttttaaaaagtaaataaaggtgaatggccaggaactgtgtatgtgatgaatgtgtgtgtgcatgcacgtgtgtgtgcatgtgggtgtgagtgtgtgtataagcagcttccccatgattttgttctcagctacagtgctcttcattcaccactgtggggcacgttcagaccacgtggcaccacaccttctccagttaaataactttctacatcttttaacatttgacaatgggtggccaggcaatgattcccgatcgaggatccccggtctgcgctgtcagaaaggacgctaccaaagagcttcctggggagactcagcttgtccaggcctccatctcacacagagctggagctgtgctaattcaggctgtggccgatctccttacacactcctgacatctccccatatcactgccacatataatggccatctttctaaaggacatctagatatgttacaagaggatccatctttaaagcataatagatgatacagacagaaatacagacgacttgtgagatacattcaaatattaaaacataccaaggatttgacaaaatatgaatataactcatggagacaatttttaaagatccaaatttctattaaaacatgctagtaagccaggcactgtggctcatgcctgtaatcccagaacttcaggaggatcacttaaggccaggagcctgaggccagcctggctgggtgacatagcaatactcccatctctacaaaataattttttaatgcataaaaccaaagcttttaaggcaaaatatttagctattagcaaacgtactcttgcccttaattataactccttgccaaagaaactgtttgcatttcgcaagcgttttaactacagaagacaaggcatttcacacaaagaaaccaggctagggcaatgtgctttcctgtcacttcacctaaaaacttcttgatttgggtcaaccctgaggctcatgacaagtagagtccctacacacatattcgtgttacctcccatgctcaaagactggctggctaccatcatcagcgaacagttcaatgtgcaaacctttaatcttccagtagcggacccagaacatacacagtcccacttactttctccattttttttatgcttgagcaactccccactgaaggcaagaaacaacgcaaaggttatcactaaaagtcttgcaaaaattatctccacccttggatttgtcatacttactatggggggaccatcaataggaactttgcacacagcggctccggcaggacagggcactccgtgcatgggatttagtggctgacaaatattgatgtagaaatcagggttggtatcggaggcatcatcctcactctcatcataagcctcataaccaccagtgcgatgaataaggggagacaagtcaacaatagagcttccattcctcacggaacattcggtctgttaagtaggaaagactgctttgagtctacaaaaaaattttcctaatcaccactaggtcatccataagaatttaaaagctgaataacaacaacaaaaaaagtagaaaggtgtcaaaatgcttcattacatagcactgggcacttccagtcaactttattattggggtgatcaggagtggacagttcagctgggcatctactagtgggcaagtgaacctgacgaaggggcccgggtgcagccaggcactggacatgcacttctcccgtgcccatctgaaaactcaccgcttgctcgcaggccagcggcgtgtgccaggagaagaagagagtgcatgtctgcttgtccagggagatgagcatgggcctattggttggcctggcctcaggcctgcacacgaaactgatcacactcttatagctcaggccggatttggagggacaaggggacccatccttgtacaccagctgcaggacctggtccacgtatctcagcctcttgttggccttgcccacgctaatcctggtctgtccaaagcaggcccctgcaccacaagggaaaggcggagaaaacacaatcacagactcgatggccaattttctgatgagaactttcgcaagtcaggaccatcaatttcatagccaacacttataacttcaagtgtccaatccggctttaaccattgttttacattgaatgttcattccatcacatgaccatgtgtcccccacatggggtgactgctgcaggagacaaaagcgtctcagcttcctggctctgctcatcctttttgccattagcatgcaaagagactgaggacaaccccagaggacgggagagtcagacaacacacgagagaccacagcactcacccacgccaggagggcagttttcattctccccacagatgctcatgtaaaccaaccccttctcgctgtaagcagctgtgaatcccgccctgccacttaaggagctcagatcaaacaggtgtcctgtagggtggaagaagatggggacacagtgactccagggagctgagacttgggaggctcatcatcggcgagctcacacacagattatgtcagcatcgggacttctgacttctcaccacgacccctgtcctaaatcctccaccaacagccaggctgtatcatgagactgtcagtcccttgatccatgagatgtcccatccttagctgaaaagatcgtggctcacagcaccctctgctgggccataccacagcagccactaagagtctggtgggcatggggagagcctgcccagcacacctcttgctgccaatggactgtgcctgtgcctttctgggtgcccagcacaagggcaggtgagagactcctggcaatccactacactgatgctgaaaggcagccaggggctagctctaacctgccctggagagcctagagctgctggactgacactgtcagtaaccccagtcaggagcacctctcacaccaggagagtgacaggagggatggattctctgtgggagcattctctcctccactgaaggagagccaggagaacacacagcagcccatccagagaaaggccaaacacacccacacaccatgacacctctgcccagggcgcctgctgcccatagcttctctttgggtctctcccctgatgagctgggtttggtgggggcaccgtctctcacctgcgctggggttaacgactggcaccacctctcacctgtgcttgggttggtgacctggcagtcatcatgctcgttgctcttcatgggacaggctgtggctgtgggccaggcaaaggtgtactcacagtcctccacggcgctgatgaacatgggcctggagttctacaacaaagcacagacaggtcctgaagggatcacgcaaaaactccatgtctatcatgatttcaacttacaagtggaagcttctctgaaaaactccacagcatgtgacatttctgtctccatgtgcctgtgggatgaggcgcagattaggaaaagcaaagggtcagaatgtgtcctgagctgccaccatgggcttcccctgcaggtaagtgaaacacccacaggcagcaacacacttaggggaccaggaagctccctcaggctgaggaacaggacaggggttggggacaggcgtgcaaaggatgctggaagggctacagggagacacaaatgtgtaaatcattgataaaattctaaaaaccaaatgaggtaaaatccattatcacagtcaaaacaaaaagatataccaagagaactagcccattccacgcatcctcccactggcaccagccaaggcttactctgctcatctcaaaacgcttcatgtccactgcagagttagcatgatgagttcagcagcaccttccttcccaggtaaaccccatgattcctgctgggcaccctgataagccacgctgcagtccagcctcccaggccctgggcacaggggcctcgacacacccccacccttccctcccagcctcctgggccctgggcacaggggcctcgacacacccccacccttccctcccagcctcctgggtctggggcacagggcctccacacacccttcacctttccctcccagcctcctgggtctggggcacagaggcccccacacaccaccctcatccttccctcccagcctcctgggctctggacatggggaaccccacacaccccttcacccttccctcccagccttctgggccctgggcacaggggccccacacaccctctcacctttgccccccacatgtggggcagcccttttgtcctcggccatgagcctctcaggtcacagaggagaatgctcagaggccccagcagctcatgagtctggactaagcctctgcacaatcttcccaagaggaaacttccctgccgctccaggcaagagggcaggcctgaagctcctggagccccccatcccaagctcccctaccactgctgcccaccgctggagagcatggggcgagccaccctgacacccagcgagctggtcttgcccgagttaatgcccaactcagccaccgagcttgtcatgcacgctagcactggggctcaccacaatctcacacacagaaaaacctgtatgcagtcgacacctgcttacgtgcatgccaaacaagtaagggaagaactgatcacaggcactcatgctcactgactgtgcatctcccgtgtgtcagaaatgacacctggcacttcctacctcttctctcgaaaccctgcaatgggcaggacaagtatgcctcatgttatgaacggctgagcagggcagactacctgagtaattaaccaagttatgtggctgggaagtggcagcgctacctgtgacccgggcccagccaaccttctcgtgcttcccaagctgccgccgtgaagacaaaagggcatgtagtcaaacaacaatctcctccacagcctttaggggtctgagtcaaactctgaagagaaccaattctgagtcgggaactgccaggcaagcttctaaggagccagacagcacgagggttccccagattgcaggccgcggcgacgctgttcccccaacctctggtaagggcgcatcatcccaggctctagaactcgcatcccaaggcagatgaggacgtgcggctcaccgccctgcacatgggctcaattcccaaagctgcaacagcagaaggtgcaggaacagtcccttaccacttggctctcgctgcaggtgaatcggatggtggttgactttttccgaatcccatctggacataagtcgccatcaacgtatttcaggacaattatgccatctctccactgaggtccgtcccttaccctgccgaggttcacgggcttggagccacccagcagacacgcggctgcttctggagggcacggctctgcagcaccagacacaagaaagagttgcctttagtgactccccaggctagaacagaacttcatcaggcaataaatgtcacacacgctgcagaacttcatacgctttctaagagtcacttcaaaatacctgctatttctttcacataagtcagatgacaatgacatcacgttagttctcactcacttacatgctgttttgtcacagatggactggggcaggcgggcgtgagtgtagaggaatagctaggctgtagcagtcgaaattctttctgaaccccatataggatgaaggttatattcccaaattaagacagaggaacattttaaatggcctacgtccatgcaccttctttattcaagaagctaccaagaattctgcctgtttcccagtccctaaaatgcctgtgccatgtgccctgggtgaagaactagtcccatgccacaggggtacagccactgtcgaagtctgcacagcacaacgcagcaaggggaagtggaaccacagcctcaaaccacacagaggatggaaccaccttctgcagctaaaaataaccacaccgcctttgaggtgagccacccaagatgcaggtggggctgtatgaaactccacgaacatgggatgagtttcatcttcagggttccgaggggccatgagtggtaccaagatccctggaggtgcccttggtttcccatgtacagctgacatccagtctcagccaaccaccgcaggtttgagtgagctgtccctgcatcacaaaaggaccgaccatacaactctcaacatacgcaggcacacaccaagacctccacgtcacaccccccatcttctacctgctaagaaggattcctcaccatggctattatttctatctattatatcttcatctcctcatgttcagaaagggttatcatgttcccagcagtcctcagcactgatttaccctgggccatactagggatcaactgttaacacccttaaatcattcttcgtcctgctgtttctcggccgaaccacgtccatgctgcagagagtaaagcgcctccaaagaatccccatcctacttgatcttccctgataaactcatgacaagccaccaccccatgaagaggccctctctcaccagtgccagccttcaatacactcactgcaaacaccatcccacgaggaggccctctctcaccagtgccagctttcaatacattcattgcaaccaccaccccatgaggaggtcctctctcaccagtgccagccttcgatacactcactacaaccaccaccccacgaggaggacctctctcaccagtgctggcctgtgatacactcacagcaaacaccaccccacgaggaggccctctctcaccagtgccagcctgtgatacactcactacaaccaccaccccacgaggaggccccctctcaccagtgctggcctgtgatacactcactgcaaacaccaccccacgaggaggccctctctcaccagtgccagcctgcggggccagagacttgcagacattgatgaggtagtgctccgggtcccccgtcccagtgatggcttcccagttgtcactgtaccttgacagggacgagaggtcgaaggagttgccagccccatctctgaaaagaagaaaacccgcagttagttaggcttggtcgtattctctttaaacattgggcactctgtctagaaacgttcaagtattcaggcatagtctaagcctgacagaactttagactcgacttctctctgtctctgtcacacacacacacacacacacacacacacacacacacacacaccccccatcagaatcagcaacaacataacttccctgaacataatagttcaggaaactattaggctcacttaaaaaaaaatttaaattttaacagaaaaactcaagtctgcaaagtgcgtgccgtctgtgctcaggccactgagaagtggaacttgctggtgacaaaggtaagcagccaagatgctaggagcacacacagcaggggccatgcccggggcagccgcacgccacctgttgtttaaaaccaaggccgccagcagttactgaaattctgaaattaaaatgggcttgctgacctttctgcacaggctaaaggttcactaactacacaaatcccaaatacagacagtaactgggaaccaaccccatgccaggagcaatattaacagtgagtgagacacacactctgccaccacggagcaggaacgggagcagctacagatgccacctcagcggcagctcttagcgcttcagaggggaataaaaactggtcattcattcaaaagctgtgtgctaaactgggggtactgtattaaacaaaacagtattaaacatcatcaatcttacaaagtttaccaaaattacctgtggaagaaaatgaccgtgaacaagataagacttttaaaaatacatactgtatttgatggaagtaagagctgaaggaaaaaaggcagataagggggatatgaagttcggggggcagaggcagctgttgaaattttagacagtggagccagagaaggcgtgaccgagaaggggacctgtgaatagactctgagagaaatggaatcactgaccatcctggcacccagtaaagcgcatcccaggcagagaacagcatgagcaaagggcccgaggcacataagcccgacatgacccgagaaagacagaaaccccgtgtggctggaacagagtgaaagtgaggttattagagacaacacgggggtcatgtccatcagaggaagaacttcagcctgtaggtcccaatgagatgggcgctcactgcattgaaggtttcagcaagagcgacatggtgggacttatatctcaagaggatcattctaattactgtgtgggactaaccaaacgtgtgacaagggacatggcaaggagacctcggagtggcagctgcagtactgcacgcacgagaggaggagtgcccaaaccaggggcaggtggcaggaagggaaagctgcctgaaggtgatgggacaagaacagagcttagtgaatatcaccaaatgctctaaaagtagtcaacagaagaaacagaaatagaactaacaaagccaaggcagaggaaagaggagaggagaacagcacaggtgaggacagctttcatcttttaaaagagagtcaacagacaccattagaagctgacaaacagaggtttagagttatagaaggttccaaaaagaaccacaagaagaaacagtaaaaagtggagtgaagctaggggttggggagggagaggtgagggtgggtaatttcatctattaatatttttggactctcaattacaatagacatatattaacttttattatgagattataaaattctcctctgatttaattctacttttaaaaacttagcataaaaatatctttaggaaggccgggcgcagtggctcacacctataatcccagcactttgggaggccaaggcagacggaggatgacctgcagtcagcagttcaagaccagcctggccaacatggtgaaaccctgtctctactaaaaatacaaaaaataggctggctcagtggctcacacttgtaatcccagcactttgggaggccaaggcgggcgaatcacgaggtcaagagttcgagaccagcctggccaacatagtggaaccccatctctactaaaaatacaaaaaaattcgccaggtgtggtggcgggcgcctgtaatcccagctactcgggaggctgaggcaggagagtcacttgaacccgggaggcggaggttgcagtgagtcgagatcacgccactgcactccagcctgggcgacagtgcaagactctgtctcattaaaaaaaaaaaaaaaaacaccacaaaaattagccaggcatggtggtgtctgtaatcccagctactagggatgctgagacaggagaattgcttgaaccagggaggaggaggttgcagtgagacaagatcacgccactgcacttcagcctgggtgacagagcgagattccatctcaaaaaaaatacatatatatatatatatatatatatatatatacacacacacacacacacacacacacacacacatacacatatctctaggaaaaatgctttatgtgcaaagaaaatcaaaattttattccttgtatataaatatcagaaaactgaaggcagcctcacatggcagaaagagaactgctaagtgaactggggatatctactgaggacatttcccatccagtagaaatgagaaacaaatttgtttcacatgaaaatatttacaaaatgttaactggaaaaggtaaggttactaaaattatgatttaaagtcactgaacataaattactaaatgcttgcatttacatacgttcctaaaacttaaatgatgatttcacctacataaataaccgatgacacaacaggacaaaggccggaaggaaacagaatcacctgcactttcccccaggaaagtcaacagtgatcaagtggctcatactgggtgtttcacacggcagaacacagggcatccctccaaaaaacagaaccgcagacccacaaaaccaaaatctctaaggatgggaccccaggtgtccagagggcgatctggcaaagctgttgagagcagctctgtggacgatcacatgcaacgaagacctcccttcatcgcaggggtcaccacaccgctcctggcccactctgctcactgacatgtggatcacgcaagagtgccaggggtccactctctgcttcagctccaatcccttccccatgcagtcaccacagcagctccaggtggtgacggagctgagagttaacctagcccgactcctcattttaatatgagcaaaccgagtcctaggtaaattaactgactaatctaatcccctgcacccaagaccactaattattaaagcaaaatcataccaagttagtctgtccaaaagagacaacacatccatggacttacttgaatgaacattcagtcagatcgaaaggtgggcaggcatactgcgttcgccactcaaacaagtaggaacaatctgaagtctcctttagaaatactggctaaaaaagttaagaggcacatatataaaagtgagaatgcaaaactttagtttatactttgagttttaagaatgaaaatagtaaagaatggttacgttcatgaaaatcaatactaactgatgaaagtttcaacatattttctgtaaatggttattttaaactcagttaaccaggagatttgatgagatctgaggacagattctttctaatatgatcccagcagcctgagggtggggagaagaccccgctgagggccgtcggtacatgctcacccgctgggtgccgcggtcacagtagaagaagatggctgtggagcgctgataaaccttatggcaagtgtccccccccgtgaagttcatttttaacaagccattttcataagttagcttctgagtcaggagacctgtaaagaaggagaacattaaacaaggtttggttcgggtccctaggctgtcaaacttagcctaagacatgtgacaccacacaccctgaagagtgtgagacaaagtatccctggcctcccagcaccataccatgcactcctgtcacattacactttgggaataaaatcaggcttccccttgtccaaggctgctgcaacgtcacagactgacccgtgtatgatgacatgaggcattccttagcctcatcacctaagggaatgtcactttctccactgtgcctgagggctgtccacgtactcaccaccagctactttgacttcatttttacaagttcctaaatgtatttaaatcttgcccaactgctgaaacagcatgaatgaccaacagcgtgccctgtaatttctacagccaaacctcgtactaaatgcattccctgtgactcaatgctatcaagtactaccccagaacatccaacactggctagctcactgtgtcccaacgttgtaataaagaagagaaatatgaccttagagtcagtaactggcatggctaactaagaataaaatagacatgctctaccaacatccttcagtatgtactctgtttaagaaaatcaagcaaaatccgaaatatcattaatatgcttttttttttttttacagtagaacactcatgtttctgactcaagggaaaattcatcttcagcaaaatattttaatattttaattccattcctttgcaacaaaaggaaaacgacaaacaatggtacctgccactttgtgaaatccctgcggttcccgcttttcctgacatgaggagaccaccttggacttgtcacttgtggggcagacgtctgaggaaagcttcccacagacccggaagtaataagtgtattcgccagcgctcacgatggtgtcgttgaggcccaggggcttcaggtcatacaagttgccatgccttgggtctttcacctcacagttgtccccttcaagaacatggaagaagtgaagggcaactgcaaccacacacgcattcacattttcaagcaaaaagctttacaaatggccgggcgcagtggctcacgcctgtaatcccagcactttgggaggctgaggcgggtggattactaggtcaagagatctagaccatcctggccaacatggtgaaaccccgtctctactaaaaatacaaaaattagctgggcatggtggcaggcaccctgtagtcccagctactcaggaggctgaggcaggagaatcacttgaacccaagaggcagaggttgcagtgagccgagatggcgccattacactccagcctggcaacagagcaaaactcggtctcaaaaaaaaaaaaaaaaacttttacaatttttggttaggtaaataccagctataaatgggcattaaaagccatttccacatgattttgtttatatataatacaaatcgcctggcaaacagctttctaggaaagtctaggtccccgaataaagacttgcttcatcaaacaacacaaaaccaaaccccacattagtgtcttcaagcatcagacgccaaaatcccatcaatccaggcacacaaggaaaatgtcactcgtgaaattagcaatatgcttcagtaaaaaaaaaagctcaaggaaaagaaattatcctccccctagcgtgtgtctcatgaccccagctatggctgttatcacacggtctcatatctaaggcatcgttcagaacgtctgctactctatacatttaaaatgacttgtagggacaggcccagtcctaccttccactctgacaacgggacaggcttccacagttctccagataaacacgtactcacaaccatcctgaagctgaaatgctggtgagccctgtaatataaatcagcagcctgatttgtttcctgtttattttaaaaattaatcaaatggggccgggcacggtggctcacacctgtaatctcagcactttgggaggccgagacgggtggatcacaagttcaggagttcaagatcagcctggccaagatggtgaaaccccgtctctactaaaaatacaaaagttagctgggcgtggtggcaggtgcctgtaatcccagctactcgggaggctgaggcaggagaatcacttgaacctggggggcggaggttgcagtgagccaagattgcaccactgcactccagcctgggtgacagagtaagactccatctcaaaaaaaaaaaaaaaaaaaaaaattaaataaatgatagccacagttagtacccaatctttgacctccatgtgcaaactacgtaacatttattaaacatttaagacctgaagaaatgagtgcattctcgtcaaaccctagcaatggctgaaactccacgaaaacacaggcaagttttaaacaagatagaagattcagaggttcaagggaaatgggaaatggagtcacccggggacaacatctcattgctggtctgaacacacaccgatatctgagcacactcaaacgtgatcctggtggagaagcgctggttcccacacttgtcaccgttgacatacatgatgctcaaagatccattcgccgcggcttggggactcatctgcaccacacccagattccagctattgccttctgacactaagcaagaccccactgcgctgcctggaagaacagaataagtggtttgggcatgaggaaggcgatgaccttgagtcaaatgctctaataaaatgaacagacgccaatcaagagaccaaggagaactcaccctggcatccaggaatgtaagggagaggattgcaaacgctcaaatagaaagtcctctttctcccatcgacagaggtgtcaacagccgtccaaggtttcctgactgtgcttaggccagtcaggtcgtactcatttccagccaggtctgaaacacaacaaaaaaccacgctggagaactctgcctccttgtgagcactcaagaactgcctttcaccctaaataagccctgaggaggcgtgaacctggcattcctaactgtgaggataaggaaatccacgggaggctgagaggctttgcctacaaaacacacccactctgtccctcaaaactgcccttcacagccgggcctggtggcatgcgcctgtagtcagctactttggaggctgaggcaggaggatcacttaggaccaggagttcaaggccagcctgggcaacatagtgagtccctaaagactctttaaagaaaaaagccaaacccccactgcccttgacaaggaagtaccactgttgcagagcaggcagggtcaatcccagaggtcaaggtctcctgtatacactgtcagcttccagggcacagcttagggagtttaacatctttttctttttttttcaccctcaaataagaagctctgacagtacatgtgaaatgtgtttcctctgcattttcttctctgttcttaagatgtatctgatcccaaaagatagcttaaaaccattaactatatagtcagattctcttcaagaaaaacattacaactctaggcatcattcaaagagaatatataacagaaatgtcacgctgcctgcataaccaagcatacacaccacacacacacaaatatacatacacacagaaacacaccttcatatccactcacacacacactgactcttgaccggcctctcagttcttaggccgcacggccttaccggtgacttggcagtccactggagaaggaacacaggccaacgcggtttcaaactcaaagtaagtgtttcggatcccttgcccagagtcgatatcttgatgcaggaatttgaggggccctgagtaaacatcatcattgcaaacaaagcggacgataaaagcatcagcggtacctgtaaagcaagaaggcccagattttaagagacagaacagtattcatggcgcagcccacaagcacagtgcagcaacaggacaaggctgccactggcaacaagcttcacagccgttcgtgggagcaatgacaccagggcaccaagtgtgtatcgagggactcgacatgaacaaagtggtcacactcgctacaacagtggcctatgacaggtttacacactcactgcaacagtggcctgtgttacaacaggtttacacactgcaacggtggcctgtgttatgacaggtttacacactcgctccaatggtggcctatgtgatgacaggtttacacactcactgcaacggtggcctgtgttatgacaggtttacacactcgctccaatggtggcctatgtgatgacaggtttacacactcactgcaacggtggcctgtgttatgacaggtttacacactcactgcaatggtggcctatgtgatgacagctttacacactgcaacagcggcctatgttatgacaggtttctaccataagcctaacatcctggcattcctactcttccagaaaatatttaaatcccacgagtttaccaatccaagcattagaagacaatgtaactctaattcgttggcttattgaacaaatactaagttcctaccatgtatcggaatgaatgaagcagacgaaaacccctgcctgcagctgtgctggttgcagagcgaggagcaagtacaaagattcaagaggggagggtgggagacagtgcactttgtttatatcagaaacagggaggccagcgggccaagcgggaagagcagcagggggtgatcatctcagagagcccccacgggcgtcccatggccgtactgtggacactggcttctactctaggtacagtgcagagcctccgagggctctgagctgggaagtgatatgatgtgatgtttcagaaacatcactctgactgctgtgttgaatacaggctacagcagccccccttatctgcggggggatatgttccgagacccacagtgaatgcctgaaattgagaaccctatatatactatgctgtttcctatacacacatacagaggatgaagctcaatttgtaagctaggcacagcaagagatcaacaataaaacagaacaactgtaacaatatctgtaatgacagttacgtgaatgtggtttctctcattctttctcacaaaataccttattattttcggaccatgtgataccacaaaagtgaagccacggataacgggacccctgtattctgcgaggtcaaacgcaggaagaccaccgtgatggctcctgcagcaaggtggacagcacagcccatggtggcgggggatgtgcacatcctacactcaggaaggtgcatggccagccacagagccaccagggccctttttagctacaaaacaacatggctctgagctcacctttggcagagagaggccctttgtaggtcagagtgatgaagccctctgtggacagctggaggcttttctcaattccgactggccttgctggcttccaattcttgagctcttcag

SEQ ID NO: 6850 - DNA, 308 bp, Homo sapiens
aaaattcttttttttttgagacagagtctcgctctgtcgcccaggctggagtgcagtggcgcgatctcggctcactgcaagctccgcctcccgggttcacgccattcccctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctaaaattctt

SEQ ID NO: 6851 - DNA, 323 bp, Homo sapiens
gctttctttctttttttttttttttttggagacagagtctctctctgttgcccaggctggagtgcagtggcgcgatctcagctcactgcaagctccacctcccgggttcacgccccacgccattctcctgcctcagcctcccaagtggctgggactacaggcgcctgccaccacgcccggctaattttttttgtattttttagtagagacggggtttcaccgtgttagccaggatggtctcgatctcctgacctcgtgatccacccacctcggcctcccaaagtgctgggattacaggcgtgagccaccgcgcccggcctaaa

SEQ ID NO: 6852 - DNA, 4062 bp, Homo sapiens
atttttactttttttcctttttctattcttttttttttttttttttttttttttttttttttttttttgagacggagtctcgctctgtctcccaggctggagtgcagtggcgcgatctctgctcgctgcaagctccgcctcccgggttcacgccattctcctgcctcagcctcccgagtagctgggactaccggcacccgccaccacgcccagctaatttttttttaatttttagtagaaacagggtttctccgtgttagccaggatggtctcgatctcttgacctcgtgatccgcccacctcggcctcccaaagtgctaggattacaggcgtgagccaccgtgcccggcctattctttttttttttttttttttttttttttagtagcacttgttgttgaagcatttttactttttgtatttccttctttctgagttactgtggtaggctgcatctaaaatgactcctaagcaccgtaccttctggttttcacatccttgtgtaatttcctcctcttgtgcttgggccggacctaatgacctctttcaaaagaatagaatatggcaaagtgacagaatgtcacatctgagattaggttacaaaagactgtgactttcatcttcctctctctcttgcgctctcacttgctcattccaatgtaggaaattgccatgttgcaatttccaaaggataggtcacaatccaaaggataggtccatatggcagaaaaacggagggtagcctctagtcaacagccagtgaggaacggaggccctgagtgcaacaccctgatagggactaagtcctaccaacatcaacacctagtcaagccttaagatgactgcagcacccgctcaacaccttttatacagccttatgagaaacccagagccaagagacccaactaagctttgcctagcttccttactcatagactctgtaagaaaataattgtttattgctttaaggcaccaagtttgggggtaatttttcatacagcaagagataactaatatagattctgtttgataaatattaacttacacctaactcagatttcactcaaagaaattaatatgcatgtgagaagatatattctttacccagccacgggaggtattgcctaggaaaaacttagatagttgccaaccgattgtatcataatctcacttctgagtttagaaattaatattaaaggactgtagtttccagtcagacttttccatttaaaaaccatgagcttctatttttacaagtcataggtacttaattagttctccactattctgtaaaataatacactcctagttctgtgataactctggtcaattctagaaataagtattcgttagtacaaattaccagagcctgtggatttgaatgtatcaatctgttttattaagcaggccccattttgtgaaactcagctggaaaacgacagtcaacctgacaattctcatagatagttaatttaagaaattcttcttcttcttcttctttttttttttttttttttttgatagagggtcttactctattgcccaggctggagtgcagcggcacaatcatgtctcactgcagcctcagcctccggaatagctgggactgcaggtgcacaccacgatgcccagctaatttttttttttttttttttttttgagacggagtgtcgctctgtcgcccagagtggagtacagtggctccatctcggttcactgcaagctccacccgctgggctcacgccattctcctgcctcagcctcccgagtagctgggaatacaggcgcctgccactacgcccagctaatttttgtatatttagtagagacggggtttcaccgtgttagccaggatggtctcgatctcctgacctcgtgatccacctgcctcggcctcccaaagtgctgggattacagatgtgagccacggcgcccggccgcccagctaatttttaaattttttttgtagaaacagagtttcacgaagttgcccaggctggtctcaaactcctgggctcgagcagtttgcccaccccagcctcccaaagtgctaggattacaggtgtgagccaccacacttggctaattttctttttctttttctttcttttttttttttttttttgagacagtctcactctgtcacctggctggagtttagtgacacgatcttagctccctgcaacctctgcctcctgagttcaagtgattctcctacctcagcctcctgagtagctggaattacaggtacacaccaccacgcccagctaatttttgtatttttagcagagacagcgtttcgccatgttggcctctatctcttgaccttgtgatccacccaccgcagcctcccaaagagctgggattacaggcgtgagccaccatgcccagcctaattttttattttttgtgaagatggggtctctgttgcctgggctggtctcaaactccagggctcaagtgatcctccagtctcagcctcccaaagtgctgagattacaggcatgagcccctgtgcccacccaaaaaattattcttaagctggtgagtacataaatgtttctttattattttttaaatctatatatatgttttatgaagtttttgttatgtgtaatacatttcataataaaaacaaggtttaaaaaaaacaagctttctgacttgttctgatatttaagattttggtaaaaagttttaagttttaaagagtgcatatgggctggtccgagtgcagtggtttatgactaattaatcacaaccagttccagatttctttgttctttctctactcccactgcttcacttggctagcctttagtaaataaataaataaatagagtgcctatggtagttaaccaaaaaaagagtgttttctaagcttccattaagtctatcatacactatcattaattcccctaagactgtgtcaagttacctatttacaaagatcgattgctcagatccttcaaagttcatgaatcctttagttttggatgataaagagtgaaaaaacaaaagttaaagagaagcccacagaaccagagaaaaaaagaagttgccttctttctcatccttcataaacacctgcccacacaggttgatgtcctttttcaaatatttagtcagaccccaagcactacctttgaccctggtattacaagtcccactctgcctttactactcatatctgaacttttaatatctaattacaatattcagtgaactgatattacatgctaccatttttaagtttggaattaaacttggaattatgttgacaaatctggtttgttttagaacttaatacgatttagaacttttgtttattatgttttataaattaaatgccattttttaccttttaaaattatcttcctattttattcattcagcaaatatttatatacctatagtaaaagtatataaacctgatatatagtaatatatccagaaatgttcaggatagaaatgcagtagtgaacagacaagcaagcttgtagtctttaaataaattaccaactgtaatgctgtttgacattatgtttttaaataatgcataacctattgttatcagggagttatacatacctatgtattaccatatatcttccaatataggcttgtaataaagtcagtatactcacgttctcttttctaagcatgtcttaacaggttaaaccacacaaccgtgatatttgtatattatataattaacatcttaaataacagctttgaaatttctttttttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggcctgaaat

SEQ ID NO: 6853 - DNA, 310 bp, Homo sapiens
ttttttttttttttgagacagagtttcactctgtagcccaggctggagtgcagtggcacaatctcggctcactgcaagctccgcctcccgagttcacgcctttctcctgcctcagcctcccaagtagctgggactacaggtgcctgccaccacgcccagctaattttttttttttttgtatttttagtagagacggggtttcaccgtgttagccaggatggtctcgatctcctgaccttgtgatccacccccctcggcctccaaaagtgctgggattacaggcatgagccaccgcgcctggctgagaatc

SEQ ID NO: 6854 - DNA, 255 bp, Homo sapiens
tgcagtggcgtgatctaggctcactgcaagctccacctcccgggttcacgtcattctcctgattcagcctcccaggtagctgggactacaggtgcccgccaccacacccagctaatttttttgtatttttagtagagagggggtttcaccgtgttagccaggatggtctcgatctcctgacctcgtgatccgcccgcctcggcctcccaaagtgctgggattacaggagtgagccaccgcgcctggccagaaatc

SEQ ID NO: 6855 - DNA, 4635 bp, Homo sapiens
taatttttttttttttttttttgagacagagtctcgctctgtcgcccaggctggaatgcactggcgcgatctcggctcactgcaagctccgcctcccgggttcactccattctcctgcctcagcctcccgagtagctgggactacaggcgcccgctaccacacccagctagtttttttgtatttttagtagagacagggtttcaccatattggccaggctggtctcaaactcctgacctcgtgatccgcccgcctcggcctcctaaagtgctgggattacaggcatgagccaccatgtccagctgagactgcatttctaaaggctccaggtgaggttgctgctgtgatgctgagggtcccaggactgcatatctgctgcagggccttgccccttccaactcctgctgccttcttgacattccctcccctttcactgagcttgtgcacagactgtcttctcccctctgggctacgcacccagtttttcctgtctggaatgagctgctattcccccttaccctacacaccccatctcctctttccccaacagcaccctgtgctgaagccttcgcaggatttaccaggctgacctgttagtacctgcatggatgtcttcagagcagagactgtggattgtctatcaccaagttccagcacctggtacaggatctggcaaatcacaagccctcaggaaatatctggggaatgaaaaatgaacctctgagaggagataagatagaaagacgcataatcatcatgacatcatcatagcaaataccacttggcacttactctgtgctggccctgttgttggtgcttgacatttagttaagtcatttaattcccacaacaacccagttttgtagggattatcatcaaccttattttattttaattaattatttgagatggagtctctcactctgttgcccaggctagagtgcagtggcatgatctcggctcattgcaacctctgcctcctgaggtcaggagttcaagatcagcctggccaacagggcaaaaccccgtctttactaaaaatacaaaagttagccaggtgtggtggcacgtgcttgtaatcccagctactaggtaggagaatcccagctgaggtagaagaatcgcttgaacccaggaggcagaggttgcagtgagccgagatcacgccattggactccagcctgggtgacaagagcgaaactcgtctcaaaaagcaaacaaatgaacaaacagaagaacaactccgtaagtttgtgccaagctgatgcttacagctgggcttcaggaccattaactgaggatgcagaagatacaggtggcagttggaagagacagtgggggagggccttgttgagaagctaaggtcatggtgtggaggggaggaaaggagggcaagtatcagagtgggacaagagtgctggggaggacaggatggctgggtaagatggtggcgaggagtgatgggtcctgggagccagggaagagggaggagaaggactgcgcatgagtgtggttgacagagagaggctggaaacctgaatggagcaggaagtcaggcatgcagacaggtttggcaagaaccaggatggtgggagcggggctagacactgtgtgctggatttaaggagaaggcagttaaacaatagggaaacacgccaaaaatcttgaacttgagagtagaactacaggtaacaaaggtgttttgttattctttttaatgttttctaacttttaaaatgagcatgtattcttttgtatctatatttgaatttatagcataatttttcacattaaaaatggatttactttaataggcaatacagccgggcgtggtggctttacgcctgtaatccccagcattttggagggccgaggtggaaggatggcttaagcccaggagttgaagaccagcctgggcaaaaaagtgagacctcctcccatctctacaataaaatacaaaaattggccaggtgctactctgggcacactgcctatagggtagccctgctctgcaaggccagtactaggagggaaaaagaaaaagaaaacaaaggaacaaacaaaacaaggaaaaaaagaaaaaaaaattagtggggcatggtggtgagtccctgtagtctcagctactcgagatgctgaggtgggagattgcttgagtccaggaggttgaggctgcagtaagagtgagccatgatcaggccactgcagctccagcctgggtgacacagagctcactgcagccttcacctcctgggctcaagtgatccttctacctcagcctcctgagtagctggaactacagccgtgcaccactccgcctgggtaatttttgtatttttttgtagagacaggatttcgccatgtttcctgggctggtctcctggactcaagtgattcctccacccctggcctcccaaaatgctggtattacaggcatgagccaccacaccctgcccttttatcttttccttcttcttccttttttttgtttttgagacagagtctcgctctgtagcccaggctggagtgtagtggcgagatcttggctcactgcaacctctgcctcccgggttcaagcgattctcctgcctcagcctcccgagtagctgggattacaggtgcccgctaccaccccggctaattttttgtattctagtagagatggggtttcaccgtattgctcagactggtcttgaactcctgagctcagtcaatccgcccacctcggcctcccaaagtgctggtattacaggcgtgagccaccacggctggccccatttttcttaatgtagatgttcttggtaacttctgggtacatattctttgttagatatatgtattgtaaatattttctaccagtctatgatttgatttttcactcttttaaatgtgtcttttgatgaacagaagttactaataataatgaggttcaatttaataatcatccatctcttatggcttatactttttttgtgtgtcttaagaaattttggtctacttcaaggtcatgaagatattctcctatgcttttttttttttttttttttgagacggaattttgctcttgttgcccaggctggagtgcaatgttgcgatctcggctcactacaacctctgcctccccggtttaagcgattctcctgcctcagcctcctgagtagctgggattacaggcgcatgccaccatgcctggctaatttttgtattttggtagagacagggtttcatcatattggtcaggctggtcttgaatccctgacctcaggtgatccgcccacctcggtctctcaaagtgctgggattacaggcgtgagccaccacgcccggttgatattctcctatgctttcttttagatgttttattgtttttacatttaggtctctgatccatcctaaactatgttcattaatggtgtggtcgggtcacgattcatgtttccctatgtgggtatgtaattgacctactaccatttattcaaaagaccattctaccctgacttgtttgcagtgacactattataataagtcaggtgaccatgtacatgtagatctctcgatttcattttattttattattattttttttgagacggagtctcactctgtcacccaggctggagtgcaatgggatgatcttggctcactgtaacccccgcctcctgggttgaagtgattctcctgcctcagcctcctgagtagctgggattactggtgtgtgtcaccacgcctggctaatttttgtacttttagtagagacagggtttcaccatgttggccaggctggtcttgaactcctgaaatcgtgatccaccggcctcagcctcccaaagtgctgggattacaggtgtgagccactgtgcccagccatgtaaagatttgaaggaaataatgagttttttttttttttgaaagagtcttgctctgttgcccaggttggagtgcagtggtgtgatctcggctcactgcaacctccgcctcccgggttcaagtgattctctggcctcagcctccctagtagctgggattacaggcgcatgtcaccatgcctggctaatttttctatttttagtagagacggggttttgccatgttggccaggctggtcttgaactcctgacctcaagtgatctgcccgcctctgcctcccaaagtgctgggattataggcgtgagccaccgcgcctggcataggaggtttgttaatagtagctgtgatggggttgtaagcttatgggtgatttttcttttcttttttttttttttggtatactccacaccgaacgtagtattaatactcagacaaaatgaataaatatttttctttttttttttttttgagacagagtctcgctctgtcgcccaggctggagtgcggtggcgtgatctcggctcactgcaagctccgcctcccgggttcacaccattctcctgcctcagcctcccgagtagctgggactacaggcacccgccaccacgcccggctaattttttgtattttctagtagagacggggtttcaccatgttagccaggatggtctcgatctcctgacctcgtgatccacccgcctcagcctcccaaagtgctgggattacaggcgtgagccaccatgcctggccagaaatgtttttcaaaat

SEQ ID NO: 6856 - DNA, 287 bp, Homo sapiens
gagacggggtctccgtctgtcgcccaggctggagtgcagtggcgcaatctccgctcactgcaagctccaccttccaggttcacgccattatcctgcctcagcctcccgagtagctggggctacaggcacccaccaccatgcctggctaattttatgtatttttagtagagacggggtttcaccgtgttagccaggatggtctcaatctcctgaccttgtgatccgcccgcctcggcctcccaaagtgctgggattacaggcgtgagccaccacgcctggccctatat

SEQ ID NO: 6857 - DNA, 313 bp, Homo sapiens
taagtattttccttttttttttttttgagacggagtctcgctctgtcgcccaggctggagtgcagtggcgtgatcttggctcactgcaaactccgcctcctgggttcacgccattctcctgcctcagcctccctagtagctgggactacaggcgcccaccaccacgcccagctaattttttgtatttttagtagagatggggtttcaccgtgttagccaggatggtctccatctcctgacctcatgatccacccgccttggcctcccaaagtgctgggattacaggagtgagccactgcgcccggcctaaaat

SEQ ID NO: 6858 - DNA, 6110 bp, Homo sapiens
gttttctttcttttttttctttttttttttttttgagacggagtctcgctctgtcacccaggctggagtgcagtggtgcgatctcggctcactgcaagctccgcctcccgggttcacgccattctcctgcctcagcctcccgagtagctgggactacaggcgcccgccaccacgcccggctaattttttgtatttctactagaggcggggtttcactgtgttagccaggatggtctcgatctcctgacctcgtgatccgcccacctcggccttccaaagtgctaggattccaggcgtgagccaccgctcccagccggaagttttctataaagctttaattattctgtcttcaggcttctctcattccttctacatgtagtgcaacaatgggtgttcagtaaagtagagtgacacagcgaggtcacacagcacattagagggagtgctagaaccagagccccaaatttctcattccccatgttcttttgctcacccatccaaccatccatccatccatccatccatccaacaaatattgctgagtttcttctatgtcagtagctctcaaacttggctgcacattggaatcacctggattccacccttagcaatcctgatttaattgggctagggagaggcatgaatattgaattttttgccttggaacatattgttttatatacaacacagtagtgaatagtgacttcattatggatttgtttctttatagatcacagtggcatataaaattcaaaatccataaacaaagagctcttaggttaaatgagttcttcctaaaaattcttaatggcatgctggtctattctcaagcggtacaattttataatgcaccatcctatatttagcatgtcacatttctacagtaacataatggaggcacaggcagtgcaagcagatttaaaccccttctacttctggactgaaggttagaaaaacacagcgtgtacacacacacacttggatgagttcttccaatacgttttcccccaaaaatgatagttttatcaaagaatttcaataactttcatagtttgtacaaccacactctattagctacattaaaaaggattcaacaaggggccaactacacagtagtaaataaacatgtttgagaatatctgctacattctctatctcctggagaaaataatatttacatttttttgtaaagtgatttaataactaaacaattctttcttttggtcgggggtaggtaatgggattttcaaagcttcacaggtgattccaataagcagtcaatttgagaagagtttctctgtgccagaaactgttcctgatgctgcagatactgcagtcaacacaccaaacaagataattactgacagaaattaaacatgtaattaataagataatatcaggtagaaataggtgctattaaaggggggaaaaacagtgtagtttgggtgtggtggctcacacctgtaatcccagcactttgggaggctgaggcaggcagattgcttgagcccaggagttcaagaccagcctgggaaacatggcaaaaacctgtctctacaattaacaacaacaacaacaaaaaaaacaaaaaccaaaaaacaagcaatgacaactacaacaacaacaattaaaaaaaaccagtgtaatgcaataaagaatagctagagtcagagtcacttttagatgaaggggccaggattaggctttgcagtgccatttgagagagacctaaatcccaaaaggacaccatagaagggcctcaggggaaagcattgctggcagaaggagcatctgaggtgttctggacagtttcccattacccttccagtcctgctctcagtcctctccttgtttgtttcagcacaaggctgaccagtaaggacttcagcagcagggcctggggtatgaggatctgggatgtgggtcttgggatgaaggggtgtctgggatgtgagtcctggggtttgggggaactgagttatagggactaggaagtaagatttcaatagtaatttgacaaaatatattaagaacttaaaaattttctttgatatgatacttccactttcagggcttatatcagatcttcatcacaatgttactgatgagaaaaaaaacctataaaccatctaaatagcccataataagggactggttaggtacattatagtctgtccatttgatatagtgaaaatgtgtgcttcagcaggccatgaacaaaaacagtgagagatgaggctgtataaatgttaacaatgtctgcctgccaaaaaattattacaacatttaaaaggcaaactggaaaaatatttgttacctgtgacaagaattcttccaaatgaggaagaaacatttaacagaaaaatgagcataagacttgaatagagaatttctaaaagaaattgtcactaaatgtctgaaaaaaaaaaaaaaactcagccttattctaaaaggttaaaatgtggtatctttttgcatggaaaaaataattaatgcttaaaagacactaaacaaatgccagtagcattccctagtcagtaaggttttacaacagttcttggacggcagtttggcaaagttaatttttcaccaaatattcattctgtgcctcttctgtgccaggtacagagaagggctctcaatgtgggtgagggtagagattcaggaccaaggagcagtctggagttttcacagagcatgggagattgtcttagtctttttaggctgctataacaaaatactatagagtggcttataaactacaaaaattttattttcctcacttctggaggctgggaagtccaaggtcaaggcatcgccaaatataatgtctggcgaggtcccatttcttatggatgtacagcttctcattgtcaccttacacggtagaagggtgaggagcctctgtaaggcctcttttataagagcacaatcctattcattatggtagagccctaatcacctcccatcttctaatactatcaccttgtgggagtcaggatttcaacatatagattttggggtaacccaaacattcccaccacagcagaggcattaccaacatttagcacccagttgttaaagacatcaaacttcctgcattgattttaggtcataaaaatttctttgaccagagaaatgtaagcagataggagattgtgccagttctgggtgaggtgtcaagaaccattctgtgttccctcactctcctaagctcaagccattcaccaggagaccgcatactcaggcaaccatacctccctccacctgggccctcaagcaagaaacaccagtgagagaccagagcagacctgagccccaagcccagccgagtaccaagcccacgagtgagatatcagtgttggttgtgaccaatgaggtttgggggttatttgttaagcatcattatcatgcataaccttataaactgtacaaagaattgttcccccagatgccataagcatgcccaaccctctgtctgaaaaatgctggatacagaaaagaaagagaacagagctctgggatgagcatgcacagtcaaccaatcatcacagcacagatgacatgacgcatgttgaaataagtgcctttaataatgagttgaaaagtgggatgaaaaagaggaacaggagtaacagttttgagtgggaagttaatgaaagtttctccagggatacaacatgtaagacttgagatgaaagagggttagacctggagcgggataaaggtttccaacagagagggggccatgaatagggaggagcttgcacctgaggggttggagcaggagcactaactaggtgccaactggatggtctggccccatcaggaccttggggaccaccaggaggggattggattttacctaagtgcaatgagagccatcaaagggaattttgttggtttgtttaaatcaaaatttgttttgtaaacatattagttttaccactggtgtgatttagcctttgatctatagaaatggaatttgagtttcaaatgtctccagtggcaggactgcccacaaagaatccctactaccattcacattttggggagggggttaatagcaccaactcaagtactatccttacactgtctagaaatgaaaggaaacaattgactcaggaatttcacttctaaatagcctgcatttacataacagtatccttggaattatagttctatcaagctttcatgtgaaaactaaatgagagaaaatgaaaattactttagaagagagaccaaaaaatactgttttctggattaatcagagacttcctgttaataaatagcaataagaatacaactttcattatcctgaaatcaaataagatgaaaagaattatactaagattcacacatatatttgtgtggatatatatatgggaaaaacctaagcatgtttccctactctctactcacaatcacagagtacttctgacaccagatgtgtggggggttttctccacatgccaaccaagcaactctgcagcaaacaccagctaggtgtcctgttattctgatcctacttacttggagacagccaggtaaagttgggttgagagctcaggataggtgagggctcagtcccaggagcctgaccccatttcacatgccaattacaaactcagattttgacctcagcttctggcccactgactataaaccagggttcccatgattccctccttgggttgtggcattgggcattctggtgagctctccatgtgatctacacatcaggcatgagactttatccctgaaacttatgtcaaattgtccagcttagcagtttttgttcttgtttggagagttgtagcaagatattgaagtaaactagaggaatttaagatccaatcctaaataaataacaaaaacttgaaaacaatcaacagggctatgatctaacaacaagtgtactatggttttcttctgaaacttaatttttctctctattgtcatccccacttctactaaaaataatcacagtaacaccaatttgtttctaaaataagtttagtctcaaacttggcctaattatttgtataagtacagcaagaataaccatataggctccttttaaatttgcttgatgataattttgacaagaaatcttaggctggactttttttttttttttttttttttgagatgaagtctcgctctgtaccccaggctggagggcagtggcgtgatcttggctcactgcaagctccgcctcctgggttcacgccattctcttgcctcagcctccttagtagctgggactacaggcgcccgtcaccacgcctggctaatttttttttttttttttgcattttttgtagagacgaggtttcaccgtgttagccaggatggtctcgatctcctgacctcgtgatccgcccgcctcggcctcccaaagtgctgggattacaggcgtgagccaccgcgcccggcctaaactggactttttaaaacctctcgatgctaggaagtcaaaccaatgcagacatcagactttgcccttaaagccagactctctatgcatgttttcaaatatgacattccagtcaaagctttgataatatagtcaatgttttcagttgtatcatgttaaagagaacagattcttgttgaatttatgcaaataaccatatcatcataaacaaaaataaggatacccatgaattatttcctgagttttggagggatcaggtagggaacaaaagcaaatgtttcaatttttgtttacaaaagtatgcattagcaaattgctataagttatagttagcttaaaagaaaaaaagttcccttgctgggtgcggtggctgacgcctgtaatcccagcactttgggaggccgaggcgggtggatcgcgaggtcaggagatcgagaccatcctggctaacacggtgaaaccccatctctactagaagtacaaaaaatcagccaggtatggtggcgggcgcctgtagtcccagctactcgggaggctgaggcaggagaatggcgtgaacccgggaggcggagcttgcagtgagccgagacagcgccactgcactccagcctgggcgacagagcgagactccgtctcacaaaaaaaaaaaaaaaaaaaagaaagaaaaaaa

SEQ ID NO: 6859 - DNA, 2604 bp, Homo sapiens
tttttttttttttttttttgagacggagtctcgctctgtcgcccaggctggagtgcagtggcacaatctcggcgcactgcaaactccaccttccgggttcacgccattctcctgcctcagcctcccgagtagttgggactacaggcgcccgccaccacgcccggctaattttttgtattttcagtagagacagggtttcaccgtgttagccaggatggtctcgatctcctgacttcgtgatccacctgccatggcctcccaaagtgctgggattacaggcgtgagccaccgtgcccagcccatggaacaccatttttaccagaaaaaaactactgacagacaaaccagggttattcagacttaagtatgtggcagaaattctgtcaaaaatgtaacaaagtgagattgtcacttcaagtaaaacaactgacagtttgtgttaccaatgataaaattctagctttcaagtgaaaactagaattttggaaaatcctatctgccactgtgagcttgacagcttcccaatacttgaagacttttccgactaaataggaagacattaaggaaagtgattgtttgatactgtataatgaaatatgtcaacattaggaagaactgtataacacagtgaaccactaaaatttccgaaggacttatgcttaatgttttaaaaaacaggcatggattcaacatccattcaaagtgtaaggtacaccattggatattaatgtaacagtgtaaaacaagtacattgatatagtttcaaattccactttgtaactaacctttaaaaagctacgatttgtcaaactttgatgtgatatcaaagaacatccatgattatctttaaaaagctattaaaatattcttctttccaacttcatatgactgtgaggtgggattttcttcatcttaaaccaaaatgaaacagtgcagcagcttaaatgcagaggcagacataagaatccagttaccttctattatgtcacacattagttttgcaaaaatgcgaaacagtgccacttctgccgggcgcagtggctcacgcctgtaatcccagcactttgggaggccgagacaggcggatcacgaggtcaggagatcgagaccatcctggctaacaggatgaaaccccgtctctactaaaaataaaaaaaaaaaattagccgggcgtggttgcgggcgcctgtagtcccagctacttgggaggctgaggcaggggaatggcgtgaacccgggaggcggcgcttgcagtgagccgagatagcgccactgcattccagcctgggcgacagagagagactctgtctcaaaaaaaaaaaaaaagaaaaaaaaaagaaacaatgccactcctaggataactgttatcaaaaccaggaaataagtgctgatgatgatgtggagaaattggaatccttaggtactgccaatgggaatgtaaaaatggtacagccactgaagaaaacagtatggtttcaaaaactaaacatagtactatcctatgactcagcaattttcacttctaggtacatacagtatcccaaagaattaaaagcagggattcaaacagacatgtgcacattaatgatcatagtagtagtattcacaatagccaaaaggtggaagcaacccaaatgtccactgacaaatggataaacaaaatgtggtatatacatacaatgaaatattattcagttttaaaaaggaaatcccgacacatgcttcaaaacgaataaaccttaaaaacgctatactaaataaaccagacgcaaaaggacaaatattgtctaattccacttatataagggacctgaaatactcaaattcatagagaaaaaataatggttaaccagggattgggggaggaagtaatgggcagttattgtgtaataggtacagggtttcagtttgggatgatgacaagttctggagatggacagtggtgttggctgtacctctcaattgtacacttaaaaattatcaaaatggtaaattttgttatatcttaccacaattttaaaaaaaagggaaaaaaccccacaatgttaatcttctcactgattggggggcgggggggttggtttggaaaatagttatttttcattaaaatcactatttatgcacctagcctatttattagttttgtaaattaacaactactttaatttttttccagctttaatgtctaatatggtaaatatagacagatataccacacaaacagaagctcttaggtccacggtaatttttgaaaggtaaaggggtcctgagaataaaaagtttgagaattgttcttttttttttttttttttttttgagacggagtcttgctctgtcgcccaggctagagtacagtggtgcgatctcggctcactgcaagcttcgcctcccgggttcatgccattctcctgcctcagcctcccgagtagctgggactacaggcgcccgccaccacgcccggctaattttttgtattttttagtagagacggggtttcaccgtgttagccaggatggtctcgatctcctgacctcgtgatccacccgcctcggcctcccaaagtgctgggattacaggcatgagccacagcgcccggccgagaat

SEQ ID NO: 6860 - DNA, 306 bp, Homo sapiens
ttttttttttttttttgagacggagtctcgctctgtcgcccaggctggagtgcagtggcatgaactcggttcactgcaagctccgcctcccgggttcaagccattctcctgcctcagcctccagagtagctgggactacaggcgcccgccatcatgcctggctaattttttctgtattttttagtagagacggggtttcaccgtgttagccagggtggtctcaatctcctgacctcatgatccacccgcctcggcctcccaaagtgctgggattacaggcgtgagccaccgcgcctggcctcaaat

SEQ ID NO: 6861 - DNA, 27666 bp, Homo sapiens
ggcactgacaggacttgacacattctaatctcctgagggccgctaacaacatagatgacagtctggacaacacaaagggtcaacaggtgctccgagtgtccggcagggctaattggtaagttcgtctcttatacaaggcccgtgggacaagactgggagaggtatttttctttttttcttttttctttttttttttctttttttctgagacagagtcttgctctgtggcccaggctggagtgcagtggcgcaatctcggctcactgcaagctccgcctcccgggttcacgccattctccttcctcagcctcccgagtagctgggactacaggcgcccgccaccacgcccagctaattttttgtatttttagtagagacagggtttcaccgtgttagccaggatggtctccatcgcctgacctcatgatctgcccacctcggcctcccaaagtgctgggattacaggcgtgagccaccgcgcccagcctgggagaggtatttttcttaactaaagtacagaaaataacagagaatcaagaacaatgaagaaacagagaaatatgttccaagcaaaagaacaagataaatctccagaaaatgcccccggtgaaatgaagataagtgacttaccttacagacaattcagaataatgatcatgaagatgcttaccatgtctaggacagcaatgcatgaacaaagtaagaatttcagcaaagagacagaaaaaagttcaaaagaaataacagagctgaagaatacaataactgcaataagagctcaaaagagaagctcaacagactaaatcaagcagaagaaaggattagcaaactagaagataggtcactggaaatcattcagaggagcaaaaatgaaaaagaatgaaaaagagtgaagatatcttaagagagttaggggacatcaagccgaccaaaataggcattatcagagtcccagaaggaggagagtgagaagagatggaaagcttatccaaagaaataacagtcacgagttgcagatcaacatttcagtcaatggcagaccacatgagcacagtggccatagcatgcagcctagctgtgtagtaggctgtcccatctaaatttgtgtaagtgcactccatgatgtccacacaatgacaaattcaccttctgatgcattttcagaacgtatccctgttggtaagcaacgcatacctataatgactgaaaacttcccaacccagggaaggaaatacaaatccacatccaggaagcccaaaggacaccaataagactgatctaaagcaacccacatcaagacacatcataatcaatttcaaaagttaaagacaaagaattctgaaagcagcaagagaaaagcaatgtattatacacaagggaaaacccgtaagtgtaggatttcttctgggggtgatgaaaatgttatgaaattagattgtgatgatggaggcacaactctgtgaatacactacaaacctttgaattgtatgtttttaaatggatgaattttacagtatgtgatgcacaacccaatatagctatctaaaaaaaaaaaaaaaacctaacctatttgtgaattattttgtagaacatgttttctcttttttattcctttattctgttttcctgcagttccctgactgtggtggaataagcttggaggagatgccttcacttactctactgagaggcagagaaaggttaggtatggaagtaaaatgtccataaataatatcaattctgcacctccaaagatgtgtgcctcttacacaaatgtctctataatctgaggggtccaggctacctaacttgcttcttgttgcttcactgcccgttagttcctctcttcactctctaagcttcccatcccctttggatcagcagccaggagcccagtgggagggtatcttacagggcacgttgcacttctgcaggcagtaggccagctccaggggccgcactgctttctgccggctgtcctgcatcttctccagcagcagaagcatctggaaagggacgcttctcctctgctcgtcagctcccctgggcaccgtgatcctgccacacaagaacagccagaaacctccttacatgtagttctcaaagctaggtgcacactggaatcacctgggagaaattttaaatcttcatatccaggccactcccatacaaattaaaccagaattctgggtccggggggcggggcgcgggcagttatcagaatttttcagttcctcagattatttcaatgtgtggtcaaggttgagaagcaccatgtgagtgaatctgctctacaggggaccctctagagagggggatcagcatgactgctgccttggcccctctgcaccctgcccagcaatcgtgctagagcagacggcagatgcacgaggtcctggctccacatctcgggcaagcagcaaaatgtccagcctaaagctctccagactgcagaggcacatgctgggttaggtcctgggaagaaaggcaacatgaaaggctgtccgtgtggtttggcaatgattcatttaatcacaggcatttttcggatgggaaaaaggagagagcacagggcagaaaaggagtgatagagagagacagagggagagagtgcattgtgtgagtgttggtggaaggaggggtgtgtactccccactgacttactccttctccgactttggtctagtcccaactctgtcttttaaccaagtcagtggctgtcaatcctggccgcatttaaaatcacccaaagagggctttaaaaaagtaccaatacctggccgggcgcagtggctcatgcctgtaatcccagaactttgggaagctgaggtgggcaaatcacctgaggtcaggaaattgagaccagcctggccaacatggtgaaaactcatatctactaaacatacaaaaattagccaggtgtggtggcgggcgcctgtaatcccagctacttgagaggctgaggcaggagaatcccttgaacccgggaggcggaggttccagtgagccgagattgcaccgtcgcactccagcctggggacagagtgaggcttcatctcaaaaaaaaaaaaaaaaaaaagtaccaatacttgggtcgcaccccagaccaacctaagaagttttagaaataatgtgtaggccagaatatgcagaagccaatctttcctctgccagcttttgagagaagatctcaaaaagtccaagtcactgtgaataactgaatatattaaaaatgaaataatacaggccaggtgcagtggcttacgcctgtaattccagcactttgggaggctgaggtgggtggatcacgaggtcaggagatcgagaccttcctggctaatacggtgaaaccccgtctctactaaaaatacaaaaaaaattagccaggcatggtggcgggctagtcccagctactcgggagactgaagcaggagaatcgcttgaacctgggaggcagaacttgcagtgagccaagatcatgccactgcactccagcctgggcaacagagcaagactccatctcaaaaaaaggaaaaagaaataatacaaatgctcatcagcctgaagaacagtcttacctcttcaatatcctggtgaagtccacattcattacgaacacctgaatcaaggagttaaggcagcaggtctgtccaatgttgtgtaaaccaaccaggcctataaggggaagagaaaaaaatgctgagggcaaggcctagggtaaagaagttgacaaggctgggcatggtggctcatgcctgtaattccagtactttgggaggccgaggtgggcggatcacctgaggtcgggagttcgagaccagcctggccaacatggtaaaaccatgtctctacaaaaaaaatccaaaaatcagccgggtgcggtggctcacgcctgtaatcccagtactttgggaggccgaggcgggcagatcacgaggtcaggagatcgagaccatcctggctaacacggcgaaaccccgtctctactaaaaatgcaaaaaaaattagccgggcgtggtggtgggcgcctgtagtcccagctactcaggaggctgaggcaggagaatggtgtgaacccaggaggcggagcttgcagtgagccaagatcacgccactgcactccagcctgggcaacagagcgagactccatctcaaaaaaaaaaaaaaaaaaatccaaaaatcagccaggtgtcatgacaggtgcctgtagtcccagctccttgggaggctgaggcaggagaattgcttgaacccaggaggcggaggttgcagtgagccaagatcatgccactgcactccagcctgggcaacaagagtggaattctgtctcaaaaaaaaaaaaaaaagttgacaaaaatctaatgtttttcttaaagctactaaggacatgaagtcctgtaaagtctctcaagtacgaagtgttcattcagcttgcaaacaaatcggagagaagatatcaaacatgaacctttaaaaagctctatcacaagggccaagcacagtggctcacacctgtaatcccagcactttgggaggccgaggcgggaagaccacctgaggtcaggagttcaataccagcctggcctacatggtaaaacctcatatttactaaaaatacaaaaattagccgggtgtggtggtgcatgcctgtaatcccagctactcgggaggctgaggaaggagaactgcttgaacctggcaggcagaggttgcagtgagccaagatcgtgccactgcactccagcctaggcgacaaagcaaaactccatctcacacacacacacacaaaaagttcgataacaagaaaagttttaatatagtccattaggaaaagtgagatgtcaccaaaagtatatattactcactgccaaatgagtagtatgagcaattgttgggagagaaaaaaaaacattagagaaagcataactgagaatatggcttcctttcattcaaatcgttctccacggagctaagtccaaatgtgcatctgtggggctcagggataagagggactccccagtatgtctatgttggactccagcggagaggtctctgcccagttcccactacagggaggcaggaaataaatcagaaggttactttggggaagattcacctaatccagtgtcaccctgagaggctgaaaggcagaaggaacttataagaatatgagaaaaacaaaagataacatttgtctgacccctagcaaccaacctcctcttttccaacccaaccttaggctcagcagaccccacaagggaagtaccactaatctcaggattcttggggaaagggctttggcttacaagataggacagtaagaaagtaacaacctggggtcacaggtgagcacagatttctactcccagactatcaggagcacattgcttccagacagacccatacaaaggtagcagtaaagatgggaactaatgctaagtgcctctagaatcccagcactggcttaaagcagtttccacagatgaccccatttaatcctcccaacaaccctatgtgcttggtactattattacccccatttgtttgtttgtttgtttgagacagagtctcactctgtcacccaggctggagtgcagtggcgtgatctcagctcactgcaacctctgccgcccaggttcaagcaattctcctgcctcagccacctaagtagctgggattacaggcacctgccactgcgcccagctaatttttgtatttttagtagagacggggtttcaccattttggccaggctggtcttaaactcccgacctcatgatccacttgccacggcctcccaaactgctgggattacaggcatgagccaccgcgcccgaccttgtttttgttttttacagatagggtttcactatggcccaggctgtatccccatctaaaagatgcagaaactcaggcacaggaaagcatgagccgtcgaatacaaagctctgcggcttcagagcggagggggtgagccgaacatttacatgcagtcaagaagaggaaaacgggaggggtctaatgaccatgagggtagtcccaggccctgggacgctctctgggctgctctctcttcatgttgctgtcttcttccttcttttcttcaagatctgccggggactgcgaggactcagccaggatggactgacagatttgcctcaggagcccaaacgccttgctcattcgtgatcactccaaaacccccaggccgcagctgcctggcccgcgttcaggacagcacgacttcacttccaggaagcgcttatgtgagccaggcacgatggaatctctgtgaaaatacaatgcgggtaggtaagaattagagaaggaggaatgtgtattcatgtaatccgttctgatgccaaagagcaggtcttagagggagataaatgtttggggagactgactcacagagctctaggctggaaatgacagctaggctacacatcccctaacctgggtcccaggcgtttccattcatcctcagagccgactgccaaatcctaaccgggagcgccctcttgggaaaggacagggaagcgcgcataggactttgctttacaacccaggaccaggcccacttcagtaaaaagccagcactaagcaagaactctcagcccctgatgccaggctggcatacaggggaagcctctcaacccgcccaacacccaaggggacctgcggccctggcagaacagcctcgtattctggcccgcaacactgccggccagctgcagcagtcagataaaccttagctgcaggcaggctgtagctacctgtcggccttaggcacatcctggtgctgggctggtctcatggcatgaattctgggggtgtgactcaatattgtctcagcctcagtggccataggggtacccgtgtaccccctcccccaacccagcacagctgtgtgaagagagacactgtttgcttgggggaagaagaggtaagtggagtacttcgccttggaacccagtgtgtccgaaattggtgggtgcttggtctcactgacttcaagaatgaagccgtggaccctcgcagtgagtgttacagtttttaaagggggcatgtccgcagtttattccttctgatgttcggatgtgttcggagtttcttccttctggtgggtttgtggtctcgctagctcaggagtgaagctgcagaccttcgcggtgagtgttacagctcctaatacggcgcatctggagatgtccgttcctcccggtgggttcgtggtgtcgctggcttcaggagcgaagctgcggaccttcacggtgagtgttacagctcttaaggcagcgcgtctggagttgttagtccctcctggttggtttgtggtcttgctggcttcaggagtgaagctacagaccttcgcggtgagtgttacagttcataaaggcagtgtggacccaaagagtgagcagtagcaagacttacagcaaagaatgaaacaacaaagcttccacagcatggaaggaaacctgaccaggttgccactgctggctcgggcagcctgcttttattctcttatctggccccacccacatcctgctgattggtccattttatagacagccaattggtctgttttacagagagctgattggtccgttttgacagggtgctgatgggtgtgtttacaatccctgagctagacacaaaacgtctccacgtccccactagattagctagatacagagtgtggacacaaaggttctccaagtccccaccagagtagctagattcagagggtcgactggtgcattcacaaaccctgagctagacacagggtgctgattggtgtgtttacaaaccttgagctagatacagagtgccgatcggtatatttacaatcccttagctagacataaagattctccaagtccccaccagactcaggagcccagctggcttcacccagtggatcccacacctgggccgcaggtggagctgcctgccagtcccgtgccgtgcgcccgcactcctcagcccttgggtggtcgatgggactcggcggcgtggagccgggagcggcgctggtcggggaggcttggtccgcacaggagcccatggctgcggggtggggaggctcaggcatggcgggctacaggtcccgagccctgccctgccaggaggcagctaaggcccggcgagaaatcgagcacagcagctgctggcccaagtgctaagccccttactgcctggggcttgcaggccggccggctggccgctccgagtgcgggcccgccgagcccacgcccactcggaactcgcgctggcccacaagcaccgcgtgcagccccagttcccgcccctgcctctccctccacacctccccgcaagctaagggagcccactccagcctcggccagcccaggaaggggctcccacagtgcagcggtgggctgaagggctcctcaagcgtggccagagtgggcgccaaggccgaggaggcaccgagagcgagcgagggctgtgatggctgccagcacgctgtcacctgtcaccaggactaggctcactacagtaaaacccagtactgggcagagcctcatcaccctgatactagaccagtacccacaggcagatctcaccccaccctagtgccagatgagaacccacagccccagtaacagggactggcgatctggcccacatcactacctgacaactacagtggccctgggccctgaataacttcagcagcagcaagcacgccatcacagctgtgggtcttgggcgtgccccagtgctgtgccagtctcggcagctatggccttcaggcataacccagggctgtgtcagcctcagtggccaaagaattccaaccacagtgatgctgggcttagagcaccccccagcactacaacagctgaagcagtcatgggcttagggtcctgaccaatcagcctctccctaatctcctatgggtttcctgatgaaagacgagcccaaacaaagccaggcaatgaagactggcttaggtacctatgtcaatgcacagacattgacacacagccataaggatcaaggtcaatcagagaaacatgacatcaccaaatgaacaaattaaggtgccagtgactaaccctaaagatatagagatgaggcctggcatggtggctcaggcctgtaatcccagcagtttgggaggctgaggtgggaggatcacttgagcccaggagttcaagactagcccgggcaacatactgagaccccatctctacaaaaaaataccaaaaaaatttagacggtcatagtggtgcacgcctgtggccccaaatactgagaagggtgaaggaggaggatcacttgaggccaggagtttgaggctgcactgaactatgattgtgccactgcactccagcctgggcaacaaatgagaccttgtatctaaataaataaataagatgaaataaaataataataatgggtaacatcgaagcactatttcttataaaaggtgaaagccttttatatgtactgtcttatttatccttacacagccatgtgaattaattactgttatattgccatttgacagatgagaaaactgagatacaaagaagtaagtgcatttcccactggcaagtgatgggccagatgtagacaagctggacggggtttaagtccagctaacatgctgctcagagtgaggaataaactcaaccaaatcattggtgggaatgtaaattagtagagccattatggaaaacagtatggagattccttaaaaacctaaaaatagatataccacatgatctagtaatgccactgctgaatatatatccaaaggaaagggaatcagtatgttgaagagatatttgcactctcatgtttactgcagcactgctcataatacccgagatacggaatcaacctaagtgtctatcaaaagaggaatggataaagaacatgtggactatatacacaaaatgggatgttattcagccattacaagagaatgaaatcctgtaattcccatcaacatggatgagcctggagtacattacgttaagtggaataacctaggcacagaaagataaataccacatgttcacactcatatgtgaaagctcaaaaagcttatctcctagaaatagagaatagaaagccaggcatggcagttcacacctgcaatcccagcactttggttggctgaggcaagaggatagcttgaagccaggagttcaagaccagtctaggcaacatagcatgttgcctaaataaaataaaaaatattttattttctaaaaataaaaataaaattagcctagcatggtggcatgtacttgtggtcccagctacttgggagactgaggcaggagaatcagttgagcccaggaatttgaggccacagtgagttatgatcgtgccacggcactccagcctgggcaacagggcaagaccctgtctccttttttttttttgagatggaatttcactctttttacccaggctggagtgcagtggtacaatctcagctcactgcaacctctgcctcccgagttcaagcacttcccctgccttagtgtcccaaatagctggaactacaggcatgtgccaccacgcatggctaatttttgtatttttagtagagacggggtttcaccatgttggccaggctggtcttgaactcctgacctcaggtgatccacccatctcggcctcccaaagtgctgggattacaggcatgagccaccgcgcccagcctggaatatattcttaaattcatgttggatggctcagataacaacaacctctttttcttagtaaatattgactttcaatagttataaacagttgttcttcttacaaggcccagcctaggaggactcaactgaaatgatgacagcagacaattccatcagcaagaaagaggattttgagctcatcattgagggaaagctgatgaaagagagcagagaggttccaggctgcattttccaagatgttgtcctcttctccgccaagacctcccagatacttcagtaggatatagcagtaaaacctcatggagcagatcatttgagcaggctcggtcccaaagggaaacaaaatacagcagcctttcagggtagatcacactggggagacagggaggcggggcagcaaggaaaggaaagtgaagcttaaaaggtctaaggaggatggggagggcaaggcgagcagagagaccgcagctgaagttagcaggggcaataagcatccaccagagaaaacagcctgggcggattccaaggaaggggattttcaaactcaactgctgactcaaaaaaagacccccaggccaggcgcggggtctttgtttgagactctgtctcaaacaaaacaaaacaaaaatcccaaatactaaactaacttagctcccaccctacctgaatttttttttttttttttggttcacgttctctcatgatcttcccgaaatgttatccttaagcttcggggagaggtgagcaacggaaggaactggcccaggcccaccactaaagaagccccaggaccaatcggggtcctcagagaagccccagaagagccaggaacaagctgcagaaaacctggggagggtggggcctccacccaatactccactcacaactggactctctgccaggaaagccaactccaacatttagatgccctaaaaggaacaaaattaacctgccaggaacatgattcaagcagcctcggtgtcttccgacccaccccatcatggcaaccacaattgtagaccgcagtctcgatgacgtgttcacattattttgcatttcttttttctttttttatttttatttttatttttgagacggagtctccctctgtcgcccaggctggagtgcagtggcccgatcttggctcactgcaagctccgcctcccaggttcacgccattctcctgcctcagcctcccgagtagttgggactacaggcgcctgccgccacgcccagctaatattttttatttttagtagatgggtttgcaccgtgttagctaggatggtcttgatctcctgacctcgtgatccacctgcctcggcctcccaaattgctgggattacaggcgtgagccaccgcgcccggcctattttgcatttcttgagtaatcgtaatatgcgggttagaacacacggattacaacactttggatgaaaaaccacataatagggaaattttgggactactctctctcaaaaaaaaaaacagctcgtggaaaaactaggacttaccttctttgaaactatgtttatgttaagcattttcccctttgtaagctcatcattgtgtaaaagtgtcagaactgtgcaacacattttttaacagtccaaaagcaagttctttgataaatcaatatgaagccgtgcacctgtgttactctccctcccgttttgttcctgcgaacacatcggtaacctgcattcactctccatccaactctgttcaataccagaaagaaacttcagatgaaatgcttttcagtatttgccttgttttctggaacaactttaaagtacaaattatacctaaataagtacaaattaaagcctctgctttaattttcaaacactttgaacccagattttcaggggtctcaaaatggagttttgtgtttaaaagtctaaatttagctttcttccaaggaaaagggtgtgaagaagagaggttaagactaaaatactctgatttgcagagtttgacaacatccttccaatttctcaatatgaatgcccactgacccagccattccacttctaggaattttccaccgatatatttgtatgaatgtatacataaaattatattcattgccgtatctgtgccagtaaaaactggaaacaacctaaatctccatgcattgtttaaacaatgtacttcccataccatgtatcaggtttttttgtttgtttgtttgagacagtttcgctctgtcgcccaggctggagtgcaacggtgcgatctcggctcaccgcaacctccgctcccgggttcaagcgattctcctgcctcagcctcccgagtagctgggattacaggcatgcgccaccacgccaggctaattttgtatttttagtagagacggggtttctccatgtctgtaactcctgacctcaggtgatcctccctcctcgatctcccaaagtgctgggattacaggcgtgagccaccgtacccggccgaatcagttttttgttttatttttaatgccattaacacatctatatgtcctgccatgaaaagatgtccataatatactcagtggacaaagcaagttcgaaatgattttaaagacttgtacatagaaacatttctgataaggtacaaacaaaaatgatactgagtggaagactgcgagacacatttgtctgcattgtttgaatttttttacaagcttacaacacttctgcaatttctttttttgttttaattaaacacaaagtcatgtcaaaagtccaaataactatattagcttagaaaaaaattcactggcccaaaatatatgcacgtagtaaatacagatcactatcataatttgcagagcacaattattacttaattccttaattatctgactggcataggagcagagttggatgtctgtgctagaaagaaaacttccaaaatgagccccgaacttgcctcaagcgccatgcaagcgtccagcctccgctgctgagttccacgtcgggactgagccggggaccgagctgggaccgaagttccgctccgggcccgccttggtctggccccgcgctcgtggcaccccgcccagctttcgttttccactgaatggaaagcgaaacttacagcggcctccgcgccgggagctgggcgccagcgtgcggggaaaccctgccggcccgagcttcccgcggctgccgttgcagccgcgcacctgctccagacttccagccctcgctttttttttttttttttttttttgagacggagtctcattctgtcgtccaggctggagtgcggttgcgctgtctcggttcactgcaaactccgcctcctgggttcaagcgattctcctgcctcaggctccggagtagctgggattacaggcatgcgccaccactcctggctaatttttgtattttagtagcgatggggttccgccatgctggccaggctggtctcaggtgatccgcccgcctcctaaagtgctgggattacaggtgtgggccaccgcgcccgacctacaggcgcctttttatttgcgattttaaggtccttgcaattagcctacgtgttagagtcatttggcgtttggtagtatccatggcagcattttttctttcttaatgctattgtatttcttggatcgggtgtcttcacatcaccggcctgtggcttggatgcggcacatggtgtaattaggagctcccctgtgggcatgcagatacagatatttctccacttaagaaggggtcagggggcgcggtggctcacacctgtaatcccagcactttgggatgctgaggcaggcggatcacctgaggtcaggagttcgagaccagcctgaccaacatagtgaaaccccatctctactaaaagtacaaaaattagctcggcgtggtggcgcttaatcccagctacttaagaggctgaggcaggagaataacttgaacccaagaagcggaggttgcagtgagcagagatcgacaagagcaagactccgtctaaaaaaaaaaaaaaaaaatggggtcaagtcccagtgaacccatcatgaagtcgaaacatcgtaagtgaaaccacggtaagtgatggaccatctgtgtatatataaggttaagagatctgtaacatgcacaccggaaaggcttattacctctttagagatgtatttcttgtatgtagactcatgggggtaggggcagaagggttatctgctaggggcctcaaactccagccgctggaatttgcgcaggaaagcagggtacaattcccccaaagcgatcattctttctgaaagccgtccccgcagcaacagacaaatagcctccaaaaacccaaagctgccagaacctcactgaagcgttggtagggtctgcagtaaggtacaaaataccatggcatgaagatgtataaacgtgtccataatagggtggatgtgtgttagaagcatgagcacagatatacacatacaggctatccacacgtccatcgtcagcccagactccgcttacattgctgctggaacggaggcagtgtcgcccacagtgcagcatgttctccctggaaggctggtggactttgcgcagtatggtgtttacacaggtacacggtggtgggcgcagggtccgtcctcattatatttgctgaccaatcagttatataaccagcttcatacatctggtaagtcttgtccacaaacaggaacctcaaaaactcaagtgagggcaatgaggagaggaggttgcaaaatttgataaaatatgctaaatacagcaagtcagtagaaggctaaggagcaagctgcagttgcttgcagcaactatcagcagaaaactattaatagtcaatccaatgattctatctgaatcttggtaggtcggtggagcaaagtaattggtgttgctgccccagtgcagaatggacaagggtgaaccttgggttggaggctggactatataatgtaaggatccattacacttctatggggctcttccttccgtccttcatggtaccctcctgaacaattccgtgctaaggccatcaggtgtgtcaagcaaagtgggcgtttgtgtagtatgttccacagtggcccaagcagggtgctggactggagcaggttgaggagggtggcagcacagtggggctgcccagcacaatgtcagacacaaatgggtgctggtgcagcccggcccagggtcacagcccaagcaatttgaagatgtggcacatcccggtattggagtggcccagtgtgtggtgtccagggagggcagggtgctggtggagatgacagattagttacatacagggggatgaccaggtaactgaatgtattaaggataattggagccagagttgaaactctcagagataggagttacaaataaggaaagggagaatgagcccactagtgttgaactggaattggacttagcagtgtggatccatgattttcagtatgtatacacagatagataaagaagtacaaggcgggtggatcacgaggtcaggagattgagaccaccgtggctaacacggtgaaaccccgtctttactaaaaatacaaaaaattagctgggtgtggtggcacacgcctgtagtcccagctactcggaaggctgaggcaggataatcatttgaacccgggaggcagaggttgcagtgagccaagattgcatcattgcactccagcctggcgacacagcgagatcccctatcaaaaaaaaaaaaaaaaaaaaaaaaaaaaaagaagtacatgtggaggtaaacatgtgtatacatgcatacatcccctgacttggtctgtagggggcctgggaacagtgacaccccaacagtacatcttgcacccagatcttggtttctaattcccattctctagtaaaaggaaccaatgttgcttggagaaatggctgtttctggggttaaggcagagaaagtacaagatgagcctaggacatcttgttctgccagcaagtaagggaatgctccaagaatgatggggatgtttcaaaacgatgcagaagccagctccaagaccatgctcccactggccaaatttggaacaacttgagcattaaaagaaatgatgatttgttctgttttgtttttgtttttgagacggagtctcgctctgttgcccaggctggagtgcagtggcactatcttggctcactgcaagctccgcctcctgggttcacaccattctcctgcctcagcctcccgagtagctgggactacaggcacccgccaccacgcccagctaattttttgtatttttagtagagacggggtttcaccgtgttagccaggatggtctcgatctcctgaccttgtgatcctcctgcctcggcctcccaaagtgctgggattacaggcatgagccaccgcgcctggcctgaaatgatgatagtaacatttcgacctgttaaataaaatgggaagccacacttcataccaataaaagtagatactgaataaattaaaagtttgatgagaaacaggatatttacacagtttcaaagtactctcccacaaaatacatattattaattaccattattacatacatgtgatacaggttcattctgcccgcatgccataaatccatcactgtgacaggttttgcaaaagagaaaagatttattcgcaaggcagcccagtgaggaggcaggagaacagctctcaaatcttcctccccaaagataagtcttagggatatttaccggtgagagaagcagggtggtgtaaggtatgggcaaaggtgattggcagtgggggaaaatgaggcagtcggtgaccactgcaagcatagtcagggttcgtggcacttcacagggcacatgttcaaaaaatgacagccttagcgtgatctgagggtgtcgcttggggcctctgatgtcaaaaggccacttcttttgtttgcacaagcctacttgaaagctcacggtctcaactggtttgaactaggcaggagctgccccaagttcctgaaaaacaatttgaacgatcatgacagtagtgacatacatgttatctgtaaggaagccggcaaggttaagttacagcgctcagtggcgcggccttcagcttcacagaaaaaaaataacaaaagcaagtgacccaaagcaagcagggcaggctaaattgggcagacctaatcagatgaaccccatggtctcatatgtaatattacattataactataaagaatgtaattaatgtaaatattcagtacaagaaagtcatcagtgcggggaacactggaattgcgtgccaccagaggacagagtggagccagcgcggtatcacttctgtgctgttcccatcgaaggtcagtaaccggaaccccttcgccaggacgcgggtcctggccaacccaaatcgaggggcattctgcagatcagctggtctgccatcttcaaacgattcatgaaaatcaaagacagctttgaggaacggctccagactggcagagaccaaagaggtcatagatgaacaggagatccccaactggatcctttggctgtaaaggacaatattggcacaacgggtgaagcttgaatggggtctgaggattaggtggtagtaacttcacaggcggggatttgggagaaatgcaatgtcacgtggaaaactgactctcaaatagttcaagaaggaagttctttggactatacttgcaacttttctgtaggcttaatactgtttcacaattttaaaatgtaaaataatagtaccaggtagtagttttttattaagacagattgtgctttttgaaagcattggtggaaagatttctcaaaatcatgcgcgaaagagtttataatgaaattgtgtaatatttgtttcaaaagaaagtgtgggccctgagaagcattttctgtagtttacacagtatttctgccaatttgggatactttcagtgtccctggaattctcatcatctgaatttcttactctttttccctttaaaaaaaaataaaataaagaagtatgaggcaaaaggccacacctacctacctcactttaaaattctgtctaaaaacctggtcacagaggaagatgttggctaactttaatgcgataatctagttcccctcaaaatggaaagctatttagaaaaaagctatttgcccaacgtgaggaacaatttatagaaactgacaagaatttttgtcctggggaaaggacagggtttgttgcatgggataaggggaagtgatgtggccgggcatgatggctcacgcctgtaatcccagcactttgggaggccgaggcaggtggatcgtgaggtcaagagatcgagaccatcctggccaacatagtgaaacctcgtctctactaaaaatacaaaaattagctagatatggtggtgtgtgcacctgtagaaccagctactcgggaggctgaggcaggagaatcgcttgaacctgggaggcggaggttgcagtgaaccgagatcgctccactgctctccagtctggcgacagagcaagagtctgtctcaaaaaaaaaaaagcaagtgattttttttaaaaaaagaaaacagaaccgatgtctgaaaaagtagtactcctttacaaaacacattctctacaaacgcgtggtttcatgtgacctctgctcagtccctttccacaactttctcctgcctattttcttctctgcattttgtcaggatgctttttattgtaaattttactgtgttttgcatgcttccaaatataaaaaataatttttaagatgaattaaacattgaacctccctctcagtattgttttgggaacatgcattctcctgaggagagggagctgttgagtggaagcagtcaaacagaactccacatttcattttcctggcatgggtttcagggtgcaactcaaacagaatgtgacttggcatctgtcacctttcccaggcactccctatcctctggcaatttgttgccttaatggagaaccattcaaaattaaatattttatattagaaaagaaatgttaaacataaagaaaagttatacaaatattataacaacctagtgagccttccttcactaattttctctctcatacacacacatctatgtgtatgtgtgagtacacagtatatatgtgtatatatttacacaatcactttttttcttttgctggactacttgagagtaaattgaagagattgacattcttcagctctaaataattcaatatgaacctcataggatcaaagatgttttcatacataaccccagtgcaattattaccaaattcagataatttcatatccgtacaattttcccatatataatatattcaatatttaaattttgacagttatcccagtattgtttatacagcaactgttttcctttgtttcttatttttatagatacatagtaattgtacatatttatgtgttacatgtgatactttgatacatgcatacaatgtgcaatgatcaaatcagggtaatgaaggtattcatcacctcaaacgtttattatttctttgtactgggaacattccaaatcttctcttctagctattttgaaatatacaataaattattgttaactattatcactgtacagtactatcattccctctatctaactatctttgtacccataaccaacacttttcatccttccctccctcctattgcttgccagcctctggtagtcatcattctactctccacctccctgaaatcaacgtttttagctcccacataggagtgagaaggtgggatatgtatctttctgtgcctagcttatttcacttaacgtaatgtcctctggtttcatccatgttgctacaaccgacgggatttcattctttttatgactaaatagtattccactgtgtatatgtagtacatttttttttttttgagacaaagtctcgctctgtcacccaggctggagtgcagtagcgtgatcttggctcactgcaagctccgcctcccgggttcacgccattctcctgcctcagcctcccgagtagctgggactacaggcacccgccaccacgcccggctaattttttgtatttttagtagagacaggttttcaccgtgttagccaggatggtctcgatctcctgacctcatgattcgcctgcctcggcctcccaaagtgctgggattacaggcgtgagccaccgcgcccggccttatctagcatgttttttatccattcatctgttgatggacacttggattgattccatatcttggctattgtgactagtcctgcagtaaacatgggagtgcagatatctcttcaatatactgatttgctttcttttgggtgtatacccagcagtgggattgctagatcatatggtagttctagtttcaattttttgagaaacctccatactgttttccacaatggttgtacgaattttcatttccaccaacagtgtacgagggtttccttttctccacatcctccccaaaatttgttattttctgtcttttgataatagccattttaactgaggtgagatgatacctattaatgtggtttcagttgcatttctctgatgcttagtgatgttgagcatttacttatatacctgatggccattagtatgtcttcttttgagaaaatgaaaatctttttcagattatttgccctatttttgttttgttttgtttttgagatggagtcttgctctgtcacccaggctggagtgcagtgggacgtctcggctcactgcaacctctgcctcctggttcacgccattctcctgcctcagcctcccgagtagctgcaactacaggcgaccaccaccacacccggctaattttttgtatttttagtagagatggggtttcaccgtgttagctaggatggtatcgatctcctgacctcgtgatccgcccgcctcagcctcccagagtgctgggattacatgcctgagccaccacacccggcccatttgcccatttttaatcagattgtttccttactattgagttatttgaggttcttatacagtttatatataggtaactaatcctttgtcagatgcaagttcgcaaatattttcccattctgtaggttgtcccttccctgttatttcctttgctgtaaagaagcgtagacgattcttttttttcccctcccccttcccagcttagaagatttctgacaagtgtagtgaaatcaacaactgctctgcaagaatcagattccagggcaggcacagtggcccatgcccataatcccggcactttgggaggccaaggcgggtggagcacctgaggtcaggagttcaagatcaacctggccaacatggtgaaatcccatctctactaaaaatacaaaaaaaaaaaaaattagctgggcacagtggtgaatgcctgtaatcctagccacttgggaagctgaggcaagagaatcgcttgaacccaggaggcagaggttgcagtaagctgagattgtactgtgtctggaattggttccttctggtgggttcctggtctcgctgacttcaagaatgaagctgggaccctcgcagtgagtgttgcagttcttaaagctggtgtgtctggcgtttgttccttcagatgttcacaggtacctggagtttcttccttctggtgggttcgtggtctcactgacttcaggagtaaagtcgcagaccttcgcagtgagtgttacagctcttaaaggtggcacgttgggagttgtttgttcctccggggggttcgtggtattgctgacttgaggagtgaagctgcagaccttcacgctgagtgttacagctcataaaggtagtacagacccaaaaaatgagcaacagcaagatttactgcaaagagcaaaagaacaaagcctccacagcatgtaagagtaccccagcgggttgcccccgctggcgcaggtggccagcttttattcccttatttggccccacccacatcctgctgattggtccattttacagagcgctgattggtccatttttacagagtgctgattggtgcctttacaaacctttagctaacacagagtgctgattggtgtgtttttacagagtgctgattggtgtgtttacaaacctttagctagacacagagcactgattggtgcatttacaatcctttagctagacagaaaagttctccaggtccccacctgattagctagacacagagcgccgattggtgcgtttttacagagtgctgattggtgtgtttacaaacctttagctagtcacagagcgctgattggtgcatttacaatcctttttagctagacagaaaagttctccaagtccccacccgacccagaagcccagctggctttgcctctcagtaccactgctctccagcctgggcgacagagcaagactccgtctcaaaaaaaaaaaaatagcactaaaagaaacttattaaaaaagaaaaacattgtcaggtcaggctaaaggttaaagaggaaaaaaaatcacagggtagggtcaaagagtggcgataacagagaagagagtcatgagacttgaaattaaataatagaaattactcaatattaactgcagagagaaaatagactgaaaaaaattagcagagcctcagtaacctgtgggactgtgatgaaagatttaacatcatgtcatcaaagtccccccaaaaaagagaaaaaagcatgaagctgaaaaatattcaaagatatgatggctcaagattttccaaaaattgcaaaagacatagcctaaaccgaataaactcctaacaagtctgaggcaatctatatcaatatatatatcataatcaaacgcctgaaaactaaaggcaaagaaaaaagtattaaaaacagcaagacagaaattctaccatatttataagggaaaagcaattttttttttttttgagatggagtctcgctcttttgtcaggctggagtgcagtggtgcaatctcggctcactgccacctctgcctcccgagttcaagcgattctcctccctcagcctccagagtagctgggactacaggcgcgcaccaccatgcccagctaatttttgtatttttagtagagacagggtttcactgcgttggccaggatggtctcaatctcttgatctcatgatccgcccacctcggcctcccaaagtgctgggattacaggcgtgagccaccgcgccctgccaggaaaagcaatttttaaatgacggcatatttctcctccgaaatcacagagaccagaaggaagtgacacagtattttccaagtgctgaaagaaaagcagtgtcaatcgagaattctattatccagtgaaaacagccttcaaaaatggaagggatatcagggcaatctcagatgaagaactactaagaatttgtcaccagcagacctaccattaaaaaaatggctaaaggaaattcttgaaatagaaaggaaatgataagtcttagaacatcagggaggaacacagaacaacagaaagagtaaaaatatagataaatacactagacatttcttctgctgagttttcgagagtatctttgtccaagcaaaaattttaacattgtctaacatggttattgaagtatgtagaagaatcattaagataattgtaagtgagagagggtaaaatgacttaaaagaattgtaaggtttctatgcttcagtcaaactggtaaaatgtcaacactagtagactgagatatcaatataatgtaatatgtagagcagctattaaataatttacacaaagagatacacactaaatcactagacatatcaaaatggaattctaaaaaggtgctagtaacccaaaggaaagtacgaaaaagaaaacagagaaaccaagaacagaggaaacaaagataacaaaaaaattctatggaagacctaagacttaatatacaggtaattacattaaatataaacagtctaaatacactaataaaaagatagattagtgagtgaaacaagccaggcacacaaagtcaaatatcacctgttttcactcataagtgggtgctaaaaaatgtgtacacatgaagacagagattggggtgacagacaatgaagacttggaagggtgaaggagtatgagggggtcatatgataggtaattcctaattgggtacaatgcgcattatttgggtaatggataccctaaaagccctgacttgaccactatgtaatctatgcatataacaaaactgcatacggccgggctcagtggctcacgcctgtaatcccagcactttgggaggctgaggtgtgtagatcacttgaggtccagagttcaagaccaggtgggccaacatggtgaaaccccatctctactaaaaatacaaaaattagctgggcatcgtggcaggtggctgtaatcccagctactcaggaggctgaggcaggagaatcacttgaacccaggaggtgaaggttgtagtgagctgagattgctccactgcactccagcctgggtgacagagtgagactccatctctaaataaataaatcagcaggtatttataaacataggccagataatgtcacttctctgctcacaaccttccactggtaccacatctcacagcaaatggaagccaaaggccttacaatattagcaacagccccagctttcaggccacaaaattcatcttgaaactgtagcctactgagtattcttaacgtaaacatttccttaatataaagcagtatatattcgctgtagaaaaactgaaaaatataaaacatgtaaagggggaaattacttataattccacagtctaaaatagccactacactggtttttttaatatatatatctttttgtaaatctagtttttacaatttaatgatactgaggcaaacaaatttgccacatccataaaaattttgaaatcaaatagaaataaaataataaaaagacagattggcagagtaggtgttttttgtttgtttgtttctgtttgtttttttaaaaaatagaaccaacagcaagcatagtggctcacactggacgctgaggtaggagggagcccaggagttggagaccaacttgggcaaccatagcaatgtagcaggacgagccgcagacaaaactcagacaccgagttaaataaggaaggggtttattcggcggggggcattggcaagactcctgtctcaagagcagagctctccgagtgagcaattcctgtaccttttaagcgctcacaactctacgggggtgcgcgtgagagggtcttgatcgattgagcaagcagggggtacgtgactgggggctgcatgcaccggtaattagatgggaacaaaacaggatagggatttccacactgcttttctatacaatgtctgtaatctatagataatataaccgattaggtcaggggtcgatctttaactaccaggcccagggtgtgatgccgggctgtctgcttgtggatttcatttctgccttttagtttttactttttctttctttggaggcagaaattgggcataagacaatatgaggggtggtctcctcccttagcaagacttggtccctacacatttttttttttttttttttttttttttttttgagacggagtctcgctctgtcgcccaggctggagtgcagtggcaccatcccggctcactgcaagctccgcctcctgggttcacgcctttctcctgcctcagcctcccgagtagctgggactacaggcgcccgccaccatgcccggctaattttttgtatttttagtagagacggggtttcactgtgttagccaggatggtctcgatctcctgacctcgtgatctgcccacctcggcctcccaaagtgctgggattacaggcttgagccaccgtgcccggcctgcattttttaagtaaataatttttcctctttaggcctcatctggtttattttttattttttgtaagatttaaactcagacttaaacatttaattttatccatgtgtgcatatgaacctcttccattacttccaacaggtcagcattgtgtaaactacacttcagttataaaccttgttttgagcagccaggttgcagcccatacaatgttcccagtgaggacttcctcctacctatttccctccatctctgagcgagcgtggacttgctgcacgggggggtgcacacttcatgctctatgtgctgagggacttccctccggatccgaccttgttaatatcccagttgtgagtgagagcttctgaagctccacaggttaactggaaattaaattgcagcgttagttgtctcctcagaactcactggtttcatgcctcactcagaagtaactgcacaattccagggcgtccacaggaacctacaggttttgcctacccctgcccgcgactggctgatctccaaaccctctccctggcttcccgctggctgctcctgccactcccgtcgtgttccgccccaagcccctttgctttgctctctgctcctccaggcggttcctcccacacagacgtgctgggctccacaggggcgccttttgcctcaggtggatcagaacatgtgttcgtgtgactctttttttttgttttgttttgtttttgtttttgtttttgttttttgagacaagtctcgctctgtcgcccaggctagagtgcagtggcgcgatctccgctcactgcaagctccgcctcccgggttcacgccattctcctgcctcagcctcccgagtagctgggactacaggcgcccgccaccacgcccggctaattttttgtattttttagtagagacggggtttcaccgtgttagcccggattgtctcgatctcctgacctcgtgatctgcccgcctcggcctcccaaagtgctgggattacaggggtgagccaccgcacctggccaatttttttttttaatttagccaggtgtggtggcagacacctgtagccccagctacttaggaaaatgaggcaggaggattgcttgaggccaggagctcaaggcttcagtgatctgattgtgccactgcactccaggc

SEQ ID NO: 6862 - DNA, 41206 bp, Homo sapiens
ttttgtggaaaataactttattcatgactgtgtttatcacactatcttatggagaagagatgatcaataaatatttgctgaataaatgaatagcagttacaaaacacttgattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtcttgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcattgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaaccttcatcagaaaacaatgcttcattaatccgtgacaggacaagcgtcagcaaacttccaggcggctggattaggccttcatctatccatcaccttggagaggaacaaaataggtggcctgggaagataagcactatgtttctattagttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgtgagccaccgtgcccagccttttgtttattttttgacgagaccgttcttgctctgtcaccaggctggagtgcactggcacaataatagctcaccacagcctcgtgctcctgggctcaactgaccctcctgcctcagttttagcttcctgagtagctaggactatggatgtgtaccaccatgcctagctataataatttttatttttttgtagagatggagtcttgctttgttgcccaggctggtcttgaactcctggcttgaagtgatcctcctgcctcggcctcccaaattgccgggattaaaggtgggagatcgcacccagtctccaaccctctttttgcaagtaaatgtaactggaccccagccatgctcatctgcccatgtactgtctacggctgcttttgctctacagggcagagttaagtggttgcaacagacaccgcacagaccacaaagtctgaagtactttctctccagccctttacagagaaagtctgccaacctctgatctcaataacagggaaatcaatgacaaccacaaagtgacaaagattgggtgtctaagatggatgttcagaataaacaagagagaaagatgaaaagtagaaggaggatttcaaacgcaagcttcacctaatccattatttttcaaatgaccaggcctatctctgtagctgaaaatcacctcaaataggatctctgatatacagtctccaaaagctcagctaagaaacttacaaagtctctctgccttaacttcatccaccttttttctctccagcttctcctcggtagttaatgattataaaaatatttattggctcatgcctgtaatcccagcactttgagaggccgaggtgggcggatcacgaggtcaggagatcgagaccatcctggctaacacggtgaaaccccatctctactaaaaatacaaaaaattagccaggcgtggtggcgggcgcctgtaatcccagctactcaggaggctgaggcaggagaatggcatgaacccacgaggcagagcttgcaatgagctgagatcctgctactgcactccagcctgggtgacagagcaagactccatctcaaaacaaacaaacaaacaaacaaaaaaacagtgtgatggccaggcgcagtgttcatgcctataatccaagcactttggcaggctgaaatggatggatggcttgagcccagcagtttgagacaagcctggcaacatagcgagacctcatctctacaaacatttttttaaaatatgccaagcatggtgtacagactgtatgcctgtagtcccagctattcaggaggctgaggtgggaggatcacctgtgcccaggagttcaaggctgcagtgagctatgatcacaccacagtgctccagcctgggcaacaaagcaagactccatctctaaaaataaaattaaattaaaaaaaagatcttcgctgtaaaagaggtatgctcaaatgcaataaaagcatataagaaggccaggtgtggtggctcatgcctgtaatcccagcactttgggaggctgaggcaggtggatcatgaggtcaagagactgagaccatcctggccaacatggtgaaacaccgtctctactaaaaatacaaaaaacaatcagctgggcgtggtggcacacacctgtagtcccagctactcaggaggctgaggcaggagaatcgcttgaacctgggaggaggagccaagtgtagtagccaagattgtgccactacactccagcccggcaacagagcgagactccgtcaaaaaaaaaaaaagaaaagaaaagaaaagaaaaccatacaagaagcccctacgaatctgggtgaatcagcaaaggcttcacaggataggaaaaggccatgagtatgaaaacatgagtggggagttggcctagatggtaaacgaggagaggacaatacggccaggaagtgcatgtgcacagcagacgggagatggagggcacggctgattggcagctacctgtactttaatattcctggagtgtgacgtgtgaggcaaacatggggtggtggggtgagtgctggagatgaggcggacagtgagccatcagcatgttagtaacaggggaatccatgggcgtttcatgcagctccaaggaccctatgtgagctcatcagactccaattacccaaatctgtttcttaccagtggtagttaggatttccgtaggtacactggatgtcttcccaggacacctggaagccagaaacaaatggggtcaagcagccagctgacacaagcacccacagaggacaggatgctataatgtgcccctcatcctccagacaagcccacccctagcaactcccaagagcctggagcaacagcagcaggatgtcttgtgcaatgaagtatgtttagtgcccttgtccctgtgtttaaacttggtcatgcttatcccagaggcctaacttacatatttctaacactcgttgctctctagacatttcccacaaagcaggaagctgcagagcatgagcctagagcaccaaaaacttagaagtgaagtgaattgaacccttacagaggtgcaaaccacatggggacttcagaccgaaaaaggcttgaaccctcatcaaaggccccacacccagacagcaggatcacagtgtgtcttgatctcagagacccacgcagccctgagcccagcatttgctagaggtggccaatccagggcaggaggcaattgtggatgatgtttcttaccaagcaaatattggagtcattgaagcagaaccattttccatccacagcattccggatgtagacacagtaatgaccggagtctgccattcccacgtgcgcaatcacagcaaaaagctcatactgccctccagactggaaagagacaggcacgagacagttcacccaccaccacaaacacgactgcctcacacatttatacctgcccacactaggcccgactctgggactttagaatattagaaaacagtcccgacccacagccagtgggcaccctccaggaggggctttcccgagtgtggatcctgaactgcgaaggctcagcagcttggcagggcagagcacgcaagagatggaaggcaggtcatgagagaggcccccaaagccaaggcaagattagaactttcccctgggaggggtggggatcatcagaacacagttctgtttctccacaagcccaggaatgaccctaacctgagccaccgtacccagccaaaaaagtcttttgtagggggaggggagacagagggcaagggcggcagacgcaaagctgagtcacccacagtggaggctgaaattatccctatttccatttgcagactttgtgcagaactttacaaaatgcagggcaatatctgtatctaaatattagtttacaagaaataaaagggttacaggaacatgttaaaagatatcaaccagccagtgctggcatatgaaaaaaatattcaaccaaatcaactgcaaggaaaagaaaaggagcggaaatctaaaaggaactcaagaaaagaaagaaacttaaccaaatgcaagtgtaggcgttgtttggatctagagtcaaacaaaccacatagattacacaacagtcaggaagtctgaacgttgaccagatatttgatgctattaaggaattgcaagatggagatgattatcttttgagtgcttattctttagggatacataatgaagtgtttataaatgaaatagtatgatgtctgggatttgcttcaaaaaaatccagtacagggttgggtgaaacaagagggtgggttataggaaaagcaagacctgccatgagttttggtaactgttacagccaaggattcactgtctaactcttccttcactacacactttggtatctatttgtaatgttccataacaaagtcttttttgttgttgttgcaaagatggagtcttgctttgttgtccagctgggctcgactcctggactccagcaatcctcttggcctcccaaagagctgagattacaggcgtgacccactgcatccagtcaaaaaagtcttttttaagtgaaaaacaattttaaatacacttcattgggcagaatctgcaggtagaaataaaaagaactagaaggaaagaaaaagagaatcctatgaaatgtatacggcctaagtaggtaaagaaatcatgttataataggagctattgtaacatattatcaggtcttaattttctaaatgtcatggttctagagcataaatagccaaacagaccaataaaacagaagagacactccaaaaatagacccgtacatacaggaatacaaaatttgttatgtagcatttcaaatctatggaaaaaaagatatttgtgtcttttttttttagtttttcttgttttgtttttagagacggggtcttgcgctgttgcccaggctggagtacaatgatagatcatagctcactgcagcctcaaactcctgggctcaagtgatcctccaactcagcctcccaagtagctgggactaaaggtttgtgctaccacacccagctaatttttttttttttttttgagagacgggggtctcattatgttgctgaagctggtctcgaactcctgggctcaagcaatcctcctgcctcagccttttgaggtgtgggatcacaggcatgagccacatcacctggccttgtgtctctttttttctcagaatctcttgataagttattatctcaggacaagtgaattaaactttactctgattaaatgtggtccagtcaactggctactttatgattatcctcaaagtgggcacaggccatctgaggaagaaagtttggttggtactatgaacccacaatgacatgtttgcctatgcatttctatgtattccacattatttccaaagaagcctactgaattctggattctgtccctcagtgctgtgaggcatatgaacacaaatccaatatttagaaagaagaaaggcttttgaggctggggacagtctctgaggaacaggtggctcctagcagactgggggtgaaggaagggaaaacagaaaggacatggcatctggggagaggcaggatggcaaggaggtcgggatcatcccacctgctcctcagcatcacaagactctcgcttcattggaaggatctggctgaaatccaagctctgggggaagtacagggagtggcagatctttctcgtctgtgaattcctgatggagaatcgcatgaggtggattgtcagggtctggggcaaatgggtcagcttcaagacctgaaaaatcaaaatcactctggagatgaagtctacttggaatgagagagtcagagaaatgtcagggctagcaacgcgttcttcccaaaaagaggggagcggggcgacatcacggagttcaaggctcctgttcgccgaatctgctgagctcctctgagaataatgcaaaacttggctattctaccaccatgtggccccccacaagaggcacaagggcacagggctctgcacaggtaccaggacccagggagccaccgcgtctgctccagggagctggtctcgcctggagggaaacgccctgccggctgctctcaggcgccctcctgcagtccctctcagtgatgcgacatgagaagccacatccacggctccagatatcagaaccacagcgtcccagatactagccagacccagattccctttctcacccaccatggggtgtcctcggggcctctgatgattctatcaggaaatccacggggggcaaccccagactagtgaaggacagatgacccctgaacagcacgggtttggactgtatgggtccgcttatacacaaattgttgtaaataaatacagtctgccctcccccataggcacgagttccacatctgcaaccaaatgctcatcaaaaataaagtatcccagatgcacaaccgcatagatgagggactgacttttcctatacgtgggttccacagggccgactgggtgtgacttgagtgtgtgtggattttggtaaaagcaggggtcctggaacaaatcccccatatgcaccgagggacagctgagtctgatttagggaatgagtacctgtttcccacgggtcttcttcccacagttctcacagaagcacttgcttttgcttgataactccctgggctggaagaagcagtgcagggcgtcctcctgtcccacccaagagaacagggaaaaagcagcgttggtatttcccacctagaatactatattcatctgttctcacactgctgtgagacaatagctgagactgggtaatttataagaaaagaagtttgattggcccatggttctgcaggccaaccggaagcatggcagcatctgcttctagggaggccgcaggaagctcccaatcatggcggaaggccaagcaggagcaggtgtcttacctgggaggagcaggtgtcttacctgggaggagcaggtgcaagagaccaagtggggagctggagtgcaggggcgcgatctcagttcaccgcaatctccgcctcccgggttcaagcgattctcctgcctcagcctcctaagtagctgggactacaggctgcgccaccacgcccagctaatttttttatgtttttagtagagacagggttttaccatgttggccaggctggtctcaaactcctgacctcaggtgatccacccacctcagcctcccaaagtgctgggattatgggcgtgagttaccacacccagcctggctccacacttttaaacaaccagatctcatgagagctcactgtcacaaagacagcaccacgggggatggtgccaaaccattcacgagaaaccctcccccatgatccaatgtccttccaccaggctttacctccaacactggggattacaattgaacaggagatttttgggcagggacacagtcccaaactgtatcagttacagcctccccacactttgcagctgagggtttcagcttttcttctggttctcctcatatcccccttaatgcctggcctggtgtggtccacttggcaggatctcaaagggcacctactgactggaggaacaaaacaggagggggctcctattaagggagcagtatgagggaagtggaggtaggagggaaaaacatttttgccaaacaaaggagaaattggccagtgccatgaaaatgaaataagtgactttccagaagccagagatagatcaaagaggcaagggggaattggccacactgtgctgtgtggtgtaatggtttgagggtttgtcctccccaaaacccaggttgaaactgaatccccagtgtggctgtatggaaaggtggggactttgagagataattggggagggcaaggtggctcatgcctgtaatcccagggaggctgaggcaggtggatcatgaagtcaggagtttcagaccagcctggccaacatggtgaaaccccatctctactaaaaatacagaaattagctgggcatggtggtgggcacctgtaatcccagctacttgggaggctgaggcaggagaatcacttaacaccagaggcggaggttgcagtgagctgagattgtgccactgcacttcagtctgggcaacagaggaagactctgtctccaaaaaaaaggggggggggaggttattgcatcatgagggcacagccctcataaatgaattaatccactcatggattaatgggttaatcggttatcctgggagtgggactggtggcttcatacgaagaggaagagagatttgagctggcacattagcatgctcagccccctcgccatgtgatgccctgcactgcctcgcctcaggactctgagagttcccaccagcaagcaggccctcaccaggtgcagcccctcaaccttgacttcccagcctccagaactgtaagaaataaattacctagtctcagatattgagttataacaacagaaaatggactaacacatacaggggcagcaaataccaagagaatccccttaccagtgtcttcaggggctttgagtccacatcaaaaagagaaagtgggagggtgagcatgctgctgtttctgctactctccatggcacagtcaacgcaaatcaaggagtccttcacccggatcgtatacagggcctgcagtctctccacctgcaagagggagagcggagaggtgagatgggaacaccaccataagccaggtcaggccaactgccagaaggtggagccaagagacagaagctcctcacaaaggtgcaaaataataccagtaacaatattatgaaactgtgataagtgttttatgtggattaactcttttttcttttttttttttttttttttgagacagagtctcgctctgtcacccaggctggagtgcagtggcgcgatctcggctcactgcaagctccgcttcccgggttcacgccattctcccgcctcagcctcccgagtagctgggactacaggctcccgccaccacgcccagctaattttttggtatttttagtagagacagggtttcactgtgttagccaggatggtctcgatctcctgacctcgtgatccgcctgcctcagcctcccaaagtgctgggattacaggggattaactcttttattcctctacacactacgggaacaacagctgaatgagtgaaatgagcagcatcttaagcttccgagtgctctggttctaggttcttaccaagtgcacatcagtgatctggtccttaatcaggttccagagtttgaggtacagttgggcagcatcatgttggacaaacactggccacagagaaaaggaacagccaattagtgaggtcttcagagtcgcttctcatgccctggtacttagacacacatgaacactcatcactttgtctcttcctagccctccaccccactgcaaggctaagttggcacgacagaagaagtgatcaataaatgaacagtaagtttggtattgatttttgagaacgcctcttaaaacttaagctccagtgccagatgtagtggctcatgcctataatcttaacacttcgggaggccaaggtgggaggatcgcttgaactcaggagtttgagaccagcctgggcaacatagcaagactccgtctcgataaaaaatttaaaaaagtacttgagagtagcggtgcacgcctgtagtcagagctacttgggaggctgaagcaggaggatcactggagcccaggatgttgaggctacagtgagctgtgatgtcaccactgcactcagcctggggaatgagatgtccacagggactttgaaaagcactgatacattcctgaggatctagaaggccaggcgcatgcccaagtaagacctgagagggctcagatccctcccctctggctgacaacaaggccacatgcaagaaagcaatgaaggcgaatacagaatcatgaactgcccagaaacgataaaacagcaacaacaacaaaccctgctgtggggatctctgatgtccagtgttgccaccttacattatctaaaatgttcattttccaacaaaagagacaagacctacaatgaaacagaaaagcatggccacccaggaaaacagcaatcgtagaacctttcactgagaagccctagatgttggcgttactaaacaaagactttagccgttataatatgttcaaagaactaaagaaaaccatgtcaaaagatgtaaaagaaagtgtgaaaatgctgcctcaccaaataaaaagtatcaataaagaaaaaactataaaagaagaaccaagcagaaatcttgagttgaggagaaccataactgaaatgaaaaatgtactagaggaggtcaatagcagattagagctggcaaaagaaagaatccataaacctggagctaggttgattgaggttctccagactgaggacggaaggaaagctgaacacagtacctatgcagcgaaaagctgaggagctgctcactgcgtgtagagctcaactaactctgatacaaaaaaaaatgtgatacaaaaggttttatacacaaatgtgaatttattctgaagccagcctggggcaaggagcaagacacatcctgccttttaatgtgccatttctcctttggaggagagaggggcattttcataaggtgtgttgtgggggtggggggagtgagcaatggcggttttctaccgggcagttatcaagttcccagcagctgagttggcgcctttccgggcagaaaagtggccgagtgggcatgctttctccatgccttcctagtgggtgaaagacaaacccctagagggtggaagtttcgaagccaccccctggcagggagagttccctggtgggtatgctttgggctgcaaatctactgccaagtctcaggaaagatcagctggaagaacttgcccgttctcaatcaaacctccatcagcctacctccatttacagattcttccttttgcccagcagggaatgtctggagaggggtaggcgaaaggtgatatttgcatttctaaagggctaacaggaaacaggaaacacggccgcggtgaggggtgagggatgggaagaggagaagtgaaaagaaagtaataagaaaactaatataactatctcttagaaaatgggagtactcagttacacccagatgggttcactagtgaacgatgggttctaccaaacatttatgggaaaaattataccaattccctacaacctcttccagaggacaaaagcagagagaacacttcctaactcattctctgaggccagcattatcctaacaccaaaaccagacagacattgtaagaaaaaaacctaaaaaccagtatctcccgtgaacataaatgcaaaattcctcaacaaaatattagtgaatcaaattcaactatgtataaaaagaatcacagagggtgacacaagcgagatggtagagaaggaggctcctggtgctccccttctcccatggacacacggtaaaactctcatctacacacagatcaactccctctgaaagaaacccagaaaccagctgagagaggcctgcacagggggcaatggggagaacacccacatcgcaaccggttggaaaagctgagacacactcgcaccacaagccccaccccagacacagtaccttactgtgaggaaggaatccctactcccagctttctcctggagaggggagggtttggaccacacataggcagccccagcttttgcagttcccactcaagggcttggctgctgggtcacctagctctgggagcagacatgggtcagcagttatgaatcctctgcgaccacagagggcaaagaggcagttttaaacgggcacgtgagcacttccagcagctgtgctcagcacagagcaaacaggcagaaatgccaggcttccagtttctccctggaaggatatgtctgcgggctctcctagctgttgcccgagggatgggcttctattaataactggcctgcacctggagccaatgaggcaggtaaacaatagatttccaggagtctggacaggcctgtgggcaagtcccatgccttctcccaccccctgctgtatggtaaaatcaggtctctaacttcacacattgagtacacatttacccctctcaaatgaaggtctagctcctcgaccaccgagctttgggagctgacaaggctctgtatttgtaagtcccacaggggcacagagaccaaagaacatccccccaggcccagtgcagcgtgaacaggcaaaaaggcccggctcctactttctccctagaaggagtttgtctgcacagtgcagctgctgccctggggtttctatgcatctgggagctgacagagcaggaaaccagtgctcctctgagaccctgaacaggcaggtgagcacctccacagctgctcccactggtttgctcaacagatagcgtcaagcttccaactaacctgtccgtctctaagcagagagcagccagcattcgctaggcccctgggggtgacaaagagtaaaacaatgcgtgaaggagtgtgcagtttcaatatgagtgcaggcacttgccacagatcctctgtccagcgttttgcagagcaagtggcggattaactcatgctcccagcttttccctgaggatagaataaactggaacacacatttaatgccccaacgtctccacctgcacctcaaggggctggtttctatctcccctgtctagggcactgacaggacttgacacattctaatctcctgagggccgctaacaacatagatgacagtctggacaacacaaagggtcaacaggtgctccgagtgtccggcagggctaattggtaagttcgtctcttatacaaggcccgtgggacaagactgggagaggtatttttctttttttcttttttctttttttttttctttttttctgagacagagtcttgctctgtggcccaggctggagtgcagtggcgcaatctcggctcactgcaagctccgcctcccgggttcacgccattctccttcctcagcctcccgagtagctgggactacaggcgcccgccaccacgcccagctaattttttgtatttttagtagagacagggtttcaccgtgttagccaggatggtctccatcgcctgacctcatgatctgcccacctcggcctcccaaagtgctgggattacaggcgtgagccaccgcgcccagcctgggagaggtatttttcttaactaaagtacagaaaataacagagaatcaagaacaatgaagaaacagagaaatatgttccaagcaaaagaacaagataaatctccagaaaatgcccctggtgaaatgaagataagtgacttaccttacagacaattcagaataatgatcatgaagatgcttaccatgtctaggacagcaatgcatgaacaaagtaagaatttcagcaaagagacagaaaaaagttcaaaagaaataacagagctgaagaatacaataactgcaataagagctcaaaagagaagctcaacagactaaatcaagcagaagaaaggattagcaaactagaagataggtcactggaaatcattcagaggagcaaaaatgaaaaagaatgaaaaagagtgaagatatcttaagagagttaggggacatcaagccgaccaaaataggcattatcagagtcccagaaggaggagagtgagaagagatggaaagcttatccaaagaaataacagtcacgagttgcagatcaacatttcagtcaatggcagaccacatgagcacagtggccatagcatgcagcctagctgtgtagtaggctgtcccatctaaatttgtgtaagtgcactccatgatgtccacacaatgacaaattcaccttctgatgcattttcagaacgtatccctgttggtaagcaacgcatacctataatgactgaaaacttcccaacccagggaaggaaatacaaatccacatccaggaagcccaaaggacaccaataagactgatctaaagcaacccacatcaagacacatcataatcaatttcaaaagttaaagacaaagaattctgaaagcagcaagagaaaagcaatgtattatacacaagggaaaacccgtaagtgtaggatttcttctgggggtgatgaaaatgttatgaaattagattgtgatgatggaggcacaactctgtgaatacactacaaacctttgaattgtatgtttttaaatggatgaattttacagtatgtgatgcacaacccaatatagctatctaaaaaaaaaaaaaaaaacctaacctatttgtgaattattttgtagaacatgttttctcttttttattcctttattctgttttcctgcagttccctgactgtggtggaataagcttggaggagatgccttcacttactctactgagaggcagagaaaggttaggtatggaagtaaaatgtccataaataatatcaattctgcacctccaaagatgtgtgcctcttacacaaatgtctctataatctgaggggtccaggctacctaacttgcttcttgttgcttcactgcccgttagttcctctcttcactctctaagcttcccatcccctttggatcagcagccaggagcccagtgggagggtatcttacagggcacgttgcacttctgcaggcagtaggccagctccaggggccgcactgctttctgccggctgtcctgcatcttctccagcagcagaagcatctggaaagggacgcttctcctctgctcgtcagctcccctgggcaccgtgatcctgccacacaagaacagccagaaacctccttacatgtagttctcaaagctaggtgcacactggaatcacctgggagaaattttaaatcttcatatccaggccactcccatacaaattaaaccagaattctgggtccggggggcggggcgcgggcagttatcagaatttttcagttcctcagattatttcaatgtgtggtcaaggttgagaagcaccatgtgagtgaatctgctctacaggggaccctctagagagggggatcagcatgactgctgccttggcccctctgcaccctgcccagcaatcgtgctagagcagacggcagatgcacgaggtcctggctccacatctcgggcaagcagcaaaatgtccagcctaaagctctccagactgcagaggcacatgctgggttaggtcctgggaagaaaggcaacatgaaaggctgtccgtgtggtttggcaatgattcatttaatcacaggcatttttcggatgggaaaaaggagagagcacagggcagaaaaggagtgatagagagagacagagggagagagtgcattgtgtgagtgttggtggaaggaggggtgtgtactccccactgacttactccttctccgactttggtctagtcccaactctgtcttttaaccaagtcagtggctgtcaatcctggccgcatttaaaatcacccaaagagggctttaaaaaagtaccaatacctggccgggcgcagtggctcatgcctgtaatcccagaactttgggaagctgaggtgggcaaatcacctgaggtcaggaaattgagaccagcctggccaacatggtgaaaactcatatctactaaacatacaaaaattagccaggtgtggtggcgggcgcctgtaatcccagctacttgagaggctgaggcaggagaatcccttgaacccgggaggcggaggttccagtgagccgagattgcaccgtcgcactccagcctggggacagagtgaggcttcatctcaaaaaaaaaaaaaaaaaaaaagtaccaatacttgggtcgcaccccagaccaacctaagaagttttagaaataatgtgtaggccagaatatgcagaagccaatctttcctctgccagcttttgagagaagatctcaaaaagtccaagtcactgtgaataactgaatatattaaaaatgaaataatacaggccaggtgcagtggcttacgcctataattccagcactttgggaagctgaggtgggtggatcacgaggtcaggagatcgagaccttcctggctaacacggtgaaaccccgtctctactaaaaatacaaaaaaaattagccaggcatggtggcgggctagtcccagctactcgggagactgaagcaggagaatcgcttgaacccgggaggcagaacttgcagtgagccaagatcatgccactgcactccagcctgggcaacagagcaagactccatctcaaaaaaaggaaaaagaaataatacaaatgctcatcagcctgaagaacagtcttacctcttcaatatcctggtgaagtccacattcattacgaacacctgaatcaaggagttaaggcagcaggtctgtccaatgttgtgtaaaccaaccaggcctataaggggaagagaaaaaaatgctgagggcaaggcctagggtaaagaagttgacaaggctgggcatggtggctcatgcctgtaattccagtactttgggaggccgaggtgggcggatcacctgaggtcgggagttcgagaccagcctggccaacatggtaaaaccatgtctctacaaaaaaaatccaaaaatcagccgggtgcggtggctcacgcctgtaatcccagtactttgggaggccgaggcgggcagatcacgaggtcaggagatcgagaccatcctggctaacacggtgaaaccccgtctctactaaaaatgcaaaaaaaattagccgggcgtggtggtgggcgcctgtagtcccagctactcaggaggctgaggcaggagaatggtgtgaacccaggaggcggagcttgcagtgagccaagatcacgccactgcactccagcctgggcaacagagcgagactccatctcaaaaaaaaaaaaaaaaaaaaatccaaaaatcagccaggtgtcatgacaggtgcctgtagtcccagctccttgggaggctgaggcaggagaattgcttgaacccaggaggcagaggttgcagtgagccaagatcatgccactgcactccagcctgggcaacaagagtggaattctgtctcaaaaaaaaaaaaaaagttgacaaaaatctaatgtttttcttaaagctactaaggacatgaagtcctgtaaagtctctcaagtacgaagtgttcattcagcttgcaaacaaatcggagagaagatatcaaacatgaatctttaaaaagctctatcacaagggccaagcacagtggctcacacctgtaatcccagcactttgggaggccgaggcgggaagaccacctgaggtcaggagttcaataccagcctggcctacatggtaaaacctcatatttactaaaaatacaaaaattagccgggtgtggtggtgcatgcctgtaatcccagctactcgggaggctgaggaaggagaactgcttgaacctggcaggcagatgttgcagtgagccaagatcgtgccactgcactccagcctaggcgacaaagcaaaactccatctcacacacacacacacaaaaagttcgataacaagaaaagttttaatatagtccattaggaaaagtgagatgtcaccaaaagtatatattactcactgccaaatgagtagtatgagcaattgttgggagagaaaaaaaaacattagagaaagcataactgagaatatggcttcctttcattcaaatcgttctccacggagctaagtccaaatgtgcatctgtggggctcagggataagagggactccccagtatgtctatgttggagtccagcggagaggtctctgcccagttcccactacagggaggcaggaaataaatcagaaggttactttggggaagattcacctaatccagtgtcaccctgagaggctgaaaggcagaaggaacttataagaatacgagaaaaacaaaagataacatttgtctgacccctagcaaccaacctcctcttttccaacccaaccttaggctcagcagaccccacaagggaagtaccactaatctcaggattcttggggaaagggctttggcttacaagataggacagtaagaaagtaacaacctggggtcacaggtgagcacagatttctactcccagactatcaggagcacattgcttccagacagacccatacaaaggtagcagtaaagatgggaactaatgctaagtgcctctagaatcccagcactggcttaaagcagtttccacagatgaccccatttaatcctcccaacaaccctatgtgcttggtactattattacccccatttgtttgtttgtttgtttgagacagagtctcactctgtcacccaggctggagtgcagtggcgtgatctcagctcactgcaacctctgccgcccaggttcaagcaattctcctgcctcagccacctaagtagctgggattacaggcacctgccactgcgcccagctaatttttgtatttttagtagagacggggtttcaccattttggccaggctggtcttaaactcccgacctcatgatccacttgccacggcctcccaaactgctgggattacaggcatgagccaccgcgcccgaccttgtttttgttttttacagatagggtttcactatggcccaggctgtatccccatctaaaagatgcagaaactcaggcacaggaaagcatgagccgtcgaatacaaagctctgcggcttcagagcggagggggtgagccgaacatttacatgcagtcaagaagaggaaaacgggaggggtctaatgaccatgagggtagtcccaggccctgggacgctctctgggctgctctctcttcatgttgctgtcttcttccttcttttcttcaagatctgccggggactgcgaggactcagccaggatggactgacagatttgcctcaggagcccaaacgccttgctcattcgtgatcactccaaaacccccaggccgcagctgcctggcccgcgttcaggacagcacgacttcacttccaggaagcgcttatgtgagccaggcacgatggaatctctgtgaaaatacaatgcgggtaggcaagaattagagaaggaggaatgtgtattcatgtaatccgttctgatgccaaagagcaggtcttagagggagataaatgtttggggagactgactcatagagctctaggctggaaatgacagctaggctacacatcccctaacctgggtcccaggcgtttccattcatcctcagagccgactgccaaatcctaaccgggagcgccctcttgggaaaggacagggaagcgcgcataggactttgctttacaacccaggaccaggcccacttcagtaaaaagccagcactaagcaagaactctcagcccctgatgccaggctggcatacaggggaagcctctcaacccgcccaacacccaaggggacctgcggccctggcagaacagcctcgtgttctggcccgcaacactgccggccagctgcagcagtcagataaaccttagctgcaggcaggctgtagctacctgtcggccttaggcacatcctggtgctgggctggtctcatggcatgaattctgggggtgtgactcaatattgtctcagcctcagtggccataggggtacccgtgtaccctcccccaacccagcacagctgtgtgaagagagacactgtttgcttgggggaagaagaggtaagtggagtacttcgccttggaacccagtgtgtccggaattggtgggtgcttggtctcactgacttcaagaatgaagccgtggaccctcgcagtgagtgttacagttcttaaagggggcatgtccgcagtttattccttctgatgttcggatgtgttcggagtttcttccttctggtgggtttgtggtctcgctagctcaggagtgaagctgcagaccttcgcggtgagtgttacagctcctaatacggcgcatctggagatgtccgttcctcccggtgggttcgtggtgtcgctggcttcaggagcgaagctgcggaccttcacggtgagtgttacagctcttaaggcagcgcgtctggagttgttagtccctcctggttggtttgtggtcttgctggcttcaggagtgaagctacagaccttcgcggtgagtgttacagttcataaaggcagtgtggacccaaagagtgagcagtagcaagacttactgcaaagaatgaaacaacaaagcttccacagcatggaaggaaacctgaccaggttgccactgctggctcgggcagcctgcttttattctcttatctggccccacccacatcctgctgattggtccattttatagacagccaattggtctgttttacagagagctgattggtccgttttgacagggtgctgatgggtgtgtttacaatccctgagctagacacaaaacgtctccacgtccccactagattagctagatacagagtgtggacacaaaggttctccaagtccccaccagagtagctagattcagagggtcgactggtgcattcacaaaccctgagctagacacagggtgctgattggtgtgtttacaaaccttgagctagatacagagtgccgattggtatatttacaatcccttagctagacataaagattctccaagtccccaccagactcaggagcccagctggcttcacccagtggatcccacacctgggccgcaggtggagctgcctgccagtcccgcgccgtgcgcccgcactcctcagcccttgggtggtcggtgggactcggcggcgtggagccgggagcggcgctggtcggggaggcttggtccgcacaggagcccatggctgcggggtggggaggctcaggcatggcgggctacaggtcccgagccctgccctgccaggaggcagctaaggcccggcgagaaatcgagcacagcagctgctggcccaagtgctaagccccttactgcctggggcttgcaggccggccggctggccgctccgagtgcgggcccgccgagcccacgcccactcggaactcgcgctggcccacaagcaccgcgtgcagccccagttcccgcccctgcctctccctccacacctccccgcaagctaagggagcccactccagcctcggccagcccaggaaggggctcccacagtgcagcggtgggctgaagggctcctcaagcgtggccagagtgggcgccaaggccgaggaggcaccgagagcgagcgagggctgtgatggctgccagcacgctgtcacctgtcaccaggactaggctcactacagtaaaacccagtactgggcagagcctcatcaccctgatactagaccagtacccacaggcagatctcaccccaccctagtgccagatgagaacccacagccccagtaacagggactggcgatctggcccacatcactacctgacaactacagtggccctgggccctgaataacttcagcagcagcaagcacgccatcacagctgtgggtcttgggcgtgccccagtgctgtgccagtctcggcagctatggccttcaggcataacccagggctgtgtcagcctcagtggccaaagaattccaaccacagtgatgctgggcttagagcaccccccagcactacaacagctgaagcagtcatgggcttagggtcctgaccaatcagcctctccctaatctcctatgggtttcctgatgaaagacgagcccaaacaaagccaggcaatgaagactggcttaggtacctatgtcaatgcacagacattgacacacagccataaggatcaaggtcaatcagagaaacatgacatcaccaaatgaacaaattaaggtgccagtgactaaccctaaagatatagagatgaggcctggcatggtggctcaggcctgtaatcccagcagtttgggaggctgaggtgggaggatcacttgagcccaggagttcaagactagcccgggcaacatactgagaccccatctctaaaaaaaaatttagatggtcatagtggtgcacgcctgtggccccaaatactgagaagggtgaaggaggaggatcacttgaggccaggagtttgaggctgcactgaactatgattgtgccactacactccagcctgggcaacaaatgagaccttgtatctaaataaataaataagatgaaataaaataataataatgggtaacatcgaagcactatttcttataaaaggtgaaagccttttatatgtactgtcttatttatccttacacagccatgtgaattaattactgttatatttccatttgacagatgagaaaactgagatacaaagaagtaagtgcctttcccactggcaagtgatgggccagatgtagacaagctggacggggtttaagtccagctaacatgctgctcagagtgaggaataaactcaaccaaatcattggtgggaatgtaaattagtagagccattatggaaaacagtatggagattccttaaaaacctaaaaatagatataccacatgatctagtaatgccactgctgaatatatatccaaaggaaagggaatcagtatgttgaagagatatttgcactctcatgtttactgcagcactgctcataatacccgagatacggaatcaacctaagtgtctatcaaaagaggaatggataaagaacatgtggactatatacacaaaatgggatgttattcagccattacaagagaatgaaatcctgtaattcccatcaacatggatgagcctggagtacattacgttaagtggaataacctaggcacagaaagataaataccacatgttcacactcatatgtgaaagctcaaaaagcttatctcctagaaatagagaatagaaagccaggcatggcagttcacacctgcaatcccagcactttggttggctgaggcaagaggatagcttgaagccaggagttcaagaccagtctaggcaacatagcatgttgcctaaataaaataaaaaatattttattttctaaaaataaaaataaaattagcctagcatggtggcatgtacttgtggtcccagctacttgggagactgaggcaggagaatcagttgagcccaggaatttgaggccacagtgagttatgatcgtgccacggcactccagcctgggcaacagggcaagaccctgtctccttttttttttttgagatggaatttcactctttttacccaggctggagtgcagtggtacaatctcagctcactgcaacctctgcctcccgagttcaagcacttcccctgccttagtgtcccaaatagttggaactacaggcatgtgccaccacgcatggctaatttttgtatttttagtagagacggggtttcaccatgttggccaggctggtcttgaactcctgacctcaggtgatccacccatctcggcctcccaaagtgctgggattacaggcatgagccaccgcgcccagcctggaatatattcttaaattcatgttggatggctcagataacaacaacctctttttcttagtaaatattgactttcaatagttataaacagttgttcttcttacaaggcccagcctaggaggactcaactgaaatgatgacagcagacaattccatcagcaagaaagaggattttgagctcatcattgagggaaagctgatgaaagagagcagagaggttccaggctgcattttccaagatgttgtcctcttctccgccaagacctcccagatacttcagtaggatatagcagtaaaacctcatggagcagatcatttgagcaggctcggtcccaaagggaaacaaaatacagcagcctttcagggtagatcacactggggagacagggaggcggggcagcaaggaaaggaaagtgaagcttaaaaggtctaaggaggatggggagggcaaggcgagcagagagaccgcagctgaagttagcaggggcaataagcatccaccagagaaaacagcctgggcggattccaaggaaggggattttcaaactcaactgctgactcaaaaaaagacccccaggccaggcgcggggtctttgtttgagactctgtctcaaacaaaacaaaacaaaaatcccaaatactaaactaacttagctcccaccctacctgaatttttttttttttttttggttcacgttctctcatgatcttcccgaaatgttatccttaagcttcggggagaggtgagcaacggaaggaactggcccaggcccaccactaaagaagccccaggaccaatcggggtcctcagagaagccccagaagagccaggaacaagctgcagaaaacctggggagggtggggcctccacccaatactccactcacaactggactctctgccaggaaagccaactccaacatttagatgccctaaaaggaacaaaattaacctgccaggaacatgattcaagcagcctcggtgtcttccgacccaccccatcatggcaaccacaattgtagaccgcagtctcgatgacgtgttcacattattttgcatttcttttttctttttttatttttatttttatttttgagacggagtctccctctgtcgcccaggctggagtgcagtggccggatcttggctcactgcaagctccgcctcccaggttcacgccattctcctgcctcagcctcccgagtagttgggactacaggcgcctgccgccacgcccagctaatattttttatttttagtagatgggtttgcaccgtgttagctaggatggtcttgatctcctgacctcgtgatccacctgcctcggcctcccaaattgctgggattacaggcgtgagccaccgcgcccggcctattttgcatttcttgagtaatcgtaatatgcgggttagaacacacggattacaacactttggatgaaaaaccacataatagggaaattttgggactactctctctcaaaaaaaaaaacagctcgtggaaaaactaggacttaccttctttgaaactatgtttatgttaagcattttcccctttgtaagctcatcattgtgtaaaagtgtcagaactgtgcaacacattttttaacagtccaaaagcaagttctttgataaatcaatatgaagccgtgcacctgtgttactctccctcccgttttgttcctgcgaacacatcggtaacctgcattcactctccatccaactctgttcaataccagaaagaaacttcagatgaaatgcttttcagtatttgccttgttttctggaacaactttaaagtacaaattatacctaaataagtacaaattaaagcctctgctttaattttcaaacactttgaacccagattttcaggggtctcaaaatggagttttgtgtttaaaagtctaaatttagctttcttccaaggaaaagggtgtgaagaagagaggttaagactaaaatactctgatttgcagagtttgacaacatccttccaatttctcaatatgaatgcccactgacccagccattccacttctaggaattttccaccgatatatttgtatgaatgtatacataaaattatattcattgccgtatctgtgccagtaaaaactggaaacaacctaaatctccatgcattgtttaaacaatgtacttcccataccatgtatcaggtttttttgtttgtttgtttgagacagtttcgctctgtcgcccaggctggagtgcaacggtgcgatctcggctcaccgcaacctccgctcccgggttcaagcgattctcctgcctcagcctcccgagtagctgggattacaggcatgcgccaccacgccaggctaattttgtatttttagtagagacggggtttctccatgtctgtaactcctgacctcaggtgatcctccctcctcgatctcccaaagtgctgggattacaggcgtgagccaccgtacccggccgaatcagttttttgttttatttttaatgccattaacacatctatatgtcctgccatgaaaagatgtccataatatactcagtggacaaagcaagttcgaaatgattttaaagacttgtacatagaaacatttctgataaggtacaaacaaaaatgatactgagtggaagactgcgagacacatttgtctgcattgtttgaatttttttacaagcttacaacacttctgcaatttctttttttgttttaattaaacacaaagtcatgtcaaaagtccaaataactatattagcttagaaaaaaattcactggcccaaaatatatgcacgtagtaaatacagatcactatcataatttgcagagcacaattattacttaattccttaattatctgactggcataggagcagagttggatgtctgtgctagaaagaaaacttccaaaatgagccccgaacttgcctcaagcgccatgcaagcgtccagcctccgctgctgagttccacgtcgggactgagccggggaccgagctgggaccgaagttccgctccgggcccgccttggtctggccccgcgctcgtggcaccccgcccagctttcgttttccactgaatggaaagcgaaacttacagcggcctccgcgccgggagctgggcgccagcgtgcggggaaaccctgccggcccgagcttcccgcggctgccgttgcagccgcgcacctgctccagacttccagccctcgctttttttttttttttttttttttgagacggagtctcattctgtcgtccaggctggagtgcggttgcgctgtctcggttcactgcaaactccgcctcctgggttcaagcgattctcctgcctcaggctccggagtagctgggattacaggcatgcgccaccactcctggctaatttttgtattttagtagcgatggggttccgccatgctggccaggctggtctcaggtgatccgcccgcctcctaaagtgctgggattacaggtgtgggccaccgcgcccgacctacaggcgcctttttatttgcgattttaaggtccttgcaattagcctacgtgttagagtcatttggcgtttggtagtatccatggcagcattttttctttcttaatgctattgtatttcttggatcgggtgtcttcacatcaccggcctgtggcttggatgcggcacatggtgtaattaggagctcccctgtgggcatgcagatacagatatttctccacttaagaaggggtcagggggcgcggtggctcacacctgtaatcccagcactttgggatgctgaggcaggcggatcacctgaggtcaggagttcgagaccagcctgaccaacatagtgaaaccccatctctactaaaagtacaaaaattagctcggcgtggtggcgcttaatcccagctacttaagaggctgaggcaggagaataacttgaacccaagaagcggaggttgcagtgagcagagatcgacaagagcaagactccgtctaaaaaaaaaaaaaaaaaatggggtcaagtcccagtgaacccatcatgaagtcgaaacatcgtaagtgaaaccacggtaagtgatggaccatctgtgtatatataaggttaagagatctgtaacatgcacaccggaaaggcttattacctctttagagatgtatttcttgtatgtagactcatgggggtaggggcagaagggttatctgctaggggcctcaaactccagccgctggaatttgcgcaggaaagcagggtacaattcccccaaagcgatcattctttctgaaagccgtccccgcagcaacagacaaatagcctccaaaaacccaaagctgccagaacctcactgaagcgttggtagggtctgcagtaaggtacaaaataccatggcatgaagatgtataaacgtgtccataatagggtggatgtgtgttagaagcatgagcacagatatacacatacaggctatccacacgtccatcgtcagcccagactccgcttacattgctgctggaacggaggcagtgtcgcccacagtgcagcatgttctccctggaaggctggtggactttgcgcagtatggtgtttacacaggtacacggtggtgggcgcagggtccgtcctcattatatttgctgaccaatcagttatataaccagcttcatacatctggtaagtcttgtccacaaacaggaacctcaaaaactcaagtgagggcaatgaggagaggaggttgcaaaatttgataaaatatgctaaatacagcaagtcagtagaaggctaaggagcaagctgcagttgcttgcagcaactatcagcagaaaactattaatagtcaatccaatgattctatctgaatcttggtaggtcggtggagcaaagtaattggtgttgctgccccagtgcagaatggacaagggtgaaccttgggttggaggctggactatataatgtaaggatccattacacttctatggggctcttccttccgtccttcatggtaccctcctgaacaattccgtgctaaggccatcaggtgtgtcaagcaaagtgggcgtttgtgtagtatgttccacagtggcccaagcagggtgctggactggagcaggttgaggagggtggcagcacagtggggctgcccagcacaatgtcagacacaaatgggtgctggtgcagcccggcccagggtcacagcccaagcaatttgaagatgtggcacatcccggtattggagtggcccagtgtgtggtgtccagggagggcagggtgctggtggagatgacagattagttacatacagggggatgaccaggtaactgaatgtattaaggataattggagccagagttgaaactctcagagataggagttacaaataaggaaagggagaatgagcccactagtgttgaactggaattggacttagcagtgtggatccatgattttcagtatgtatacacagatagataaagaagtacaaggcgggtggatcacgaggtcaggagattgagaccaccgtggctaacacggtgaaaccccgtctttactaaaaatacaaaaaattagctgggtgtggtggcacacgcctgtagtcccagctactcggaaggctgaggcaggataatcatttgaacccgggaggcagaggttgcagtgagccaagattgcatcattgcactccagcctggcgacacagcgagatcccctatccaaaaaaaaaaaaaaaaaaaaaaaaaaaaagaagtacatgtggaggtaaacatgtgtatacatgcatacatcccctgacttggtctgtagggggcctgggaacagtgacaccccaacagtacatcttgcacccagatcttggtttctaattcccattctctagtaaaaggaaccaatgttgcttggagaaatggctgtttctggggttaaggcagagaaagtacaagatgagcctaggacatcttgttctgccagcaagtaagggaatgctccaagaatgatggggatgtttcaaaacgatgcagaagccagctccaagaccatgctcccactggccaaatttggaacaacttgagcattaaaagaaatgatgatttgttttgttttgtttttgtttttgagacggagtctcgctctgttgcccaggctggagtgcagtggcactatcttggctcactgcaagctccgcctcctgggttcacaccattctcctgcctcagcctcccgagtagctgggactacaggcacccgccaccacgcccagctaattttttgtatttttagtagagacggggtttcaccgtgttagccaggatggtctcgatctcctgaccttgtgatcctcctgcctcggcctcccaaagtgctgggattacaggcatgagccaccgcgcctggcctgaaatgatgatagtaacatttcgacctgttaaataaaatgggaagccacacttcataccaataaaagtagatactgaataaattaaaagtttgatgagaaacaggatatttacacagtttcaaagtactctcccacaaaatacatattattaattaccattattacatacatgtgatacaggttcattctgcccgcatgccataaatccatcactgtgacaggttttgtaaaagagaaaagatttattcgcaaggcagcccagtgaggaggcaggagaacagctctcaaatcttcctccccaaagataagtcttagggatatttaccggtgagagaagcagggtggtgtaaggtatgggcaaaggtgattggcagtgggggaaaatgaggcagtcggtgaccactgcaagcatagtcagggttcgtggcacttcacagggcacatgttcaaaaaatgacagccttagcgtgatctgagggtgtcgcttggggcctctgatgtcaaaaggccacttcttttgtttgcacaagcctacttgaaagctcacggtctcaactggtttgaactaggcaggagctgccccaagttcctgaaaaacaatttgaacgatcatgacagtagtgacatacatgttatctgtaaggaagccggcaaggttaagttacagcgctcagtggcgcggccttcagcttcacagaaaaaaaataacaaaagcaagtgacccaaagcaagcagggcaggctaaattgggcagacctaatcagatgaaccccatggtctcatatgtaatattacattataactataaagaatgtaattaatgtaaatattcggtacaagaaagtcatcagtgcggggaacactggaattgcgtgccaccagaggacagagtggagccagcgcggtatcacttctgtgctgttcccatcgaaggtcagtaaccggaaccccttcgccaggacgcgggtcctggccaacccaaatcgaggggcattctgcagatcagctggtctgccatcttcaaacgattcatgaaaatcaaagacagctttgaggaacggctccagactggcagagaccaaagaggtcatagatgaacaggagatccccaactggatcctttggctgtaaaggacaatattggcacaacgggtgaagcttgaatggggtctgaggattaggtggtagtaacttcacaggcggggatttgggagaaatgcaatgtcacgtggaaaactgactctcaaatagttcaagaaggaagttctttggactatacttgcaacttttctgtaggcttaatactgtttcacaattttaaaatgtaaaataatagtaccaggtagtagttttttattaagacagattgtgctttttgaaagcattggtggaaagatttctcaaaatcatgcgcgaaagagtttataatgaaattgtgtaatatttgtttcaaaagaaagtgtgggccctgagaagcattttctgtagtttacacagtatttctgccaatttgggatactttcagtgtccctggaattctcatcatctgaatttcttactctttttccctttaaaaaaaaataaaataaagaagtatgaggcaaaaggccacacctacctacctcactttaaaattctgtctaaaaacctggtcacagaggaagatgttggctaactttaatgcgataatctagttcccctcaaaatggaaagctatttagaaaaaagctatttgcccaacgtgaggaacaatttatagaaactgacaagaatttttgtcctggggaaaggacagggtttgttgcatgggataaggggaagtgatgtggccgggcatgatggctcacgcctgtaatcccagcactttgggaggccgaggcaggtggatcgtgaggtcaagagatcgagaccatcctggccaacatagtgaaacctcgtctctactaaaaatacaaaaattagctagatatggtggtgtgtgcacctgtagaaccagctactcgggaggctgaggcaggagaatcgcttgaacctgggaggcggaggttgcagtgaaccgagatcgctccactgctctccagtctggcgacagagcaagagtctgtctcaaaaaaaaaaaagcaagtgattttttttaaaaaaagaaaacagaaccgatgtctgaaaaagtagtactcctttacaaaacacattctctacaaacgcgtggtttcatgtgacctctgctcagtccctttccacaactttctcctgcctattttcttctctgcattttgtcaggatgctttttattgtaaattttactgtgttttgcatgcttccaaatataaaaaataatttttaagatgaattaaacattgaacctccctctcagtattgttttgggaacatgcattctcctgaggagagggagctgttgagtggaagcagtcaaacagaactccacatttcattttcctggcatgggtttcagggtgcaactcaaacagaatgtgacttggcatctgtcacctttcccaggcactccctatcctctggcaatttgttgccttaatggagaaccattcaaaattaaatattttatattagaaaagaaatgttaaacataaagaaaagttatacaaatattataacaacctagtgagccttccttcactaattttctctctcatacacacacatctatgtgtatgtgtgagtacacagtatatatgtgtatatatttacacaatcactttttttcttttgctggactacttgagagtaaattgaagagattgacattcttcagctctaaataattcaatatgaacctcataggatcaaagatgttttcatacataaccccagtgcaattattaccaaattcagataatttcatatccgtacaattttcccatatataatatattcaatatttaaattttgacagttatcccagtattgtttatacagcaactgttttcctttgtttcttatttttatagatacatagtaattgtacatatttatgtgttacatgtgatactttgatacatgcatacaatgtgcaatgatcaaatcagggtaatgaaggtattcatcacctcaaacgtttattatttctttgtactgggaacattccaaatcttctcttctagctattttgaaatatacaataaattattgttaactattatcactgtacagtactatcattccctctatctaactatctttgtacccataaccaacacttttcatccttccctccctcctattgcttgccagcctctggtagtcatcattctactctccacctccctgaaatcaacgtttttagctcccacataggagtgagaaggtgggatatgtatctttctgtgcctagcttatttcacttaacgtaatgtcctctggtttcatccatgttgctacaaccgacgggatttcattctttttatgactaaatagtattccactgtgtatatgtagtacatttttttttttttgagacaaagtctcgctctgtcacccaggctggagtgcagtagcgtgatcttggctcactgcaagctccgcctcccgggttcacgccattctcctgcctcagcctcccgagtagctgggactacaggcacccgccaccacgcccggctaattttttgtatttttagtagagacaggttttcaccgtgttagccaggatggtctcgatctcctgacctcatgattcgcctgcctcggcctcccaaagtgctgggattacaggcgtgagccaccgcgcccggccttatctagcatgttttttatccattcatctgttgatggacacttggattgattccatatcttggctattgtgactagtcctgcagtaaacatgggagtgcagatatctcttcaatatactgatttgctttcttttgggtgtatacccagcagtgggattgctagatcatatggtagttctagtttcaattttttgagaaacctccatactgttttccacaatggttgtacgaattttcatttccaccaacagtgtacgagggtttccttttctccacatcctccccaaaatttgttattttctgtcttttgataatagccattttaactgaggtgagatgatacctattaatgtggtttcagttgcatttctctgatgcttagtgatgttgagcatttacttatatacctgatggccattagtatgtcttcttttgagaaaatgaaaatctttttcagattatttgccctatttttgttttgttttgtttttgagatggagtcttgctctgtcacccaggctggagtgcagtgggacgtctcggctcactgcaacctctgcctcctggttcacgccattctcctgcctcagcctcccgagtagctgcaactacaggcgaccaccaccacacccggctaattttttgtatttttagtagagatggggtttcaccgtgttagctaggatggtatcgatctcctgacctcgtgatccgcccgcctcagcctcccagagtgctgggattacatgcctgagccaccacacccggcccatttgcccatttttaatcagattgtttccttactattgagttatttgaggttcttatacagtttatatataggtaactaatcctttgtcagatgcaagttcgcaaatattttcccattctgtaggttgtcccttccctgttatttcctttgctgtaaagaagcgtagacgattcttttttttcccctcccccttcccagcttagaagatttctgacaagtgtagtgaaatcaacaactgctctgcaagaatcagattccagggcaggcacagtggcccatgcccataatcccggcactttgggaggccaaggcgggtggagcacctgaggtcaggagttcaagatcaacctggccaacatggtgaaatcccatctctactaaaaatacaaaaaaaaaaaaaattagctgggcacagtggtgaatgcctgtaatcctagccacttgggaagctgaggcaagagaatcgcttgaacccaggaggcagaggttgcagtaagctgagattgtactgtgtctggaattggttccttctggtgggttcctggtctcgctgacttcaagaatgaagctgggaccctcgcagtgagtgttgcagttcttaaagctggtgtgtctggcgtttgttccttcagatgttcacaggtacctggagtttcttccttctggtgggttcgtggtctcactgacttcaggagtaaagtcgcagaccttcgcagtgagtgttacagctcttaaaggtggcacgttgggagttgtttgttcctccggggggttcgtggtattgctgacttgaggagtgaagctgcagaccttcacgctgagtgttacagctcataaaggtagtacagacccaaaaaatgagcaacagcaagatttactgcaaagagcaaaagaacaaagcctccacagcatgtaagagtaccccagcgggttgcccccgctggcgcaggtggccagcttttattcccttatttggccccacccacatcctgctgattggtccattttacagagcgctgattggtccatttttacagagtgctgattggtgcctttacaaacctttagctaacacagagtgctgattggtgtgtttttacagagtgctgattggtgtgtttacaaacctttagctagacacagagcactgattggtgcatttacaatcctttagctagacagaaaagttctccaggtccccacctgattagctagacacagagcgccgattggtgcgtttttacagagtgctgattggtgtgtttacaaacctttagctagtcacagagcgctgattggtgcatttacaatcctttttagctagacagaaaagttctccaagtccccacccgacccagaagcccagctggctttgcctctcagtaccactgctctccagcctgggcgacagagcaagactccgtctcaaaaaaaaaaaaatagcactaaaagaaacttattaaaaaagaaaaacattgtcaggtcaggctaaaggttaaagaggaaaaaaaatcacagggtagggtcaaagagtggcgataacagagaagagagtcatgagacttgaaattaaataatagaaattactcaatattaactgcagagagaaaatagactgaaaaaaattagcagagcctcagtaacctgtgggactgtgatgaaagatttaacatcatgtcatcaaagtccccccaaaaaagagaaaaaagcatgaagctgaaaaatattcaaagatatgatggctcaagattttccaaaaattgcaaaagacatagcctaaaccgaataaactcctaacaagtctgaggcaatctatatcaatatatatatcataatcaaacgcctgaaaactaaaggcaaagaaaaaagtattaaaaacagcaagacagaaattctaccatatttataagggaaaagcaattttttttttttttgagatggagtctcgctcttttgtcaggctggagtgcagtggtgcaatctcggctcactgccacctctgcctcccgagttcaagcgattctcctccctcagcctccagagtagctgggactacaggcgcgcaccaccatgcccagctaatttttgtatttttagtagagacagggtttcactgcgttggccaggatggtctcaatctcttgatctcatgatccgcccacctcggcctcccaaagtgctgggattacaggcgtgagccaccgcgccctgccaggaaaagcaatttttaaatgacggcatatttctcctccgaaatcacagagaccagaaggaagtgacacagtattttccaagtgctgaaagaaaagcagtgtcaatcgagaattctattatccagtgaaaacagccttcaaaaatggaagggatatcagggcaatctcagatgaagaactactaagaatttgtcaccagcagacctaccattaaaaaaatggctaaaggaaattcttgaaatagaaaggaaatgataagtcttagaacatcagggaggaacacagaacaacagaaagagtaaaaatatagataaatacactagacatttcttctgctgagttttcgagagtatctttgtccaagcaaaaattttaacattgtctaacatggttattgaagtatgtagaagaatcattaagataattgtaagtgagagagggtaaaatgacttaaaagaattgtaaggtttctatgcttcagtcaaactggtaaaatgtcaacactagtagactgagatatcaatataatgtaatatgtagagcagctattaaataatttacacaaagagatacacactaaatcactagacatatcaaaatggaattctaaaaaggtgctagtaaccccaaggaaagtacgaaaaagaaaacagagaaaccaagaacagaggaaacaaagataacaaaaaaattctatggaagacctaagacttaatatacaggtaattacattaaatataaacagtctaaatacactaataaaaagatagattagtgagtgaaacaagccaggcacacaaagtcaaatatcacctgttttcactcataagtgggtgctaaaaaatgtgtacacatgaagacagagattggggtgacagacaatgaagacttggaagggtgaaggagtatgagggggtcatatgataggtaattcctaattgggtacaatgcgcattatttgggtaatggataccctaaaagccctgacttgaccactatgtaatctatgcatataacaaaactgcatacggccgggctcagtggctcacgcctgtaatcccagcactttgggaggctgaggtgtgtagatcacttgaggtccagagttcaagaccaggtgggccaacatggtgaaaccccatctctactaaaaatacaaaaattagctgggcatcgtggcaggtggctgtaatcccagctactcaggaggctgaggcaggagaatcacttgaacccaggaggtgaaggttgtagtgagctgagattgctccactgcactccagcctgggtgacagagtgagactccatctctaaataaataaatcagcaggtatttataaacataggccagataatgtcacttctctgctcacaaccttccactggtaccacatctcacagcaaatggaagccaaaggccttacaatattagcaacagccccagctttcaggccacaaaattcatcttgaaactgtagcctactgagtattcttaacgtaaacatttccttaatataaagcagtatatattcgctgtagaaaaactgaaaaatataaaacatgtaaagggggaaattacttataattccacagtctaaaatagccactacactggtttttttaatatatatatctttttgtaaatctagtttttacaatttaatgatactgaggcaaacaaatttgccacatccataaaaattttgaaatcaaatagaaataaaataataaaaagacagattggcagagtaggtgttttttgtttgtttgtttctgtttgtttttttaaaaaatagaaccaacagcaagcatagtggctcacactggacgctgaggtaggagggagcccaggagttggagaccaacttgggcaaccatagcaatgtagcaggacgagccgcagacaaaactcagacaccgagttaaataaggaaggggtttattcggcggggggcattggcaagactcctgtctcaagagcagagctctccgagtgagcaattcctgtaccttttaagcgctcacaactctacgggggtgcgcgtgagagggtcttgatcgattgagcaagcagggggtacgtgactgggggctgcatgcaccggtaattagatgggaacaaaacaggatagggatttccacactgcttttctatacaatgtctgtaatctatagataatataaccgattaggtcaggggtcgatctttaactaccaggcccagggtgtgatgccgggctgtctgcttgtggatttcatttctgccttttagtttttactttttctttctttggaggcagaaattgggcataagacaatatgaggggtggtctcctcccttagcaagacttggtccctacacattttttttttttttttttttttttttttttttgagacggagtctcgctctgtcgcccaggctggagtgcagtggcaccatcccggctcactgcaagctccgcctcctgggttcacgcctttctcctgcctcagcctcccgagtagctgggactacaggcgcccgccaccatgcccggctaattttttgtatttttagtagagacggggtttcactgtgttagccaggatggtctcgatctcctgacctcgtgatctgcccacctcggcctcccaaagtgctgggattacaggcttgagccaccgtgcccggcctgcattttttaagtaaataatttttcctctttaggcctcatctggtttattttttattttttgtaagatttaaactcagacttaaacatttaattttatccatgtgtgcatatgaacctcttccattacttccaacaggtcagcattgtgtaaactacacttcagttataaaccttgttttgagcagccaggttgcagcccatacaatgttcccagtgaggacttcctcctacctatttccctccatctctgagcgagcgtggacttgctgcacgggggggtgcacacttcatgctctatgtgctgagggacttccctccggatccgaccttgttaatatcccagttgtgagtgagagcttctgaagctccacaggttaactggaaattaaattgcagcgttagttgtctcctcagaactcactggtttcatgcctcactcagaagtaactgcacaattccagggcgtccacaggaacctacaggttttgcctacccctgcccgcgactggctgatctccaaaccctctccctggcttcccgctggctgctcctgccactcccgtcgtgttccgccccaagcccctttgctttgctctctgctcctccaggcggttcctcccacacagacgtgctgggctccacaggggcgccttttgcctcaggtggatcagaacatgtgttcgtgtgactctttttttttgttttgttttgtttttgtttttgtttttgttttttgagacaagtctcgctctgtcgcccaggctagagtgcagtggcgcgatctccgctcactgcaagctccgcctcccgggttcacgccattctcctgcctcagcctcccgagtagctgggactacaggcgcccgccaccacgcccggctaattttttgtattttttagtagagacggggtttcaccgtgttagcccggattgtctcgatctcctgacctcgtgatctgcccgcctcggcctcccaaagtgctgggattacaggggtgagccaccgcacctggccaatttttttttttaatttagccaggtgtggtggcagacacctgtagccccagctacttaggaaaatgaggcaggaggattgcttgaggccaggagctcaaggcttcagtgatctgattgtgccactgcactccaggc

SEQ ID NO: 6863 - DNA, 315 bp, Homo sapiens
ttgtttttgttttttttgttttttttttaacagagtcttgctctgtcgcccaggctggagtgcagtggcgcaatctcggctcactgcaagctccgcctcctgggttcatgccattctcctgcctcagcctcccgagtagctgggactacaggtgcccgccaccacgcctggctaattttttgtttgtattttttagtagagacggggtttcaccatgttagccaggatggtctcaatctcctgaccttgtgatccgcccacctcggcctcccaaagtgctgggattacaggcgtgagccaccgcgcctggcccaa

SEQ ID NO: 6864 - DNA, 299 bp, Homo sapiens
tttttttttagatggagtctcgctctgtcgcccaggctggagtgcagtggcgcgatctcggcgcactgaaagctccgcctcccgggttcgcgccattctcctgcctcggcctccctagtagctgggactacaggcgcccgccaccacgcccggctaaattttttttgtattttttagtagagacggggtttcaccgtgttagccaggatggtctcgatctcctgacctcgtgatccgcccgcctcggcctcccaaagtgctgggattacaggcgtgagccaccgcgcccggccccacat

SEQ ID NO: 6865 - DNA, 211 bp, Homo sapiens
ggttcacgccattctcctgcctcagcctcccgcgtagctgggactacaggcgcccaccacctcgcccagctaattttttgtatttttagtagagatggggtttcaccgtgttagccaggatggtctcgatctcctgacctcgtgatccgcccgcctcggcctcccaaagtgctgggattaccggcgtgagccaccgcgcccggccaaacat

SEQ ID NO: 6866 - DNA, 299 bp, Homo sapiens
gtttttgtttttgagacggagtctcgctctgttgcccaggctggagtgcagtggcactatcttggctcactgcaagctccgcctcctgggttcacaccattctcctgcctcagcctcccgagtagctgggactacaggcacccgccaccacgcccagctaattttttgtatttttagtagagacggggtttcaccgtgttagccaggatggtctcgatctcctgaccttgtgatcctcctgcctcggcctcccaaagtgctgggattacaggcatgagccaccgcgcctggcctgaaat

SEQ ID NO: 6867 - DNA, 174 bp, Homo sapiens
tgggactacaggcgcccgccaccactcccagctaattttttttttgtatttttagtagagacggggtttcactgtgttagccaggatggtctcgatctcctgacctcgtgatccacccgcctcggcctcccaaagtgctgggattacaggcgtgagccaccgcgccccgccaaa

SEQ ID NO: 6868 - DNA, 308 bp, Homo sapiens
ctttcttttttttttttttggagacggagtctcgctctgttgcccaggctggagtgcagtggcgcgatctcagctcactgtaagctccacctcccgggttcatgccattctcctgcctcagcctcccaagtggctgggactacaggcgcctgccaccacgcccggctaattttttttgtattttttagtagagacggggtttcaccgtgttagccaggatggtctcgatctcctgacctcgtgatccacccgcctcggcctcccaaagtgctgggattacaggcgtgagccaccgcacctggcctaaa

SEQ ID NO: 6869 - DNA, 308 bp, Homo sapiens; identical to SEQ ID NO: 6868

SEQ ID NO: 6870 - DNA, 465 bp, Homo sapiens
ttttttctttttttttgtttgagatggagtctcgctgtgtcacccaggctggagtgcagtagtgcaatctcggctcactgcaagctctgcctcccaggttcatgccattctcctgcctcagcctcccgagtagctgggactacaggcacctgccaccacacctggctaattttttgtatttttagtagagacggggtttcaccatgttagccaggatggtctcaatctcctgacctcgtgatccacccacctcagcctcccaaagtgctgggattacaggcgtgagccaccgtgcccggccgaaaatctgtcctctcttacacaatacctcgagtgcactcaatttgaaatccatctgggttcacaaaccgctctagaaggaaggctggttcctgtcacttacccacttggaggtgtggagatatctgggcaccttgttttccttctaacctcaagctgtgctcg

SEQ ID NO: 6871 - DNA, 318 bp, Homo sapiens
caatgtgtactttctttttttttttttttttgagatggagtctcgctctgtcacccaggctggagtgcagtggcacgatctcagctcactgcaagctccgcctcctgggttcacgccattctcctgcctcagcctcctgagtagctgggactacaggcgtcctccaccacgcccggctaattttttgtatttttagtagagacggggtttcaccgtgttagccaagatggtctcgatctcctgacctggtgatccacccgcctcggcctcccaaagtgctgggattacaggtgtgagccaccgcgcctggccaacaat

SEQ ID NO: 6872 - DNA, 22428 bp, Homo sapiens
acatgtttccaactggaatcgtttaatgtgtctacttcttccacgcataattataaaagaataagaatcgacaaaaatattttctttccataatatgtagaggtggtttgtttcttttttttttttttcttttctttttacttttttttttgcccgcccctggcagagctcttggcggggagggaaggggagagggaaatataaccctgaggtggggatggttcagctcccaaccccggaacccctggtgtgtacgggtcaggcagacacatgtggctgggcggctgggctggggaggggacagccgccactgaccagcagagcgtggaagttcggtgcgtttcagtgcctgcctgaaagcttggggacaggagggctgtccacaggtggtgccccccgcgggccctggccgcttctcctgtggggcccgcatgaccctctgctcgggcttgggaagaaatggagcctaccaggtgctgggttgcaaccccgctgcccggtgtggaccccaagtctagatttaggcaccccttgctttctgtcttttattttttatttattttgagacagagtttcgctcttgttgcccaggctggagtgcaatggtgcgatcttggctcaccgcaacctccacctcccgggttcaagcgattctcctgcctcagcctcccgagtagctgggattataggcacgcgccaccacacccggctaattttttgtatttttagtagagacggggtttccccatgttggccaggctggtcttgaactcccaacctcaggtgatccgcccgcctcagcctcccaaagtgctgggattacagacgtgagccaccgcgcccggcctgtcttttaaataattatgaaaaatatccccccaaacaaaacacaaacatcaagttggggaggctggccgggggggacaggcaattgcatgcttgggtgctggggacggtggctggccgggccaggggactgagaggtcacagggagccccaggcggaaggcagcccgctcctctgagtctcttctggcctctccagtgcccatcagcgtgtgacctcctcctcccagaaggcggggagaggaggggctggcccgagaccaccatctctctgtctcggcaaccaagaagcagcggacataaaacccaagagcgtttaaaaaaggataaaaggcgtcggggcggtgaaggcagcggctcctcggggctggccagcgctgggcgggacaaagtgcctcactggggcccgcgggccactcagtccctcccgcctggttccccgcggaggctgcagccacttgtgctgtgatgtggcggctcccggtgggcaggctcagaggtattcctgtagaaagtgcagcaacgtgacttcatagtgctcgcccgactcggggcagcgaatactgtgtctctcgttggggtagatctgcggggagacaggaggcagggctggggggcgtggccggaccacccccgtgtcctaggctcctcccttattctggctcagggcatccgggaaggcgcaggtgctctgaggcccagtgatctgggtttgaatcccacctcggctgttgacttgcagtgtaactctgggcctctctaaaaaatggggtgaatccggacctcacagtctttgggaggatttggtaagacaaagtttacaaaacgccttgcggtgtgcacgcgcttgcacagaggaaagatttaggaagaaaccgtttgcctctttcccccaaaccggctgacgggcgaccaactcatctctgtggaggtggctgaggcttcaagcctcagggacatctggtgccctggtctcgagccatttccactttaccaaaaggcatgtgactagctctgggccttaggacagctgcctgtgaggatttgtgaagcattttctgggtcctcttagcgcccaagggggatcaagccaagaggcaggcagtaacatggaactccccaggctcctgagacctggaccagccaacgccaggcctgggggtggatccacacggggatgcaggtcctgcctctggccacgaaggagggctctcgaggcactgacggacaacccctatagctccccactgccccctaggggttggtaggaccaaggcatgaaaataaccctacgttctccacaaagaaccccggggctggccggcagcaggggcaggtggcccatctacgccacctcctgccagtgagatgggtttctgaatcatcccctcctctccaggctcctggtccccactgttgcccatcaccctgggaatgcaccaagccacccactggtttcccctcctctactcttgccttctttaatccatccctggatgaatcacgagtttgatgacaccgtccccagcctagacctctgcaaggacttgccagtctgacatcaagaccagcttccaggtcctgctgccccaggcacttcaagggcccactccttccccagcccgggcagtggcactccctggggcagactctgctgcccttgacaccagccatatgcacatgttgtgcccatgcctttatgccactctgggtcccagctgcctggttactttttcctcttggctaagagggcagatagagggtctgtctggctccccaatgagcttccagaccaagcccaaggcccggcatgtgacaaatgtgatttgtgtataaagagggcctggggccgccagctgcctggcccagatgttttggggtctttgaaacagaaggagaggtgcactctatctgtcccacacaatgccatgttcccaccccacagcctatctcatctcacgttctacttcctgtggggaggcagtgagacaggaccctgggcccaccctgtgtgctgaatgcttttcttttttctttcttttcttttttttttttcttttgagacggagtctccctctgccgcccaggctggagtgcagtggcacaatctcggttcactggaacctccgcctcccaggttcaagcgattctcctgcctcagcctcccgagtagctgggactacaggcgtgtgccaccacactcggctaatttttgtatttttagtagagacggagctttgccatgttagccaggctggtctcaaactcctggcctcaagtgatccacccgcctcagcctcccaaagtgctggggttacaggcgtgagccaccacgcccggcctgaatgcttttctgaagaccttgtttggccccagcagccttcaaggaggccgagttatcatgaccgtttcaaagacggagaaacgaggtgcaagggtgaatgctgtcccagctacctggcccctgggaaggcagtgggctcgggtctcaggctgggaagagacatctgaagttccattccagccctgcctgatatcactccctgggctgcttgggatgtggggtgtcggtggggggcaccgccaagagatcagctcatcaccgcacaaggtggctctgcctccctcctgctctgcggccccatttccctgctctgttgaaaggcaacaggacgctccccacaggacagagcatgccgaggcgcccaggaagcagaaattgtctgcagtccacaggtaataaaacctggccctcttgcctccaagatacctcctgaatctcccgccggtacaactatggaccacgtcccactgtcccccacaggccatccacaaagcagccagagaaatgtgggtcaaatggcaagccgcccaactctatgctctgctcacaagcccgagtcacctcccaccaccctcagttgaaaatccagccgaagccccgcccccgctgaggccccacccctctatagcagaagctccaccctgcttactgagggccccccctcctctacagcagaagccccaccctcctcaccgctgaggcgctgctcccacaccgagccccaccctctccactaccgaggcccttccccacaccgaggccaaccatttactgcggaagccccacccaccgtaacactgaagccccgtccctctgcagaagtcccaccctcctcgccattgaggccccgcccataaccatgcccaccccttagcgcagaagccccgcccacctagactgagccccacgttgctgccaaggctccacccactcccccactctcctcccgctcggtcccccaagcctggctggctccactcactctagcacccttcactgctgcctcctcagggaatgcttggccccagcgccttaggaaggagcctgctagggccttcagcactcagcggtttcttctacgcaatttctcagtttcaaataaagcccgtctgcggggcaatttcggtaagggttcctccctccattaggcccggagcaggggtgggtgtggcagcccccgatcccgtgcttccagcaccgaaggcaggcggaaccctgagctgtcaagacaggactgatacatcaatggccctgggagctgggagggcggggacacagggctgtggggtggggggctgggagccccagatcccccagggagcccctggtcacagtgggaagccaccccgcctcgtcccaccccccactcccagggatctgtcggctcgcggaggggccgaagcccccaacagccacccacctggagctggtaaggtttccctgctcggatcagttgggagacgaggaagtttgtgtggaaaaagtgcacgttttcgtccaggaagccgtggaggataagcaagcggttgggcctggaaaacagatggggaagggtctgaggccagggattgtccgtggggtaggaggggagcagatcacaaggtcaggagtttgagaccagcctggccaacatggtgaaaccctgtctctactaaaaatatatttaaaaaaaattagccaggcatggtggcaggtgcctgaaatcgcagctacttgggaggctgaggcaggagaactgcttgagcctcagaggcagaggttgcagtgcgctgagatcgcgccactcactccagcctgggcgacagatggagacagcatctcaaaaaaaaaaaaaaaaaaaagatcagctgagtgtagtggtgcgcctgtaagtccagctactgtgcaggctgaggcgggaggatcacttgagcccaggaggtggaggctacagtgagctatgatcataccactgcactccagcctgggtgacagagcaagaccccatctctaaattagaaaaacaaaaacaaaaacccaggccgggtgcagtgcctcatgcctgtaatcccagtactttgggaggccaagctgggtggattgagtccagttgtttgagaccagcctgggcaacatggcaaaacctcatctctacaaaaatatttaaaagttagccaggcgtggtggtgcacacctgtggtcccagctgagcctgaggcaggaggatcacctaaaccctgggagggtgcagtgagctatgattaaaaaaaaaaaaaaaaaatgctgagcatggtggcttacacctgtaatcccagcactttgggaggccaaggcaggtggatcacttgaggccaggagttcaagaccagcctgggcaacatggtgaaaccccatctctattaaagatacaaaaattagctgggtgtggtagtgcatgcctgtaattccagctactgaggaggctgaggcacgagaattgctttaacctgggaggtggaggttgcagtgagctgagattaagccactgcactccagccgggaccacagagtgagactctctcaacaaaacaaaacaaaaacccacctaggtctgctgctgtctgtggtctggagtgtggcatgggctactggtgaggccaacacgcagcctcaccagaatcggctgccctagcccttcctgtccgatacgggagccagtggccacacgtcgccgttgaaattccagtttacattcatccaaattaacggaacttataaacccattgagacagagcacagatcggtggctgccccgggacagggagtgactgctaaggaatgggaacagggtttgacgctggagtgctggaaaggttctggaaccactgcaaatgcaccgagggctgctttaaggtgactgttaggttctgtgaatttcaccacaataaattattattttttgagacagagtctcgctctgttgcccaggctggagtgcagtggtgcgatctcagctcactgcgacctcacccttccaggttcaagcaattctcctgcctcggcctccttgagtagccgggattacaggtgtgtgtcaccacacctggctaatttttatatttttagtagacatggggtttcaccgtgttggctaggctggtcttgaactcctgaagccaccgttcctggcctattattattattattgttttgagacagtttctctctgttgcccaggctagagtgcagtggcacgatgttcgctcactaccaactccacctcctgggttcaagcgattctcctgcctcagccttccaagtagctggcattacaggcatgcaccaccatgcccagcttattttttgtatttttttgtagagacggggtttcaccatgttggccaggctggtctcgaactcctaccttaagcaatcctcctgccttggcctcccaaagtgcccaggcagacttttttttttttttttttttttgaattggagtctggctctgtcgcccagactgtagtgcagtggcgcacgatctcggctcactgcaagctccgcctcccgggttcacgccattctcctgcctcagcctcccatatagctgggactacaggcacccgccaccacacccggctaattttttgtatttttagtagagacggggtttcatcttgttagccaggatggtctcaatctcctgacctcacgatccgcccgcctcagcctcccagagtgctgggattacaggagtgagccaccgcgcccggcccatgcccaggcagatttttaaccccctaggtgactgcatgggattccggggaacattttctggagacgtgccagaaaatgggaacactgttttctctccatcagagaataagacccatgtcaaaagcataaaatgggacatctgagctggtccctggccctgtggacatctatgtcctgaagcacaagacagaggctgtgatggggcctccagcaggatgcaggggagtgggggaggcttgcctgtgaaaagcagtgactcgaattccctcatctttcccagggcagggctgtgagcctccttccccagacaagcatccctgggtgccccttcctgcaaggtgcagtgaggagggagggtgggctggaggggactgtgaggcacatgcaggcagacgccaccacaggagcacagcggggaggctccacatggcctgaggctccctgggcagggccagctggggcaggagggcaccctcatagagacagctggtgccggggtgcaggagaagccccggggaggagcgcagggcagggcagtggccttactcattgggcagcttctccacgtgcagggccacggaacccgcctcatagccgtgctggttgttctcagggacgtccatgtagcgctcagtgtaccctgtgtcgtaggccatccagacggtgaccggggcacccgcgatggccacctgagggacacagcagacagatgggggcagagagagagagagaaacaggcgtcgggtcctacagccagcatcagccgctgtcccggggccgccctggagcccgtgaggagcgctcatgcacatggggccggcaaggaaggggccctcagaccgcgtggcccccgtggacggtgcgtggcatgggggtgggcagggcgccacaggcgggcaggtgcggcccctccccgccgccgcagagggccgggtcccactgcccgtctgcctcctcctcctcctcatcgccgccgccccgcagtgccctgactgccgccggcctggggcccccccgccgctctgcacaccatgccccacctctgcccatccgaggccggggtcccgggctcagcctcccacagagagctgctggcggggttttgtgcagccggatgccatcctgcggtcggcggtggcgggcaatgaggaggggggctcggccccgtggggctgctgcagggagaaacagccacgtggcaaggcccctgccgaggcgcctccccggtaggtgggctccgggtggcgcgggcggtgggcaaacgcggcgtagatggggaagggggcagggaggggcgtggctgaggccggccaggggtgggacccaccttgaacacctggggcttgtggattagccccatgagcgagaggaagcccccgtaggaccagccatggatggcaactcggctcaggtcgatgaagccatacttctcggccacgaactgcaggccctccacctggtcctcgatctccacctggccctgagggatgaagccgggcacctctcagtggcctcctcccggtatgtccctcccctgcagtgacacctctgctcctttcagggcgtctctccctcttggatgaaaagtggctcgctggaagccccctgtccttccaggccctgctaaccctgcctgctatctggggatggctggacagatccagcagccatcttgctctgccacctcccaggtgagtggctctgggagccacgtcccctctgagggcgtcagtttgcccatccctaataaagggacattaacaggaagaggacccattttctagagggcacaaggaagaaaaagacgggtgcccaggcatgtgcaagggcacaaagaatggctggtgccatcgccgttgtcactaccagccacatccccaccaccgccactgccacgatttcaatgctggtgtcccctctgaagtccgtgctgagatcactactgcggccttcaagcgactgatccatggggcccactcatgtgaatgggatgaggggcccttataaaagggcctgatggagggaggccacggcttttccgctccttgcaacccctctgccgtgtaggaagcagcacagggcctctctggagggttgctgaccaggcaacctcgtgggaacagagagcagccctccccgacacagccctgccttggccttggacctcccagcctccagaactgtgagagattttcgttctttataaatccccaggctgtggggttttgttccagcagtgcaaaggggccgagatgatcgccatcaccaccgtcgtcatcaccagtgtcagcacaacttgtctctgtccctgcagggcgcagcccagagctgagcagcaaagcatacatccccttttgttctaaaagggcgcctcattgagcctgcgtcaccccagccagaagtgcccttctgcgggtggtattccagagccgctcccatgccctgcacccacacggcccagggctcccttcccgagacccaaaggacccagagcaacagggaggagttgttaccatttggtttttcagggccccttcgaaccgaagccctcgctgacaggagcccctgccgtcaatcacaaccacggcgtagcccagggaggccagtgtgttgagccgcaagtacttgatgcctttgaaggagttattcaccagctgcacctgtggggaggtgagggccagcagtccagcacgagatgccgggcaggacgggcctggcaggggagatgccggtgggctggggaccgggccgggctggggcctcagagcctaatgaaagcacctgtgccccggaggctctggatggacacctgggagtggcaaggcgggaggggcccatactcgggaccctgctagggagggggaagggccactgtcaggctctttctcagctgggccactgccccagtcctgcctggaacaactactctggcatgatggacattggggtggctccttctcgggtggggccatctgggcactgcggggtgctgagaagccactccaggccaggagaactcgcagtggtgatgaaccacaaagtacccagacatcgccccgtatcctctgtggggacagagctgctctgggtaagatgtgcgcctaagatggtccaactgccaatctgctgcctgcttttgacccctgctccaggaattgggcccagggcccatggccacctccataccaacctggagactaggggacttcctagaggaacaagggagagtcagcaggcggagggggaaggggaggccatccaggaagggcggggagcgtgcaaacgggcacagagaaaggagggtgaggggccccgaggaccctgtgtagtcagggcaggcggggtgggctggggcaccaggcaggtagccggggagcctcctctggttgactgttctacagctggcacttgagtggggatggggagtcctcgggtggatggtggggtgggggcctggggagcaggtgtgcactcacctgggggcctccatatacaaagaggacggtggggtgcttcttccctggctgcaaggcgtggggcttgtagatcatgccgtagagccgcacatccgagcgcgtgtggaaatggaagatctctggaggaacataatccggggggcagcctgcgggagacagggcggctatctggctgcccggggaagccacatccagctgacacccttgttctcctgcccaccccaagccttggagggtggaccaaagcaccccctcttttcctgggcttcccgagagttgataattgaaaaaaacgtttttttttcattaaataagatttgtacagtttttgtagagatggggtcttgtctccctgttgcccaggctggtctcgacttcctggcctcaagcgatcctcccacctcggcctcctgtgtagggtcactgctatttttgcaaagcaacagttgttgtccaattaggatggtgggggtttttctgttttttttctttttcttctttttttttttcaagacaaagtcttgtgatcttggctcactgcaacctccgccttcctgggttcaagcgattatcctgcctcagcctcctgagtagctaggattataggtgcacggcaccacgcccggctaatgtttttgtatttttagtagagacggggtttcaccatgttggccaaacttgtctcgaactgtatttttttttttttttttttgagacggagtctcactctgtcacccaggctgcaatgcagtggcacgatcttggttcacggcaacttgcacctcctgggtttgagcaattctcctgcctcatcttcccaagtagctgggattacaggtgcgcgccaccacatttggctaatttttgtacttttagtagagatggggtttcaccatattggccaggctggtctcgaactcctgtccttaggtgatccacccacctatgtctcccaaagtgctgggattacagacgtgagccaccacacccagccatcgaactcctgaccttgggtgacccgcacaccttggcctcccaatgtgctgggattacaggcgtgaggcactgcacctggcccaaagttttttctttaaataaatgtatgtaggtaaattttggtggggcaatttataggaaggtgagtaaagggtactacaggtctaggggtagcagaagtttactgtggagggccagatagcaaatatattgggctctgggaattgggcgtggcgggacacgctccgtgctgtgtctctgtgtcatctgctgcggtagcgctaatgtggccacagaccacagagggactgcacgtggctggatttggcagcagttggcctgctcctaatgcaggcagtcttcaaacgtggcacagattgggagtttcgggaaacagtgcctcgttccccagggcactgaggttctggtctctgcccccactgctaggctgggtgccctgctgagccccttcccctccctgacccatctcctcatctgaagccagggctccagctcctggcggtgtcggtgcggacaggagagtgaggactgggctctagagggaggcctgggatctgtttctgctcaggggtgagggcatcacaaaatgctttccagcccacggaataccccgcatatgctggaaattcgttgtgtttagaatgttctggaaacccaccaacatggcagagacagggccagggtgggttgtccttgtactgagtgatgcctgggagcccagcagtgtgctgacccgctggttttcatcccacactctgtatatacagtttcgttgataaagaaacacttcatggtgatacgctgatgtgtgtgacggagccagcactggaacccggagtcaccaatgcagggtcctggccaacttccaggttctgggcaaggtgtcaggttgcctcatttcctgaggcccccctgtgactgaccctttgctccttttcctgataaaggcctcggagtgtcggctctgagcaggtgctgctgtgggcggcagcctctgggcacaggacaccataaagggccctctgcatgccgctgtggccaggactgcagggtcctggagaaggtgagtggaaagcctgataaccacggcgggtttcaaaccagtgtgggtggactctgacatcccggccacccctgcatggaccaccactgttcaaaaggttttttttttttgagacggagtctcgctctgtcgcccaggctaaagtacagtggtgcgatctcagctcactgcaacctctgtgtcctgggctcaggccattctcttgcctcagcctcccgagtagtgggactacaggcgcccgccaccatgctcggctaattttttgtatttttagtagagatggtgtttcaccgtgttagccaggatggtctcgatctcctgaccttgtgatccacccgcctcagcctcccaaagtgctgggattacaggcatgagccaccgcgcctggcccaaaatgtttttaatttttaatttttttttagagtcagggtcttgctctgttgcccaggctgaagtgcagtggtacaatcacacttcactgcagcctccgacttctgggcacaaatgatcccccccatctcagtctctggagtagctaggactacatgtgcacactactacacccggctaatttttaacatttttgtagagggagttcttactatgttgctcaggctggtctcaaactcctacgtgcaagcaatcctcctgccttggcctcccaaagcattgggattacaggcagaagccactgtgcccgctgatgaaaatgtttacttgtcacctgcccactaccctgggagctcccagtgacagggtctgtgtctcactggttaccattttggcagggggttggcacggagctgcatccctgccgggttctgtgcagtccggccctttactgcagctcgaacccaggaccgtctcggacggcaggggctgtggcttatgtcctatgacgagttcccagatgcttggaggggcctgggtgctgtgggaggccaggcaggccagctccaggcctctgcctctttccccagcatggggccctcgtcccgttttacagccgggcgggcggaggcctccgtggggcggggcaggggctactcactggctgcctccatcatgctagcccagaagcggggctgcttgtgcagggggtcgtcgtcggggccgctcagcttgtagacgtgcacgcagggcggcgtgctcacgctgctgtagtggctgacgaacatgtcgaagttctgggggtggaatggggtgatgagctccacgggatgccgctgcgccctttccactgggtgccgaccgcagatccagggtagcttccctcccgcccgcccccatccctctgcccctgcctgtcatgaaacctcaaagctccacccgctgctgcaaggggggcaccactgccatcgccccattctgcagagcaggaaactgaggccaggacgagtctgtcccccagccaggggcctatggacagtcaccgaccgctggatctgccgagggctctgccactgcacaggcctgcaagcttgctggctccacagctggcaaactgcagctgactcgtgccctggactaggggtggccctctgcatggccaccgcctgacattctagaatgttctgagaggctaagggccacatcccaccgcacacagagcggcggagccccagctcagcggacgggcactggggggctccaccacttactaccctgggattggtggtgggcaattcactcccttccctgccctacccaggaggcaggggtgggcactgcctgccccaaggcagctatgagaatgcgagaccatgagaatgaccctgagtgctgtgccgggccatgagggactgctctggctgggagctgttggacgggcacagggcggtgccgtgaggctgggcggtcccacctggctcatggagcagctatgggagaagccgggcgtggtgaggcgtacgatctcgccggccgcctcatagctgaccacgtagaggtggtgctccagcggcgtgtccttggtgccctggaagtacaccagcttggtctcctcattgacccagatctgcagggggacaggggatcctcgtgatgcgtcccagatgcccctgggcccacacccctctccacgccccacaggagtgggccccatgttcctcggactggggacgcatgctgtcctcgcccaagtctggctttagggctggagatgaaccatccctgagagatgcgcttatctggccccgtgggctgggagcagcccctggtcgagctgggaactgcgtgtcctcaggcgggacctggggcctgcattccacccccagacagctctttcctagcttgaattgggagggcccaccagagccaggtgggaaggccagggagggcaccgtgcccgaaacagaggctcagggaaacccggcagtccccagcctggtcagccgttcctccgacccaggtgcttgggttcagaagtggcagggccctaccttcctgtgggaagccccagtaggccccgaagtggtgtctcctggaggagtgggagggcagcctgcactgcgtggagcagcggggcccctccttcacctgtgctgggatgctaatggtctcgaaacaactgctgctgcccaggagcgagcaggctttggctgatgcctggaaaggagccgggaggcctcagagccccgagggaggagagggcattgcccctgtgcccagggcctgagaggccggtggaggcagctggagcgtggggtgaccagggaccctaagacgtgaagaaactgaggataagtggtctcctgggacagcggggcacaagcttccagtcgggggagcatcatgccccacaacaaggcagctggacgcatggccccagacggcctgcagaggacacacttcctctttcatgatttctaaaaggcttccaatgttttccttaatttcagggtgaaaggataaagcacgtgaatggcacaacgttcaagatgagacggggaggtgatgaaatgattggcttgtgtgtatggtagacaccgtgctgaggcctgcgaactgctgtaaagcagggtcctcacaggtgtgtgtgcgtgtgtgtatgtgtgagaatgagtatgtgtgtgagtgtatgtgtgtgtatgcgcgtgcgtgtgtgtgtgagtgtatgtgtgtaaaacacacatgcatggagcaggggaaggctgcaaggagaccctggtaccttggagccgtgcctcgccaaaacctcccattcaccgctggtcagagcaatctcttccttaatggggcacttaaattcatctggaaagaaagaaagaagggaggtgaaggggcctgggaggtgatgcaggcgcccaaaggcacccaggccaaattccacccgagcagactcaccatggagccactgaaaccccggcttgctgtgaactcagacgccagcacaggccactgcgtcagacctgccacatgggcaaggaagcctgcggggcctgttcctgccatgtggatggcaggcccagtgtttcccacgataaaccaggagacccgtggctcactcctgaaatcccagcactttgggaggccgaggcaggaggattgcttgaggccaggagtttgagaccagcccgggcaacatagggagaccctgtctctccaaaaaaaaaagaaaaattagccaggcgtggtggcgtgtgcctgtggtccaagctacttgggagattgagctgggaggactgcttgagccaggaggttgaggctgcggtgagctatggttacaccactgccactccagcctgggcgacaacaagaacccgtctcaaaaaaaaaaaacaaaaaacaaaaaacaggaagagaaaccaggaatctggattttcattggaatttcccaattttagaaccctccaaaggccacatgacatctgtgtgtggcacgggaaggggggcggggagtgtgggggaggagccaactgggcccatgacctcttaggacacattaggactttgtaaaaccagactttttttttttttttttttttttgaagacggagtcttgctcttgtcgcccaggctggagtgcaatggcgtgattttggctcactgcaacctccgtctcctgggttcaagtgattctcctgcctcagcctcccgagtaactgggattacaggcacctgccaccatgcccggctggattttgtatttttagtagagacggggtttcaccatgttggtcaggctggtctccaactcctgacctcaggtgatccacctgcctcagcctcccaaattgctgggattacaggcacgagccactgcgcctggccgactttttttgtgggggcgagggggtagagacagggtcttactatgttgcccaggctggtcttaaactcctgggctcaagtgatcctcccacctcggcctcccaaagtgctgggattccaggtgtgagccacatccccggctggaacaagatgctggtgaaagcgctagggctagagaccaaggctctgctggttttatgattgtttttttggggggtaggagggttgacttcatgtttgaattttcaccaggtaaagaatgacagtgcggggtgcatcatggcacacagcagaaacacactgagatggtttgtaactgagggctcactgtcctttcctaaccttttaggtctaaacaagctacggcaaacgtgtctgtcaggagcacgggagggcagatgtggtttccctggcgtagaggtctgggtgtggttacttgtggcatcggggcctggggaggagagcggttcccacccagccccaagacccaggctcctgcccgcgtcccgacgtgttccttctgatgcaatgtcacttggggtcacctcctcgccatgcagctgctgtctaggagatgcatggtgtgtgctgggggctgagcagggtgctgggaaatctggtgtgcccacctcacaggccgggggtccctgggggcactgcagcagcctggagggtctgtgcccctggagagtggcagctgcagctggctccacttgagaccacatttgaaacgtgagcactcgggctggcccattttcccacagggggcaaaatgagcatttacatgaaatcccaatgccagatggcggtggctgagccagccagacagaaagtgaaacaccaatgagccgaagacagctcccctttgagacgcttagccagtaagtctgcactggccgcatcccacccaggaggaccccgatgctggcctgaggcagctgtcaccccgccggtccgcatcatactcagctccgtggcagcctacagcatcacctgtccctggctcattcgcccttcagctcctgcagtcccggatgcctcgctccctggggtctctgtcccctgtgttgggggacgccttggctgctgtgtgggctctgcccccagagggcaccggaccacatctagggacatctgtggttgtcacaactggaggtgctcctggcatggagtgggtggaggccagggatgccacttggtgcacaggatggccccgccccagagaaccacccggccctggcgtccatggtgtccctgctctaactttgaagagcctgggccgggctcccggaccaccccacctctctatccagaagtgacccttgggagctctgtcccatcccgaggctgacactgtcagtgtgcaaggacacctgcaatcccaccaggagtctcggttccctgagctccaggcacgggaactggcccatacagcatctccactaccgggcacctcaacttgaacacatccaaacccgactctggattttttctctcctagaacagtccctctctgagtctgtcttagactggacctgcggagccctccgggcatccatgccgcctccctcctctctgatcccccaccctttccactgcaaacggtgtgggctcagctgtccaagcacatccagaatcagacccaccaggacagctcagccactgccatgacagcaagcctgtcgcctctcccggcccctgggcctgtgtgcaagctgcaaccagaggagtcatctgaaactgaggtgagggtgacgacttcctatttctctcggggtcaaagcccaagtcctcctggagccccagcaggccctgcaccatctgctttttctctccccaccctctcctccctctctccccctcctccctgtgctccagccacaggggcctcctccctattcctccaacatgccaggaacagtcctgcctgccccagggcctttgtacgggctgtggctctgcccagagccgtggtgtggacccctcacctccacagcatgctctccagagacgtcctcatgccctcccgttgtagaaagaaggcccctcaccctcaagcctctcgcccgactgcatttccttccaccacgcacatcacaccagaggcagcacctctaactgtttctggaatactgcctcctccactagaaggtcccaagagcagggattttcctttttctttatttacagtgaacaattccatcacagctacctacagcaggagctggcaaatgtttctacaaagggctagacagtaaatcttggccttgcacaacagtttctgctgggactacccagttctgctgctgcagcacaaaagcgaccacagacagtctctgtaaacaagtggctgtggctcagtgccaataaaactttatttatgaacacaggtggtgggccggatttgacctgtgggccgtaggtggccaacccctggttgtgctaagggcctggcacaggggaggtgctcagtaaatctgctgcctgaataagccaacagttgggtgctctaagccctgccagatcatgcagtcactggggaaggctggcttcctgccgatccctgttccttctcccgcagggtgtgctggctgagtgggggggccgaccaatgaacaaacagcatattgaaccacacgtgactaacgcgatgagtcgacagcattcgtcaggctctgctcaccttccccggggctgaagggctcactccaatcgtagccctgggattttaaaacggcggtgactttgtacaaatggcagaagccggtcttgcattcattggcgcggagaaagcagagctcgtcctctccctctgattgggggaagggatagaagatgtcatgaacctgtccggaaagcagatagaagatgcgtcagaaggtgtgggtggccgggcatggtggctcacaccagtaatcccagtagtttgggaggctggggcaggagacttgcttgagcccaggaatttcagagaccagcctggacaacatagtaagaccccacctctaaaaataaataaataaattagccaggcatggtggtgcaggcttgtggtcctagctactctggaggctgaggtgggaggatcacttaggcccaggaggtcaaggctgcagtgagctatgaccacaccactgcactctagtctgggcaacagagcaaccctgtctctaattaaagaaaaaaatagatgaggggagaggctccaatggctgccagactcaccaacccccctagaccctcttccctgccagccagggatggccaaggcctgagctcacttctccacacaagggcaaacaccacctgccattggcgctcagccttctaggacgtgggggtggggacagtgtgactccagggcccaggcgggcatacagccagcgcttgccccgcttacattgatccagacgttggtgacctcctcgtacaccacatacggctggacattcctggggacagctctggcagaggctagccgctgctcctcattctctgtgctcgggatgaacagggccggggggaggaggacgagctggagccactgctggggccggtccaggaacatggcccaggcgctaagggggaagatgcgggggaagatgagagggaagctgggagcctcagtggcctgcacagagaagctggggacgcagcgtccaaacccgtgtggaatcagggctgggcttcctgcgctggcttcacctgcacttggccaagtaaccctgcagcacccacaggcttccttcctggcacatgcttaggggaggacaggatgggtgacaagatttcatgatccaagtgttccggaaacaatggcctaagtctcacagcggcaagctctaatagtttctcctcttcactgactcttcggcccacagtcgctatcctttatttcgtagtttgctttattttatttatttatttctttatttaattttttgagacagagtttcactcttgtccaggctgaagtatagtggcacaatctcagctcactgcaacctccacatcccaggttcaagcgattctcctgcctcagcctcctgagtagctgggattataggtgcctgccaccatgcccggctaatttttgtatttttagtagagacaaggtttcatcatgttggccaggctagtctcgaactcctgacctcagatgatccgccagccccagcctcccaaagtgctgggtttacagacgtgagccaccgcacctggcctaaatgaacaatttttaaacttgaatttattttaagaggagatgttagtattctacgtggaaaagcagcacctccacacacagaacaacgaaaaccaaaccaaagggaagcatcacagggacataaaatactaactagagtgggtgcctgggctcaggcctgcaatcccagcactttaagaggctgaggtgggcgggtcgcttgagcccagaagttcaagacctgcctgggcctgggcaacatggcaagaccttgtctctacaaaaaaaaaaaaaaaagtccaggcacagtggctcacgcttgtaatcccagcactttgggaagccgaggggggcggatcacaaggtcacgagtttgagactgtcctggccaacatggtgaaaccccatctctactaaaaatacaaaaattggctgggcatggtggcacgtgcctgtactcgggaggctgaggcaggagaattgcttgaacctgggagtcagaggttgcagtgagccaagatcataccactgcactccagcctggtgacagggcaagactccgtctcaaaaaaaaaaattaaaatattagctgggagtggtgactcacacccacagtcctagcaaatgtacatatggcagcagcacataatagaattcattgttaacattccattggaggcattaaccaatgcaattagaaaagtgaacaggctaagaggcataggaatgcaaaagcaagaccctcatatctataaaaaatacaaaacattggccaggcatagtggcgagtacctatagtcccctctactcaggaggctgaggtgggaggattgcttgagcctgggaattcggggctgcagtgagttatgatcgcaccactgcactccagcttgggcgacagagcgagactccatctcaaaaaaaaaaaacaggcagaggctgaatttgcccactggggtttggggcccccgtttagggaggtggtagagttctctcctcgacatgggtgggaggctggggagtgagtacaggggagcacctctactttgtgactcagtttttctgagcctgaggtctggggacacctgaaatcccctctgtaggtctcctccacactctgggtaactggatcagcatgtcctagtggcactaacactgggactcataagtccagtgtttcatcctcagactggctgaggtcaggagggccctttggacactggtctgaggcctgtcctggcggttgcactgcgggaagacgtgagcagatggaaggaatggcacggaaggccaggaggcagcttcggtggctgcccagggcccagggccctgcaggtgaattccttgggttccagccagagacactcactatttgccatcccgggtccacccggccctggcgatgtactccaccttcgggaacagcgagctgaagggctgcaccagctccttctcctgggtcgagacgatct

SEQ ID NO: 6873 - DNA, 210 bp, Homo sapiens
ttcacgccattctcctacctcagcctcccaagtagctgggactacaggcgccctccaccatgcccggataatttttttgtatttttagtagagacggggtttcaccgtgttagccaggatggtctcgatctgctgacctcgtgatccgcccgcctcagcctcacaaagtgctgggattacaggcgtgagccactgcacctggcccaacat

SEQ ID NO: 6874 - DNA, 737 bp, Homo sapiens
aaatctatttttttttttttttttttttttttttttgagacggagtctcgctctgtcgcccaggccggactgcggactgcagtggcacaatctcggctcactgcaagctccacttcccgggttcacgccattctcctgcctcagcctcccgagtagctgggactacaggcgcccgccaccgcgcccggctaattttttgtattttttagtagagacggggtttcaccttgttagccagatggtctcgatctcctgacctcatgatccacccgcctcagcctcccaaagtgctgggattacaggcgtgagccaccgcgcccggccgcaaaatctattttttaaagtgaggtgcccagaatgaagaaaagatggatggggacccttccctccctcaagcaggtcagattgctgggaatgatggtccaggctcctggcccccatcctttcctgtcaaggctacacctaagtgagggtaaaaaatcctggagaaaaccactgcaggaggcagaagcctccccagtgtgtcctacttctgaattctgttattggaccaaaagagccctctgctcttctcctccatatttttcactgttgctctctgggtaatcagaggcagagggaaaaaaaagtaacctttcctgatactcttgcccttgtattttgttcaaaactctctgttaccaaaggaatgattaggaacctcagttggaggttctgaaatcaaaatcattgcgttg

SEQ ID NO: 6875 - DNA, 138 bp, Homo sapiens
tttttttgtatttttagtagagacggggtttcaccgtgttagccaggatggtctcaatctcctgacctcatgatccacctgcctcggcctcccaaagtgctgggattacaggcgtgagccaccgcgcctggcctagaa

SEQ ID NO: 6876 - DNA, 4702 bp, Homo sapiens
tttgtttgtttgagacggagtctcgctcttttgcccaggccggagtgcagtggcgtgatctcggctcactgcaagctccacctcctgggttcacgccattctcctgcctcagcctcccgagtagctgggactacaggcgcccgccaccatgcccagataattttttgtatttttggtagagacggggtttcactgtgttatccaggatggtctggatctcctgacctcgtgatccgcccgccttggcctcccaaagtgctgggattacaggcgtgagccaccgtgcccggcctgttctttaaaaagaatattagattatattttctaaatgtgccaagtatctaagaatatattctttcacctcctgctgataagagttatacatttaaccttaagcaaatctgccaagattctatgtcatttatgctttgatttatgtgagtattaatgtagtttctgtgactattgtatggttatatataccctccacctagtaaaacagttccatattcctggaaatggtcttttacatcccacaaatgtagctggaaaggaataatataaatactaatggtttgagagacaactagtcttgacatgtcttggttgaatagtgttctataagcaacaatatatgaaatactagacacacccattaaaagtagaaaatacccactactgttctaaaattattctgcaagatctcaccaatgcaatgagacataaaacagaaataatgggtgtaattattgaaaattggagataaaatttttattacttgcaaacaaaattctctgtgtcaaaaacctgataaattaaacaatacaattaatatgtttaatagaactaattacatatgagaggcatccaaaatccattttttctatacaaacatggtttgatatacacagtcttgttttatctgtgtattaattggttgatgaaataataaatggaaaaatcaagtatgcattatcaggttaaagaagcaggagagacagagccataaaaacaaagagagaagaatgttgtaaggagggcttaacgaccaggataaatgttgtagagagatcaattaaagtgatggcctagagatcacaggcttcctttggcagagccatgttggtgaagtgaaggaagtggaagccagaccacaatggttgaagaatgaatgtaatgtaagagccaagacatttatttgagtttgatagtaatgaaaaaggacgagaattttcttcttgctgttgtttttgtcatttcatgttcaaaaccctttatctcccatgtgggactgaaaactccaagatgggatctctgtttctgtgaggcctgtagtgcttagtacatccttgaatgtgtgaggctctcattggtataagtttaattcctgactgtggatgaaagctttaaaactttgtgggcaaaatacagaatgaatttcagtgagttcccatgtattaaacaaggtggcgctggctggagacatgctgtccctgtgcccacaggagtagcagtgctgtgctcatcttcctgacccgctcttcacagtcttcaccgcctttcttcaggagtctcccctttggcttttccacagctatgaaacccacgtagtcggacaccctgatgcttctcctgcagggcgtgtgatgaggaggtgagcttggctttggagtgctgggaacctgaggaattgccaaggacccagagcccagccctgaccacccagagagcccaaaacacaatgaacaaattgaatttccacaacagagtcatgcaagaccgccgcagcgtgtgcattttccttcccaatgatgaatctctgaacatcatcataaatgtgagtagatctcaatataattctgatagctggaggatagtgtattttcaggtttgctggaggaaaaaaactggactttaaataattaagacaaaatgattgtattaattgacttctatgcttaatcactaatttcactttttatatttcccttgacttttgggggagaaatagtctttgtctcaaaagtgggcttcagtgacctatgggtctgatgaagcaaccagggataatgagacaaggatatttaatggcaacatgccagcaattattattagttaattgaaagcgtttatgattttggcctggggccaatgctttccccctctgctgggctaacatgtgggtaagggagaggaaaagctttgtttcactttttaaataaaagtattacgtaactttgaaatttgtataaaattaaaagatagtaaaaacaactattctaacagaattcaaaacctgttatgcttcagtggagagattattcaagataagtctgtgggaaattgggagtacatttctactggcaaagttagtgataactatgcacttctgacaaaatgtgaaatggggggtatgggcgtgtcatatcatcatggtgcagatacgtggatgtgtgcttccaaacaatggcaacctaactgactgctggaaccatacaaaatacctgaaactactcagaaagaaggtgaaaattgcatgcaaaaattatttgaaaaatattgagctaacacaacatgaattttgaattataagtgaggtattgtaactcacctacagatgtgttttttgtaatcaatattcatggactcagactacacagtaaaagcttacatagaaatcattctatctaaactttctggatatgaaagtaacttactatgtgttttgctactatatctttatatgaatttaaatcacatttccaagtggcttacagtaatcaaggttaatttgtcacaaggaagatgcaaattaaaaccacattgcaatatcactgcacacccactagtacggtttaaaagaaaaaaaaacaaaatatcaagtattggtgaaaatgtggagcaaacagaactctttttcaataatggcgggtatgtaaagtggcacaaacactttggaaacctgtttggcattataccatactaaacctgaacacatgcattgtttatgacccaggaatgcccctcctgggaaccaacaacaacgcatatatgtgttgcatatgttcaccaaaagacatttacaagaatgttcatagcagcactatttgaaatcgcccccaagtagaagatgcacaaatatttaacagtagttagataaagtgtggtacgtttatgcaatataataccatatagaaacgagagtgagggatctgcaaactaatatgcaactgtacaaatgaatcccacaaatataatgttgggtggcagaagccagatgcaaatgaatacatgctgtagatttcattcttttacattaaaaaagctagtcacacaaagttatgctgttagaagagagtgatttggtcgggcgcaggggtagttacaggaagggagtacacggagatttctggttgttagttatgttcagtgtcaatctaggtgctaaacaggtacaataaagattttagaattcatcaatttgcacacttatgatagatgcactttcctgtatgtatatttcaatacaatcttttaaaaagtaaaatgacaaaaagacactattaacaaaaatgacatattacattaactgttatactaaggaaaatataaaaatgagttctataacaggggctctgcaggtcatgtggtcatgccaaggaccatatgtgctcaagattctcatgacattttggaaggaggttgggctttctttatctttcctttcttctctcccttcccttcccttccctatttttaaacctaggtttggtattttcctggggtgatggtgactttggaaaattgggccggggcggaagtgaaggctgcaacattccccagaacattgagagactaaatggacagggggtgtgccagattgagtgtggagctcagttcctactggcgctcaccaagtctggagtggtgtggacatggtacgtaaacgtcctccccatcacagtgtgcgtgcttgtgccggtgcgtgcagggaacttgggcctcgccccaggaccaccccggcgtgattgtgacctgtcatatttttacttatgcatgcatctttgtcctttaaaggatattgagtcgggattagtgacaatagtacaagaagaaatttcctattgtaactgggtcattttgaaaatactagaaaaattttaggccacttacctttcctgtttgggcgagatttataggaagtgtttcttctgctgaagcctaaggataaaatgagagcaaaatagccttctgaatcctttgatcctgagaaagttaacatgtatttcttgttaaagcttattatattaatgtgcaaaagagcaggtgcccagactggccttggatgctgtgtcaggccttgctgcctctggtcataacattggcactatttatttatttatttatttgagatggagtctcgctctatcgcccaggctggaatgcagtggcacaatctcagctcattgcaagctccgcctccggggttcacaccattctcctgcctcagcctcccgagtagctgggactacaggtgtctgccaccatgcccggctaatttttttgtatttttagtagagatggggtttcaccgtgttagccaggatggtctcaatctcctgacctcgtgatccacccacctcagcctcccaaagtgctgggattacaggcgtgaaccaccgcgactggccaacattggcac

SEQ ID NO: 6877 - DNA, 299 bp, Homo sapiens; identical to SEQ ID NO: 6864

SEQ ID NO: 6878 - DNA, 295 bp, Homo sapiens
tttttgagacggagtcttgctctctgtcacccaggctggagtgcagtggcgcgatctcggctcactgcaagctccgcctcccaggttcacaccattctcctgcctcagactccagagtagctgggactacaggcacccgccaccacgcccggctaattttttttttgtattttttagtagagacggggtttcatcgtgttagccaggatggtctcaatctcctgacctcatgatccgcctgcatcggcctcccaaagtgctgggattacaggcgtgagccaccgcgcccggccca

SEQ ID NO: 6879 - DNA, 4364 bp, Homo sapiens
tttttgtttttgagacggagtctcgctccgtcacccaggctggagtacagtggcacaatctcggcttactgcagcccatgcctcccaggttcaagcaattctcctgcctcagcctcccgagtagctgggattacaggcgcgttaccaccacgcccagctaatttttttatttttagtagagacggggtatcaccatgttggccaggctggtctcaaactcctgacctacagtgatctacctgcctcagcctcccaaagtgctgggattacaagcatgagccactgcgcccggccgagaaagaagtttaatggtaggataattaaagagatgggaggaaacctcaaatctatctccccaaggaatttgaggttagggttttaaagggttttggagtgggccaaagtgtggagattgttgattggttgaagagtgcaggatgaagtcataggacttggagatgaagaaactgtattcttggccaggttgatgcctataatcccaacactttgggagcccaaggcaggaggattgcttgagggaagtagttcaagaccagcctggctaacatagggagaccccatctctacaaaaaattttttaaaattagctgggtgtagtggtatctacctgtagccccagctactaaggaggctgaggctggaggattacttaagcccaggagtttgaggctttagtgagctatgattgtgccacttcactccagcctggctgaggagcaagactctatcttaaaaaaagaaacaagtatattcttgtgctgatttggttcctctctgagggtcttgaaactggttggcttcagcctttccactagaattcaggatcctgagaatatcttaagcagtctttaaacgaaagccttataattccaatgtcagagatcctatctataggaacaatgggaatgcaaatagtcagtatctagtactacatgactttcagcaaaaggaaagtgggccaaagggcagcctgattaatttttaactatatttctgtccagaacctggcatgcaattcatgtcaccccactggggatattttcagagttatatttatcgagtgacttgaccaaaaccaataagcccttaatggcttaactgtgggtataaggggtgtcttcatagagggtgcaaagatacagccctccccccaactgccaagatccagaaccactcccagagatagccaaaagacagagaatcctctgagagctggcaacagttggtaggaccctagatacaagtagggtgcaacccccatttctgtccggccatattattgggggctgccaacctttcagttggctgcctgcaaatacaggcttgataacctgtgtgcccggacaggtagaaagccaagctaagctttcaggacacgagaccaacaggaaagcaaaagctgtctctgagagggaaaggatcaagccagagtcataatccaaaaaaatcaattggtacagatgttttcctcctgctaatcaaagttagaaagtaaggagcaaagaaaagtgtttgccttcctcttctctactaggtgctacagacagatccaggagagttgactttggtaagaattcttacccttagccagcttctgtcagtttccccgggatctcattggcaggttccagagtgagcagggtaccccagagatcctatcctcatcaccagaaactctaggggaggaaagataattttctctctacccttcatagttgttaattgtgatggactcctgtaacaaaagatagattcacaagagaaaaacagtttaatagcttgtacagcagtccccccttatctgaggagagtatgttccaagacccctggtagatgcctgaaatcacggatagtaccagaccctatatatacattttttcctatacatacctatacttcatttataaattagacacagtaggagattaacaacaataaaataggacaattgtaacaatttgctagcattactactcttgtgctttggggccattgttaattaaaacaaagattacttgaacagaagcactgcagtactgcaacagttgatctgataaccaagatggctactaagtgactaatgggtggtatatacagtatggatgtgctgggcaaaggaatgatttgcatcttgggtgggatggagcaggacggcatgagattccatcatgctattcagaatggcatgcaatttgaaagttaggaattgtttatttctggaattttccatgtaatattcttggaccatgttgaccacaggtaactgtacccagggaaaacaaaactgcttataaggggggactattatatgcctcatgtatacatccaaccagggaaggatgagtaaatctccccttctgttgtatttgattgatttttttttgtagtataccgttttgattctcttctcatttccttttatgcatatcttttttttaaatagaagcaaagtatcactgtgttacccaggctagactagagctcctgggttcaagtgatcctccctcctcagcctcctgagtagctgggagtataggtgcacgccacctcgcctggcttattttcatatatatatcttttagggtttttttcttagtggttaccctggggattatgatgggcatcttaagtttacaactaactagtatgaattaatactaatttagcttcaatagtatatataaaaactgcttctatacagctctacctctcctcctttatgtagttattgtcccaaagtacatctttatatattgtgtgcctatttagagatgaaatctttctcagatttcttagtctgaaatagccaatgagacattcttaagttgaaagcaatataaatattggcacgagttgcttttagatattcaattgttttgtgttaatttaaaaatcccttctgtgcataaacgcattttcttttcattaactatatgtcagaagtttgtttcgttggtttgtttttgtttgagacagagtttcactctgtcacccaggctggagtgaagtggcgtgatcttgcctcactgcaacctccatctcctggattcaagctattctcctgtctcagtcacccgagtagctgggattacaggcatgcgccaccacgcctggctaatttttgtatttttggtagagacggtttcaccatgttgaccaggctggtctcgaactactgacctcaagtgatctgcccgcctcggcctccaaaagtgatgggattataggcgtgagccaccgcgcccagcctatgtgtcagaagttatttttttaaacatttggcagatagaattttttattaagtacaaagaaatttttcctttgttgatttgtttaaatcattggtgtgtgaatatcttgtgaaagcattttaaaaagtggtcataagattcttcaggccgggcgcggtggctcacgcctgtaatcccagcagtttaggaggccgaggtgggcggatcaccaggtcaggagttcaagaccagccttgccaacatagtgaaaccccgtctctactaaaaatacaaaaattagctaggcatggtggcgtgtgcctatagtcccagctactcgggagactgaggcaggagaatcgcttgaatccgggaggcggaggttgcagtaagctgagatcatgccactgcattccagcttgggtgacagtgtgagacttcttattaaaaaaaaaattatttgtaatggttaacattatacctaaaagggcagtatggaatttgctggatttttaaaagataacacaagtgagaagcaaagacaaattttcttagaatcaggcctacataatgaattagacttctgtcctaaaacacaagcagcaattcagactatggaattagcatctttcaaaggtttatttctaattcctctttgagttaaggattatgaggcagaaagataactgtataagcattttcctctttatctttcaaacatattaaatttttaacataatttatataatgttcaggaatttcaagtatcctacttaatatggttttttttttttttttttttttgagacggagtctcgctctgtcgcccaggctggagtgcagtggcgcgatctcggctcactgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggcccttaatatggttttgcatgtgattgttt

SEQ ID NO: 6880 - DNA, 4721 bp, Homo sapiens
ttatttatttatttgtttgtttgtttgtttgagacggagtctcgctcttttgcccaggccggagtgcagtggcgtgatctcggctcactgcaagctccacctcctgggttcacgccattctcctgcctcagcctcccgagtagctgggactacaggcgcccgccaccatgcccagataattttttgtatttttggtagagacggggtttcactgtgttatccaggatggtctggatctcctgacctcgtgatccgcccgccttggcctcccaaagtgctgggattacaggcgtgagccaccgtgcccggcctgttctttaaaaagaatattagattatattttctaaatgtgccaagtatctaagaatatattctttcacctcctgctgataagagttatacatttaaccttaagcaaatctgccaagattctatgtcatttatgctttgatttatgtgagtattaatgtagtttctgtgactattgtatggttatatataccctccacctagtaaaacagttccatattcctggaaatggtcttttacatcccacaaatgtagctggaaaggaataatataaatactaatggtttgagagacaactagtcttgacatgtcttggttgaatagtgttctataagcaacaatatatgaaatactagacacacccattaaaagtagaaaatacccactactgttctaaaattattctgcaagatctcaccaatgcaatgagacataaaacagaaataatgggtgtaattattgaaaattggagataaaatttttattacttgcaaacaaaattctctgtgtcaaaaacctgataaattaaacaatacaattaatatgtttaatagaactaattacatatgagaggcatccaaaatccattttttctatacaaacatggtttgatatacacagtcttgttttatctgtgtattaattggttgatgaaataataaatggaaaaatcaagtatgcattatcaggttaaagaagcaggagagacagagccataaaaacaaagagagaagaatgttgtaaggagggcttaacgaccaggataaatgttgtagagagatcaattaaagtgatggcctagagatcacaggcttcctttggcagagccatgttggtgaagtgaaggaagtggaagccagaccacaatggttgaagaatgaatgtaatgtaagagccaagacatttatttgagtttgatagtaatgaaaaaggacgagaattttcttcttgctgttgtttttgtcatttcatgttcaaaaccctttatctcccatgtgggactgaaaactccaagatgggatctctgtttctgtgaggcctgtagtgcttagtacatccttgaatgtgtgaggctctcattggtataagtttaattcctgactgtggatgaaagctttaaaactttgcgggcaaaatacagaatgaatttcagtgagttcccatgtattaaacaaggtggcgctggctggagacatgctgtccctgtgcccacaggagtagcagtgctgtgctcatcttcctgacccgctcttcacagtcttcaccgcctttcttcaggagtctcccctttggcttttccacagctatgaaacccacgtagtcggacaccctgatgcttctcctgcagggcgtgtgatgaggaggtgagcttggctttggagtgctgggaacctgaggaattgccaaggacccagagcccagccctgaccacccagagagcccaaaacacaatgaacaaattgaatttccacaacagagtcatgcaagaccgccgcagcgtgtgcattttccttcccaatgatgaatctctgaacatcatcataaatgtgagtagatctcaatataattctgatagctggaggatagtgtattttcaggtttgctggaggaaaaaaactggactttaaataattaagacaaaatgattgtattaattgacttctatgcttaatcactaatttcactttttatatttcccttgacttttgggggagaaatagtctttgtctcaaaagtgggcttcagtgacctatgggtctgatgaagcaaccagggataatgagacaaggatatttaatggcaacatgccagcaattattattagttaattgaaagcgtttatgattttggcctggggccaatgctttccccctctgctgggctaacatgtgggtaagggagaggaaaagctttgtttcactttttaaataaaagtattacgtaactttgaaatttgtataaaattaaaagatagtaaaaacaactattctaacagaattcaaaacctgttatgcttcagtggagagattattcaagataagtccgtgggaaattgggagtacatttctactggcaaagttagtgataactatgcacttctgacaaaatgtgaaatggggggtatgggcgtgtcatatcatcatggtgcagatacgtggatgtgtgcttccaaacaatggcaacctaactgactgctggaaccatacaaaatacctgaaactactcagaaagaaggtgaaaattgcatgcaaaaattatttgaaaaatattgagctaacacaacatgaattttgaattataagtgaggtattgtaactcacctacagatgtgttttttgtaatcaatattcatggactcagactacacagtaaaagcttacatagaaatcattctatctaaactttctggatatgaaagtaacttactatgtgttttgctactatatctttatatgaatttaaatcacatttccaagtggcttacagtaatcaaggttaatttgtcacaaggaagatgcaaattaaaaccacattgcaatatcactgcacacccactagtacggtttaaaagaaaaaaaaacaaaatatcaagtattggtgaaaatgtggagcaaacagaactctttttcaataatggcgggtatgtaaagtggcacaaacactttggaaacctgtttggcattataccatactaaacctgaacacatgcattgtttatgacccaggaatgcccctcctgggaaccaacaacaacgcatatatgtgttgcatatgttcaccaaaagacatttacaagaatgttcatagcagcactatttgaaattgcccccaagtagaagatgcacaaatatttaacagtagttagataaagtgtggtacgtttatgcaatataataccatatagaaacgagagtgagggatctgcaaactaatatgcaactgtacaaatgaatcccacaaatataatgttgggtggcagaagccagatgcaaatgaatacatgctgtagatttcattcttttacattaaaaaagctagtcacacaaagttatgctgttagaagagagtgatttggtcgggcgcaggggtagttacaggaagggagtacacggagatttctggttgttagttatgttcagtgtcaatctaggtgctaaacaggtacaataaagattttagaattcatcaatttgcacacttatgatagatgcactttcctgtatgtatatttcaatacaatcttttaaaaagtaaaatgacaaaaagacactattaacaaaaatgacatattacattaactgttatactaaggaaaatataaaaatgagttctataacaggggctctgcaggtcatgtggtcatgccaaggaccatatgtgctcaagattctcatgacattttggaaggaggttgggctttctttatctttcctttcttctctcccttcccttcccttccctatttttaaacctaggtttggtattttcctggggtgatggtgactttggaaaattgggccggggcggaagtgaaggctgcaacattccccagaacattgagagactaaatggacagggggtgtgccagattgagtgtggagctcagttcctactggcgctcaccaagtctggagtggtgtggacatggtacgtaaacgtcctccccatcacagtgtgcgtgcttgtgccggtgcgtgcagggaacttgggcctcgccccaggaccaccccggcgtgattgtgacctgtcatatttttacttatgcatgcatctttgtcctttaaaggatattgagtcgggattagtgacaatagtacaagaagaaatttcctattgtaactgggtcattttgaaaatactagaaaaattttaggccacttacctttcctgtttgggcgagatttataggaagtgtttcttctgctgaagcctaaggataaaatgagagcaaaatagccttctgaatcctttgatcctgagaaagttaacatgtatttcttgttaaagcttattatattaatgtgcaaaagagcaggtgcccagactggccttggatgctgtgtcaggccttgctgcctctggtcataacattggcactatttatttatttatttatttgagatggagtctcgctctatcgcccaggctggaatgcagtggcacaatctcagctcattgcaagctccgcctccggggttcacaccattctcctgcctcagcctcccgagtagctgggactacaggtgtctgccaccatgcccggctaatttttttgtatttttagtagagatggggtttcaccgtgttagccaggatggtctcaatctcctgacctcgtgatccacccacctcagcctcccaaagtgctgggattacaggcgtgaaccaccgcgactggccaacattggcac

SEQ ID NO: 6881 - DNA, 5635 bp, Homo sapiens
taacattttaaaaattgctgtattcaaaattaataataaactttggggtaaataagctttaaaacaaaagtacataagcaaaaataaataatttacaccaacccactaacctaattttcagagtaaagccatttccaattacagtactgttatcccgggcaccagcctgtggttaaactttgatgattcattatttttaaaaaacagtaataaaaattgaatactaagcaaaatctttaacaaaaccactggatttaactttttaattttaaataaccaaattttataattttgtacataattcaatgtaatgccaatataattagcatttcagcttgaagagctggtttttaacagggatgggaaactataaattattcaaacagtctgcaaaccatgagatacaaataaaaatggacaagcatatagtagaacaaaaaccgcagacactctactaactggggaaatatctgaaggctttacaccctttattatccataatggcttttggaattacgattgtgtgacatatagaacctttgatattttagatacagcctttatttttttttccacgggaagttaaaaatccatcataagactccataagactttactagtcttgcatgtagactctaggagtttgtgatctgataaaagagtaacatgaaaatttactgtattgccctaatttcatacttccttgtacacaatgaatcactctgagaatctattccaagggttatatacacaaaagtgtcaagaataaaatgttctccactctcgcataaaaatgtgtacagtgtatcaggaatggaaaacttctaattttcctgggcccgggcttcatggatttctgctgccagaagatgaaagactccttctgctttattgctccattgttctgaggattaatcatccaaccctggcgtttctccttgttggattctagacgctattctgatggcttcttccagagatggctgttctccaagctgaaacaggaacacacacatcaaacgctaacaattcaaaagccacagtcaagaaaatgccaaagaaatgttatatgccagaagtgaaacttctctctgtaattctgacacttgggattgttaaaatactactgctaactcaaacattaagagaacaaaacaatttcctgcaggggagaataatgcaatgcaatttctttttcttttttgaatttcaaatcctatgtgcagccaggcctggtgatatgatgaggtctcagcggggcatggtggcccatgcctgtaatcccaacactttgggaggtggaggcaggcagattgcttgagcccaggagttcgagaccagcctgagcaacatggcaaaacgccccatctctactaaaaaaatacaaaaattggctgggcgcggtggctcacgcctgtaatctcagcacttcgggaggccgaggcgggcagatcacgaggtcaggagattgagaccatcctggctaacacagtgaaaccccatttcatttctactaaaaaatacaaaaaaaaaattgctgggcgtggtgatgggtgcctgtagtcccagctactggggaggctgagggaggagaatggcatgaacccaggaggcggagcttgcagtgagccaagatggtgccactgcactccagcctgggtgacagagcgagactccgtctcaaaaaacaaaaattagctgcgcatggcagcgtgcacctgtactcccagcctgccgtgcctggcctgcaatttacttgggattttgataaaatcttcatacagtctggccatggtggctcatgactataatcgtagcactttgggaggctgaggcaggaggatcacttgagcccaggagttcaagaccagcctgagcaacatagtgagaccccatctctatttatttttacataaataaaaactaaaaaaaaaaaaaattcatacatgcaagagacaaaagatgcttacctcagccaacaaaagagagcttcttgagcctttagcttctatacccataaactacataaagccaacagctgacatttcctggagtgtgttctaactctttatcaagtaaacacgtgggcggaaaaaaaatctccctaaggacaggtaatctgcacctagcccctaggattctattttactttacattctaattttttttttgagacagggtctcgctctgttgcccaggctggagtacagtggtgcgatcttggctcactgcagcctcaacctcccttgctcaagtgatccttccacctcagccacctgagtagctgggactacaggtgcacaccaccacacctggctaatttttgtatttttgtagagatggggtttcgtcatgttgcctgggctggtctcttattttttgagatggggtctcatttgttacccaggcgggagtgcagtggcacaatcttggctcactgcagcctcaaatctcctgggtacaagtaatcctcctgcctcagcaccccccaagtagctgggcactacaggcagccgtcaccacacccagctaatttttgtgttttttgtagtgatggttttcaccatgttgcccaggctggtctctaattcctaagctcaagctacctacctgtctcagcctcccaaagtgctaggattatagggatgagccaccatgcccggctgcacctaagattctaaattctctgcttcccagagaatgattccttctaagtcttctgacattccccactttaaaatgggggctgtgcaaggattctcagaggacttatttaggatttgtgtttccactaggtttttctctaaggagtagctcttaagtgctttacagacccctgcctaattagacttttattttgagagtaaagatgcctgggtgggtgcacacagggatatatacctgaaggttttttttcttgctataaattcccctagaatatgcaaagatgggtagagaacaaagtgctggtctttttgagtccacctcaaatacaccgatttccttaaagtaggctaggtgatagagattattctacaccttgcctcctgtaaaggttatacacgaagcacagtgtacaaagttgaaagctatgagcagcactgctgtcgactgaggacagtatgccttggtactcacctgaactgcaatctgggtgccattggatgttgctactaaggtcagaggtctggtttctgtggttactaagtgatggctatgctgctggtgccccatttctgatgaggcagtatggaatgctgccaagtcttgagctacaattgcaaccttaagcaaaacaaaacaaaccatacacataaagaattaaacctgcgatttaaataggttaaagtccacttaatacaatggatttcttcaaattgaaaaggaaaaactcctctgaccatagacttgtcaaagcctatattgaaaggaggtttatttgaggaagttgaggctcattatctaaggttatgaagtgagccaacggcaaaatagggtagagaacactggagaaatggatctgctatgccaggccccattagccagggagatgtggctgtacctagattctattacccctaagtgactgcttgggaagttatgtatgtggactaatttgcacctcaaatgtccatttttttttcctgagattggctcataggagaaaataaatgatttttttcctctttacttgtcgtatttaaaattagatttccatttaactaggaaaactgaaaggaccagtggtactactgacaaacagcatctcatctcatactcatttcccattttagactccatggaatcttcccatactcctcttgcagcatctagccaggaggattaaaagggcttttgtggctcttataccacaagtacaactttttaaaaaaatgcagataacatggaaaatggcaattaactatttctgttagatgatattctaaaattttactcagccaaattcagagaaagaatagattaaaaatgaaaactgctgttttacttggctattcatccactaaaaatgctacattttaagctaatagatatttagcttggatcaatcccaataatgttccctaattctataagaaaaacagatttcattccagcaatgtctaagtagcttatattgggctaaccttcctgcagataacaattataaacccttgacaaaaatatgaaaaagcaactatatgaaggctttgaggagcaatgacaagcaggaagaaactagaggggattctcaaaagaagggagtcacactgtgttatatctgtgtttaaatagatttcacactgagggcactacccagtttgagcagcctggggcaacttaaggttaaagataatggagtccagggctgccagaatagcagtacagagaagaatagcccagaaagcaaagaatttgagtgggaagcccccaaatctttgtataaactgtcctcaaatcctttttttttttttttttttttgaggtagtctcgctctgtcgcccaagctggaatgcaatggcttgatctcagctcactgcaaactctgcctcccaggttcaagcgattcttctgcctcagcctcccgagtagctgggattacaggcatgcggcacctcactcggctaatttttgtatttttagtagaaacagggtttctccaagttggtcaggctggtctcgaactcctgacctcaggcgatccacccgcctcggcctcccaaagcgctgggattacagacgtgagcccccgcgcccagccagaataataattattattattatatattttttgagacggagtctcactttgtcgcccaggctggagtgcagtggcgccgtcttggctcactgcaagctccgcctcccgggttcacgccattctcctgcctcagcctcccgagtagctgggattacaggcgcccgccatcacgcccagctaattttttgtattttttagtagagacggggtttcaccgtgttagccaggatggtctcgatctcctgacctcgtgatccgcccgcctcagcctcccaaagtgctgggattacaggcgtgagccaccgcgcccggcctcaaatccttaagacccctcaacacaaatatttccggtttccgacaacattccaacaagactggcaaagcagcatctagaaggctgagaaactaaggagagctttcagtgcaactcaccaaagagagacggaatttgaagtttcaatcttaccaagttaggaggtaagattacgtcccaggactaaatattcaccctaagaccttatagcaacactgaaacagacctgccttaacaaagtacaaaacccagccacaacacgtaatttaactagctaatagaaaaaaaaaatcaatattctccagagaaagataacaaaattcagaatctctataatgtgtcatccacaaggtccagaatgcaattttaaaattacaattgcttagccaggcatgatggctcacgcttgtaatcctagcactttgggaggccgaggtgggtggatcacctgaggtcaggagttcgagatcagcctggccaacatggtgaaagcccacctctactaaaaaaaaaaatacaaaaaattagctgggcatggtggcgggtgcctgtagtcccagct

SEQ ID NO: 6882 - DNA, 209 bp, Homo sapiens
ttcacgccattctcctgcttcagcctcccaagtagctgggactacaggcgtccgacaccatgcccagctaatttttttgtatttcttagtagagacgggtttcaccgtgttagccaggatggtctcgatctcctgacctcgtgatccgcccgcctcagcctcccaaagtcctgggattacaggcatgagccaccgtgcccggcccaaaa

SEQ ID NO: 6883 - DNA, 139 bp, Homo sapiens
ttttttttgtatttttagtaggcacggggtttcaccatgttagccaggatggtctcgatctcctgaccttgtgatccacccgcctcagcctcccgaagtactgggattacaggcgtgagccaccgcgcccggcctaaaa

SEQ ID NO: 6884 - DNA, 108 bp, Homo sapiens
gggtttcactgtgttagccaggatggtctcaatctcctgacctcgtgttccactcacctcagcctcccaaagtactgggattacaagcgtgagccaccgcgcctggcc

SEQ ID NO: 6885 - DNA, 138 bp, Homo sapiens
tttttttttgtatttttagtagagacggtgtttcaccgtgttagccaggatggtctcaatctcctgaccttgtgaaccaccctcctcagcctcccaacgtgctggaattacaggcgtgagccaccgtgcctggcccaa

SEQ ID NO: 6886 - DNA, 323 bp, Homo sapiens
attttttttttcttttttttggagacggggtctcattctgtcacccaggctggggtgcagtggcacaatctcggctcacggcaagctctgcctcccgggttcacgccattctcctgcctcagcctcccgagtagctgggactacaggcgcccgccaccacgcccggctaattttttgtatttttagtagagacggggtttcaccgtgttagccaggatggtctcaatctcctgacctcgtgatccgcctgcctcggcctcccaaagtgctgggattacaggcgtgagccaccgcgcctggccaacaatttttttttttttttt

SEQ ID NO: 6887 - DNA, 358 bp, Homo sapiens
ttttttttttttttttttttttttttttgagacagagtctcgctctgttgcccaggctggagtgcagtggcatgatcttggctcactgcaagctccgcctcctgggttcacgccaggagttcacatgggttcacaccaggagttcacacctgggttcacgcctacctcagcctcccgagtagctgggactacaggtggccgccaccacgcccggctaattttttgtatttttagtagagacggggtttcaccgtgttagccaggatggtctcgatctcctgacctcgtgatccacccgcctcggcctcccaaagtgctgggattacaggcgatgagccaccgtgcccggccaggaatc

SEQ ID NO: 6888 - DNA, 427 bp, Homo sapiens
gaatttgtctaattcctttttttttttttttttgagacggagtctcgctctgtggcccaggcgggagtgcagtggcgcaatctcggctcactgcaagctccgcctccagggttcacgccattctcctgcctcagcctcccgagtagctgggactacaggtgcccaccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccgagaatttgtctaattcagatactcccaaataagcagatcattttgtatgtaaaatggaaatatgtccattctgttctgtgacataatataacttgatgaatctgagtctt

SEQ ID NO: 6889 - DNA, 549 bp, Homo sapiens
gctcactgcaagctccgcctcccaggttcacgccattctcctgcctcagcctctggagtagctgggactacaggtgcccgccaccacgcccagataatttttttttttttgtattttttagtagagatggggtttcaccgtgttagccaggatggtctcaatctcctgaccttgtgatccacccgcctcagcctcccaaagtgctgggattacaggcgagagccaccgcgcctggcccaaaataagaattttttttttttttttgagatggagtcttgctctgttgcccaggctggagtgcagtggtgcgatctcggctcactgcaagctccacctcccaggttcacgccattctcctgcctcagcctcccgagttgctgggactacaggcgcccaccaccatgcctggctaattttttgtatttttagtagagatgtggtttcaccatgttagccaggatggtctcgatctcctgacccgtgatctgcccgcctcggcctcccaaagtgctgggattacaggcgtgagccaccacacctggcccaaaa

SEQ ID NO: 6890 - DNA, 5059 bp, Homo sapiens
gagaatctttttctttttttttctttttttgagacggagtctcgctctgtcgccgaggctggagtgcagtggcgcaatctcggctcactgcaagctccgcctcccaggctcccgccattctcatgcctcaggctcccgaatagctgggactacaggcacccaccaccacacccggctaattttttgtatttttagtagagacggggtttcaccgtgttagccaggatggtctcaatctcctgacctcgtgatccgcccgcctccgcctcccaaagtgctgggattacaggcatgagccaccgcgcccggccgagagtctttaattttctactttgtatatttctatattaactttgaaagaacacccatttattaccttttaactagtaaaagcaataaaaataagaaaagttaatactatcatagtaatactattgttgtcattccaagaaaaaaatatattaaaaatatttatttgaaaaaataaataaataaaaataaaaatgagattgaaaggaatggccagagaagtaagacaaagaagaggcatgatgggtcacagaagtcaatgtatcgaagtatttcaaggagtatttcttgtcatattttgcttgacaggtcaagtgagatgaggactaaaagtatccattggatttagtgatttgatagtcattggtgaccttatcaccacaaactgaggaagtcagattagagtgtgttatattaataagggagtaagaagaaggaaatggaaaaagaatagttatgtcaagaagtttggctacaacagatagaagggtgttaggtggtagctagagagggatgtgaactcaagggaaattatttttgtaagactggagaaactagagcatatttaaatgtcaataaaaacatgtcaatgaggccagatgcagtggctcacgcctgtaatcccagcactttgggcgggtggatcacctgaggtcaggagttcaagaacagcctggccaacgtggtgaaacctcgtctctactaaaaatacaaaaattagctgggtatggtggcgggcacctgtaatcccagctactcgggaggctgaggcaggagaatcgcttgaacccaggaggtggaggttgcagtgagccaagatcctgccattgcactccagcctgggcaacaagagaaaaactccgtctcaaaaaaaaaaaaaaaaaaaaaaaactcaatgagcgggaattgttgaataaacaggagagagaagggataattaatagtggaaggtttctgggaaggtgtgaggggatagcatacagtaggaagaaatgagaagtataaaaggaggtagggagaggatttgttctaatgtgagcaaatatgtagatttgatggtgggaaatgggggattaaatgagataatgcatgcaaagcacttagcatagtgcctggcacagttagtttgtatcagaaatggtaactatggctattgttgtttttcatgtcatacacctgcttgaaaatttctcaccttttaggctttgtccatgtgaaatgagctagtaccctactttattaatgctataaatttcaatttttatttttttgagacagagtctagctctgttgcccaggctggagtgcagtggcatgatcttggctcactgcaacctccacttcccggtttcaggtgattctcctgcctcagcctcctgagtagctgggattacaggtgcccaccattatgcccggctaaattttgtatttttactagaggagaggtttcaccacgttggccaggctggtctcgaactcctggcctcaagtgatctgcccaccttggcctcccaaagtgctgggattacaggtgagagccaccgcacttgactttcaaattttctatattgaatttatatacaacgagggttacttgaacttttgttttgttttgttttatttttatttttatttttggagacggagtctcactctgtcgcccaggctggagtgcagtggcatgatctcggctcactgcaagctccgcctcccaggttcacgccattctcctgcctcagcctccccgagtagctgggactacaggtacccaccaccacgcccaactaatttttgtttttgtatttttagtagagatggggtttcaccgtgttagccaggatggtcacgatttcctgacctcgtgatccacctgcctcagcctcccaaagtgctgggattataggcgtgagtcaccacacctggccgagggttacttgaacttttgattcctcacctctgttctcttcagaacttctggatatttgctggttccctgattttgataagaagaaaaaagttgtacatttaagattaatgggctgggtgcagtgggtcacacatgtaaccccagcactttgggaggccaaggcaggcgaattacttgaggtcaggagttcaagaccagtctggccaacatggtgaaacttcatctctactaaaaatacaaaaattagccggtcgttgttgcgtgtgtctgtaacccagcactttgggatgctgaggcgggcagatcgcttgagtccaggagttcaagaccagtctggccaacatggcaaaaccccatctctacaaaaaatacaaaaattaggcagttgtggtggcgtgtgcctgtggtcccagctactcgggaggctgaggtgagaggatcacttgagtctgggagatgaatgttgcagtgagccaagatggcaccactgcactccagactggatgatagagcaagacaccatttcaacaacaacaacaacaaaaaaaaaaaaaaaaaaaaaaagagagagagagatcactcctcactcctccctcctcctctgattaagaatctacatttgaggctgggtgctgtggctcacacttgtaatcccagcactttagggggccaaggcgggtggatcacaaggtcaggagttcaagagcagtccggccaagctggtgaaaccccgtctctactaaaaatacaaaaaattactcgggtttggtggcgggtgcctgtaatcccagctactcgggagactgaggtaggagaatcacttgaacccgggaggcagaggttgcggtgagctgagattgcaccattgcactccagcctgggcaacaagagtgaaactccgtctcatagatagatagatagttagatagatagataaatagatagatagatagatagatagatagatagatagatagatagaatctacatttggccgggtgcaatggctcacacctgtaatcccaacactttgggaggctgagctgggaggattgcttgaggccagaagtttgagaccagcctgggaaacagcaaaatccggcctctactaaaaatacaaaaaattagccaggcatggtggcgcacgcctgtagtcccagcttctcaggaggctgaggtgggaggattgcttgagccggggaggtcacagctgcagtgagccatgatcatgctactgcactccagcctgggtgacagagtaaaactctgcttcaaaaaaaaaaaaaaaaaaaaagaattggctgggcatggtggctcacacctataatcccaacactttgggagaccgaggtgggcagatcacttgaggctaggagtttgagactagcctgaccaacatggcaaaaccccgtctctactaaaaatataaaaattagccgggcatggtggtgcatgcctgtagtcccagctaatcgtgagggtaaggcagagaatcgcttgaacctgggagacagaggttgcagtgagccaagactgcggccgctgtgtgcctgggagacagagcgagaccctgtctttaaaaaaaaaacaaaaaagagaatctacattctttttttttttatttaaaggcctataatgcccttttaactctctttttaaatcattttcaaaatccttgacctagaattttaggttcctgttaatctagccacactccatttaactttttcatcttctttcttcaacataacctctgacatgttaccactgcttacaaatagaaagaggactaagcttggagagactctgaagagaagcatttactttttactctacatacttctgcatttaatttttttacagtgataatgtactacatttggaatttaaaatgaaacacaataaataaattaaaacaacttttgccctagtatcactctccctaatctttcatacccatcaaaattaatttctcattattcagatttccattcaaatgtacaggtgacacttgaacaagggttttaactgcatgggtccacttatatgtggattttcttctgcctctgctacccctgagatagcaagaccaacccctcatcttcctcctcctcctcctcagcctactcaatatgaagacagtgatgaagaactttatgataatccacttccgcttaatgaataatgcatatattttcccttccttattttattttattttatttttagacaaggtctcactctgttgcctaggctggagtgcattgcgacaatcatggcttactgcagcttcgatctcctgggctcaggtgatcctcccaccttaccttcccaagtagctgggactacaggtgtgcgctactatgactggctaatttttttgtatgtttttgtagagagggggttttgtcatgttgtacaggctggtcttgaactggacacaagtaatctgcccacctcggccacccaaagtgctaggattacacgcatgagccacctcacccagccccttatgattttcctttttttttttttttttgagacgcagtcttgttctgtcgcccaggctggagtgcagtggcacaatctcggctcactgcaagctccgcctcccgggttcacaccattctcctgcctcagcctcccgagtagctgggactacaggcgcctgccactacgcccagctaatttgtgttttttttgtatttttagtagagacggggtttcaccgtgttagccaggatggtctcgatctcctgacctcgtgatccgcccgtcttggcctcccaaagtgctgggattacaggcgtgagcaaccatgcc

SEQ ID NO: 6891 - DNA, 129 bp, Homo sapiens
tttttttttgtatttttagtagagacagggtttcaccgtgttagccaggatggtctcgatctcctgaccttgtgatccgccagccttggcctcccaaagtgctgggattacaggcgtgagccaccgcac

SEQ ID NO: 6892 - DNA, 1939 bp, Homo sapiens
ccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgacctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatgta

SEQ ID NO: 6893 - DNA, 139 bp, Homo sapiens
ttttttttgtgtatttttagtagagacggggtttcaccgtgttagccaggatggtctcgatctcctgacctcgtgatcacccgcctcggcgtcccaaagtgctgggattacaggcgtgagccaccgtgcctggccgaaa

SEQ ID NO: 6894 - DNA, 47567 bp, Homo sapiens; identical to SEQ ID NO: 6849

SEQ ID NO: 6895 - DNA, 141 bp, Homo sapiens
ttttttttttgtatttttttagtagagatggggtttcatcctgttagccaggatggtcttgatctcctgaccttgtgatccacccgcctcagcctcccaaagtgctgggattacaggcatagccaccgcgcctggccctaa

SEQ ID NO: 6896 - DNA, 54877 bp, Homo sapiens
acaaatgagaaagtttcatttacctcaaaaaaatccaggctatacaaacagacaactgaaagccacataggaaatttccgaaacacaaaagaaaaagtctcacctacaagattatttacatgtttagggccagtattattaaaagacgtcatcccctaggtctagtagaaacatatagagaagtctatgctaacacacttggaaagaggactattgtccttccttgcacatgacaaaaaccaaatgaaccaaacccctagaaggtattaatgcacaaaggttttaataccttggctttaatgatttttcaaggttaagaaacaaattcaaattggttggagcttcaactcagtaattacaatcacaatgcatctctgaaaggccctgcatttggaggcagagtaatctgcaaagatgatagtttttacatatgtcctgttacctacaccaatataattactacattatcttataaagacaaacagttgcttcaaactctttaaaaaatatatatataatgagtttcccaaagactcgagtctatattcaaagatgagtaaaaaaaaatccattacttccctagggtcactttcttcctttactcctgcttaaatgcaaaagctgatagtttctgatttgtagaaaaatctaaaggtttctgctttttagacaaattcaggttctcttttgctttttcttcctggttttctgtttcatcactttcatcaaccacacgttttcgcttctttgcttcagttccttcacttgccgtttctcctttggctttgttagcccacacctttgtaaaatggcaggagtgaaaaggaaagatttttagaaaataacaaataagaagtaaatgatttatttacttttccaggtaatatttttatatataaagcagaataattagcacttgaattaagtgttctcattgttaacaaatcttttattacttaaatgcagagcacattaaagatttacactacttttatatctcaatctaagctttgcttatattaatcatattagttgcaaaatactataattgcagtactatttaaaaatgaaacttttggccaggcacggtggctcatgtctgtaatcccagcactttgggaggccgaggtgggtggatcacggggtcaggagactgagaccatcctggctaacacagtgaaaccccgtctctactaaaaatacaaaaaaattagccgggcatggtagcgggcgcctgtagtcccagctacttgggaggctgaggcaggagactagagtgaacccgggaggtggagcctgcagtgagctgagatcacgccactgcactccagcctgggcgagagcaagactccgtctcaaaaaataaataaataaataaataaataaataataaaaatgaaactttttattctaagataattgcagtttcacatgcagttgtatgaaataatacagaaagatcctgtgtagccttcacccagttttccccagtggtaacattttgcaaaactatagcccaacaatcacaactatagggaactgacattgaaacaatcccattttacttctactcatttgagcgtatgtatgtatttacttttattgtgggttggtttgtttaccaccacagtcaaaatacagaacctcttccccaagccccaactccgactccaacccctggcaaccactactctattctccatcttgatcatgttgtcatttcaggaatgttatataaatgagtatatattctttggggtttggtttttattcactcagcaagagccagacaaggtccattcatttcatctgtctctaaaatctcttttaatctataatagttccccactcctactttatttccctggccatttcaagggctcttcaagctgtagaatttctcacattaacaaactggatttaagtaaatgtttagggtttaccttaaaaatactgattacatttttaagtattcaaaaacacaatcacagactttgccaagtctcttcctcttttgcagtgtaaagtcttatttatttagacgccattttattgaacaacaaatgagaaacataaaattgtaaatgaggttctaaatgacgctaaaggtgtttaaaccagtttctggcttcctcattatgcaacacctttttcataaaacccaatttaccaaagcaagtatctacgttactaggtgcctgtgctgcgccctgccattcctggggaagtgaaacctgaggatttaactggtacaccacacacattccttccacttctaactgagagattgtgccttccttccttcacatggcagaagtttatcagaagcaagccagccacctgtcctaatttccatgtgaaaggctggaacagaacaccagtctttttcccaaaaggaatagtctcatgtagtatttaatgtgtaagtagatacaatttttaaaaattctgcttgcaagaaccctaaagtagtattcaaaaaatgtgaattcatttttacttattaatttttttccccctagagacccggtctcactctgtcacccatgctggagtacagtgacacaatcacggctcactgcagccttgacctcctgggctcaagtaagtgatcttcccacctcaacctcctgagtaactgggactacaggtgtgtgccaccatgccaggctaatttttaaatttttgtagagatggtgtatcactatgttgtctaggctggtctcaaactcctgggctcaagagatcctcctgccttggcctcccaaagtgctaggattacaggcttgagccaacgaactcagcttgacacttttgatttttaacaaatgcatcttttcttggggtattctcctaacttaaaacatacaggaacttatagagattaaaacagtaaaccgtcaaaaaattaaccatccagcctgggcaacacagtgagaggttgtctctataaaaaaaaaaaagaggacaattgcttgtgcccaggaggtcgaggtggcagtgagccatgatcacaccacgacactcctgcctgggtgaaagaacaagacctgcctcaaacaaaaacaaaacaaaaaacccatcaccattacataataattactacatatccatattaccatatatccgcacttactttcctctttaaaaagtttggtggatgtattcaatttccaaaaacagaaaaaggcttttccttttttttttagttgtcatgatcgttattatctttgttgttgttattattattattagagacgatgtctcactatgttgcccaggctggtcacgaactcctgagctcaagtgatccgcctcgacctcccaatgtgctaggattacaggcataagacaccatacccagccaaaaggcatttctataagaattttttaaatctgggaattcactaagatctcaatctcggcacaattatccttacctttctttcttcagttgacaatactctaaatcgaatcattccttcttttattatgtctgcttcatctgaaaagtcaggattgtcagacaaaatattacttctattttcttctaaccacatctggaacccggtctttggcctaaaatcacaattatgtgaaaacattttatacttaagacagagtttaaagtgcctcatgattttaagttagtaatcaaccataagtctctgacatctattatataaagtaaggaagacacagttacacttgttaattcatgttactttttttttttttttttttttgagacagagtctcactctgtcacccagcctggagtgcaatggcgcgatctcagctcactgcaacctccgcctcctgggttcaagcgattctcctgcctcagcctcccaagtagctgggattacaggcatgcgccaccacacctggctaattttttgcatggggtttcaccatgttggtcaggctggtctcaaactcctgacctcacgtgatctgcccgcctcggcttcccaaactgctgggattacaggcataagccaccgtgcctggcctcatattactttaaactgcctggagactgcaggatcaatgaactggaaaatcctttgtaaggtcaattcaaaaggatcactcacgtttgtattttccaagtgcagcaaccatgaactctgtactttcaactttttaatgaatgttgacaggctcaaggtctccaacctcacttagcccttgtggcctaccacatgtccttggtaggctctttttctatttccccaaaccagctatttgaattcctcacgacttttctcaagcccctttgccatcgcctcacccttgctctcagagctgacctgcatcagcattaggtgaagcacggacacagcacatttgtacatttcattagattccactcacaatacaaattgtctttaagtcacacaagtgaaggtttaatgcaaatatttaacatttactgatcacttactatctaccaggcactactctaaaagctttatgtatagtacctcatttaaatgacaataacactatgagatggatacagttattatctccattccataagtgagaaaagggaggctcagagatgtgaaataacctatcccaggttacacaaacagtaaaactcagacctgggatccaacaaccaggcaatttgactccaaagtctatgtttttttgtagagatggagtctagctctttcccctatgctggagtacagtggctctgtattggcttactgcaacctccaccttccaggttcaagtgattctcctgcctcagcctcccaaacagctgggactacaggtacgcgccaccacacccagctaatttttgtatttttagtaaagacagggtttcaccatattggccaggtgggtctcgaactcctgacctcatgatccactcgcctcggcctcccaaagtgctgggattacaggcgtgagccactgtgcctggcccagagtctcttatgtttaacccagcagctatacgcccctcactaggctgaacctaaatgaatcctaaataaaaagtctaaactttttaaggttaaaaaaatttttattaaaaaattactagtatgaccataaccatttgcccaatttctgaaaatatgcaaattttaagtaatcttaacgtaaaccgatttccagaaaaataacagaacaaatcaaaacaagtaaaaatcaaggtataacaaaggttcctgaatttccaaaaattaatgaagacccattttaatgaaacttggggcaatgtcacaagtctacttagtggcctgcaatcatctacttctaaacagctatttttaaaaagaaaaccaaaattgaacatttctttctttgttttttaaagagacgtgagtctcactatgttgcctaggctggcctcaaacttctgggcttaagcaacccttctgactcaaccttctgagtggctaggactacaagagtgcacagccacctggctaaaactggacatttctgattaagtatatcaacatctgtgacaaaatattagtttcaatagtggtaattccttaaaatttcaaaagtaagttttttgtataaccaactgatagtatgaaaaattaaattatcaatcttctttgttgttgttttaagagaaagggtcttgctttgtcgcccaggctggagtgcagtggtataatcagctcactgccacctcaaattcctgggctcaagcaatcctcctgcctcagactctcaagcagttgggactacaggcatgtgccaccacacacacctggctgattttaaaacttttggtagagatggggtctccctacattgcccaggctggttccaatctcctgggctgaagctaactgatcatgttggccttccaaagtgttaggcttggccaggtgtggtggctcacacctgtaaccccagcactttgggaagccgagatgggcaaatcgcttgaggccaagagtttgagaccagcctggccaacgtggcaaactccatctctaccaaaaaataacaaaattagtgggcatggtggcacacacctgtaatcccagctactcaggaggctgaggcatgagaattgcttgaacccagaaggtggaggttgcagtgagctgagattgcaccagtggactccagccttggtgacagggcaagactgtctcaaaaaaagtgttaggcgggccaggcatggtggctcacacctgtaatccctgcactttgggaggccaaggcgggtggatcacctgaggtcaggagttcaagaccagcctgaccaacatggagaaacctcatctctactaaaaatacaaaattagtcgggcatggttgcgcatgcctgtaatcacagctactcaggaggctgagacaggagaatcacttgaacccagaggcagaggttgcagtgagccgagattgtgccattgcattgcagtctgggcaacaagagcaaaaagaaaaaagtgttaagcggaaaaaaaaccatgagccactatgcccggcctatcaattttcttaaataaaattttcactgtttaagacctaaattaaattcagaacaaaacaggaaatgtgaaaaccacagccactccctcaaactggttaacataaagtcattaagaaaataagatatactttattattatttttctccctggactgttcagcatgagaaaaatgagatatattatggtaaaaatgaaattgtgactgttcttttctttttgttttttctgagatggagtctcactctgttgcccaggctggagtgcagtggcacaatcttggctcattgcagcctccgtctcctgtgttcaagcgattctcctgcctcagcctcccaagtagctgggattacaggcatgagccaccatacctggcaaacttttgtatttttaatagagatggggtttcaccatgttggccaggctggtctcgaactcttgacctcaagtgatccgcccacctcagcctcccaaagtgctgggattacaggcgtgagccactgtgccaggccaaaattgtgacttttcaaatttaacggatatattaaaaataaggccaggagtggtggctcacacctgtaattccagcactttgggaggccaaggtgggcagatcacctgaggtcaggagtttgagaccagcctgaccaacatggagaaacctcgtctctactaaagatacaaaattaagcggttccaagatggtcgaataggaagagcttcagcctacagctcccagcatgagcgatgcagaagacgggtgatttctgcacttccaactgaggtaccaggttcatctcactagggcttgtcggacagtgggcgcagaacagggggtgtggcacaccgagtgtgagctgaagcagggcaaggcatcacctcacccgggaagcgcaaggggtcagaaaattccctttcctagccaagcaaagctgtgacacacagcacctggaaaattgggtcacccccaccctaatactgtgcttttccaatggtcttagcaaacggcacaccaggagattatatcccactcctggctcagagggtcccatgcccatggagcctcactcattgctagcacagcagtctgagattgaactacaaggcggcagcctcagccaggaaactcgaactgggtggagcccactgaagctcaaggagtcctgcctgcctctgtggactccacctctgggggcagggcatagccgaacaaaggcagcagaaacctctacagatttaaatgtccctgtctgacagctttgaagagagtagtggttctcccagcacagagtttgagatctgagaatggacagactgcctcctcagtgacaggtgggtccatgatccacaagtagcctaactgggaggcaccccccagtaggggcagactgacacctcacacggccgggtacccctctgagacgaggcttccagaggaatgaccaggcagcaacatttgctgttcaccaatatttgctgttctgcagcctccgctgctgatacccaggcagagtctggagtgggcctccagcaaactccaacagacctgcagctgagggtcctgactgttagaaggaaaactaacaaacaaaaaggacatccataccaaaaccccatgtgtacgtcaccatcatcaaagaccaaagatagatgaaaccataaagattggggaaaaaacagagcaaaaaagctgaaaattctaaaaatcagagcacctctccccccccaaaggaacgcagctcctcaccagcaacggaacaaagctggacggagaatgactttgacgagttgagagaagaaggcttcagacgatcaaacctctccgagctaaaggaggaagttcgaacgcatcgcaaaggagctaaaaaccttgaaaaaagattagacgaatggctaactagaataaccagtgtagagaactcctcaaatgacctgatggagctgaaaaccatggcacgagaactacgtgacgaatgcacaagcctcagtagccaattcaatcaactggaagaaagggtatcagtgatcaaagatcaaatgaatgaaatgaagcgagaagaaaagtttagagaaaaaagagtaaaaagaaacaaacaaagcctccaagaaatatgggactatgtgaaaagaccaaatctacgtttgtttggtgtacctgaaagtgacagggagaatggaaccaagttggaaaacactctgcaggatactatccaggagaacttccccaacctagcaaggcaggccaacattcaaattcaggaaatacagagaatgccacaaagatactcctcgagaagagcaactccaagacacataattgtcagattcaccaaagttgaaatgaaagaaaaaatgttcagagagaaaggttaggttacccacaaagggaagcccatcagactaacagctgatctctcggcagaaactctatgagccagaagagagtgggggccaatattcaacattcttaaagaaaagaattttcaactcagaatttcatatccagccaaactaagcttcataagtgaaggagaaataaaatcctttacagacaagcaaatgctgagagattttgtcaccaccacgcctgccctacaagagctcctgaaagaagcactaaacatggaaaggaacaaccggtaccagccactgaaaaaacatgccaaattgtaaagaccatcaaggctaggaagaaactgcatcaattaatgagcaaagtaaccagctaacatcataatgacaggatcaaattcacacataacaatattaaccttaaatgtaaatgggctaaatgctccaattaaaagacacagaatggcaaattggataaagagtcaagacccatcagtgtgctgtattcaggagacccatgtcatgtgcagagacacacataagctcaaaataaagggatggaggaagatctaccaagcaaatggaaaacaacaaaaggcaggggttgcaatcctagtctctgataaaacagactttaaaccaacaaagatcaaaagagacaaagaaggccattacataatggtaaagggatcaattcaattcaacaagaagagctaactatcctaaatatatatgcacccaatacaggagcacccagattcataaaccaagtccttagagacctacaaagagacttagactcccacgcaataataatgggagactttaacaccccactgtcaacattagacagatcaacgagacaaagttaacaaggatatccaggaattgaactcagctctgcaccaagcagacctaacagacatctacggaactctccaccccaaatcaacagaatatacattcttctgagcaccacatcgcacttattccaacactgaccacatagttggaagtaaagcactcctcagcaaatgtaaaagaacagaaattataacaaactgtctctcagaccacagtgcaatcaaactagaactcagcattaggaaactcacccaaaactgctcaaccacatggaaactgaacaacctgctcctgaatgactactgggtacataacgaaatgaaggcagaaataaagatgttctttgaaaccaacgagaacaaagacacagcataccagaatctctgggacacatttaaagcagtgtgtagagggaaatttatagcactaaatgcccacaagagaaagcagaaaatatctaaaattgacaccctaacatcacaattaaaagaactagagaagcaagagcaaacatattcaaaagctagcagaaggcaagaaataactgagatcagagcagaactgaaggagatagagacacaaaaaagccttcaaaaaatcaatgaatccaggagctggttttttgaaaagatcaataaaactgatagaccgctagcaagactaataaagaagaaaagagagaagaatcaaatagatgcaataaaaaatgataaaggggatatcaccactgatcccacagaaatacaaactaccatcaaagaatactataaacacctctatgcaaataaactagaaaatctagaagacatggataaattcctggacacacacaccctcccaagactaaacgaggaagaagttcaatctctgaatagaccaataacaggctctgaaattgaggcaataattaatagcctaccaaccaaataaaaagtccaggaccagatggattcacagccaaattctaccagaggtacaaggaggagctgttaccattccttctgaaactattccaatcaatagaaaaagagggaatcctccctaactcattttatgaggccagcatcatcctgataccaaagcctggcagacacacaacaaaaaaagagaattttagaccaatatccctgatgaacatcgatgcaaaaatcctcagtaaaatactggcaaaccaaatccagcagcacttcaaaaaacttatcaagtgggcttcatctctgggatgcaaggctagttcaacattcgcaaataaataaacgtaatccagcatataaacagaaccaaagactaaaaccacatggttatctcaatagatgcagaaaaggcctgtgacaaaattcaacaacgcttcatgctaaaaaactctcaataaattaggtattgatgggatgtatctcaaaataataagagctatttatgacaaacccacagccaatatcatactgaatgggcaaaaactggaagcattccctttgaaaactggcacaagacagggatgccctctctcaccacttctgttcaacatagtgttggaagttctggccagggcaatcaggcaggagaaagaaataaagggtattcaattaggaaaagaggaagtcaaattgtacctgtttgcagatgacatgattgtatatttagaaaaccccgtcgtctcagcccaaaatctccttaagctgatagggaacttcagcaaagtctcaggatacaaaatcaatgtgcaaaaatcgcaagcattcttatacaccaataacagacaaacagagagccaaatcatgagtgaactcccattcacaattgcttcaaagagaataaaatacctaggaatccaacttacaagggatgtgaaggacctcttcaaagagaactacaaaccactgctcaatgaaataaaagaggacacaaacaaacggaagaacattccacgctcatggataggaagaatcactatcgtgaaaacggccatcctgtccaaggcaatttatagattcaatgccatccccatcaagctatcaatgactttcttcacagaattggaaaaaactactttaaagttcatatggaaccaaaaaagagcccgcattgccaagtcactcataagccaaaggaacaaagctggaggcatcacgctacctgacttcaaactatacaaaacagcacagtactggtaccaaaacagagatacagaccaatggaacagaacagagccctcagaaataataccacacatctacaaccatctgatctttgacaaacatgacaaaaacaagaaatggggaaaggattccctatttaataaatggtgctgggaaaactgcctagccatatgtagaaagctgaaactggatccattcctcacatcttatacaaaaattaattccagatggattaaagacttaaatgttagatctaaaaccataaaaaccccagaagaaaacctaggcaataccattcaggatataggaatgtgcaaggacttcatgtctaaaacaccaaaagcaatggcaacaaaagccaaaattgacagatgggatctaattaaactaaagagcttctgcacagcaaaagaaactaccatcagagtgaacaggcaacctacagaacgggaaaaaattttgcaatctacccatctgacaaagggctaatatccagaatctacaaagaactcaaacaaatttacaagaaaaaaacaaacccaatcaaaaagtgggcgaaggatatgagcagacacttctcaaaagaagacatttatgcagccaacagacacatgaaaaaatgctcatcatcactggccatcagagaaatgcaaatcaaaaccacagtgagaaaccatctcacaccagttagaatggcaatcattaaaatgtcaggaaacaacaggtgctggagaggatgtggagaaataggaacacttttacactgttggtgggactgtaaactagttcaaccattgtggaaggcggtgtggcgattcctcaaggatctagaactagaaataccatttgacccagcaatcccattactgggtatatacccaaaggattataaatcatgctgctataaaaacacatgcacacgtatgtttattgtggcactattcacaatagcaaagacttggaaccaacctaaatgttcatcaatgatagactagattaagaaaatgtggcacatatacaccatggaatactatacagccataaaaaaggatgaattcatgtcctttgtagggacatggatgaaactgggaaccatcattctcagcaaactatctcaaggacaaaaaaccaaacaccgcatgttctcactcataggtgagaactgaacaatgagaacgcttggacacaggaaggggaacatcacacacttgggcctgttgtggggtgggggaagtagggagggatagcattaggagatatacctaatgtaaatgatgagcacagcacaccaacatggcacatgtgtacatatgtaacaaacctgaatgttgtgcacatgtaccctagagcttaaaagtatttaaaaaaaaaaaaaagatataaaattagccaggcatggtggcgtatgcctgcaatcccagctactcaggaggctgaggcaggagaatcgcttgaacctgggaggcggaggttgcagtgagccaagatcgtgccaatgcactccagcctgggcaacaagagcgaaactccgtctcagaaaaaataaataaatacaaagaaatccagcatagtagagatcaagaaaataggtaacatactgtgtttgtggacaaagaggatatgagcaaataggaatactcatattgctaaaggtgtataaaatgatacaacatcaatgcagaacaatctggcattggaattataagtgcagattaacttgaaccatacatgaatccatcttatagctatatatgcatctgtgagaaatgctattcatataaaattattcattgcagtactgtctgtactagcaaaagaccggtaaccatcttttgtccacaagtagagaactacatgaactatgacatgtctattcaatggatacacaaagattaaagctcttatttttctatctatccatccatttatgtatttactttttctgatagccttgctatagtataaagaagttctttttgtttttttggtttttttgagacagagtttcgcttttgttgcccaggctggagtgcagcggtgtgatctcagatgactgcaatctccgcgtcccgggttcaagtgattctcctgcctcagccttccgatttgctgggattacaggcatgtgccaccaagcctggctaattttgtatttttaatagagacagggtttctccatgttggtcaggctggtctcgaactcccatcctcagatgatccgcctgcttcggcttcccaaagtgctgagattataggcgtgagccaccatgcccagccagtataaagaagttctttatgtagtaatataaaataagctacaaaagctattgttaagttaaaaaagtaaggtacagaataatgtgtaaaacaaaaaatagacaaatatgtatttgcacataaatagaataattttggaaagttccacaagaaacttgttgcagtgattgtttttggagacagaaattagttggatgaaactacttattatcactcttctttttgtatcttttgctatttctccccattaaactatttaaaaacaaacaaaaaattaattacaaaatataatgtcccaataaaatatatccacaatttaaaaatatacaatttattaaagcatattttaataaatattataaatagacattaatatttgtggcttccttatagtcacaagtgtccagaatgcccactaccaatgccaatgtattatttgtattaaggaataacagcattgcataattttgtattgctgctactgtatactttttacttggtcactgcatgctaaatttctctatgtactgacctttggttttcagtgttttgaggaggacatatagctggggtttcagataatacatttttaagattttcttctttcacttcctcagttttattagtttgagaatttcttttctggaaataggatgctgcagatgcctataaaaacaaacatgaatactgcaataacatctagtataattttatatgttttataagcacgttctgaaaaatgtgaagaaacatctataattattgagaattcttatactaacatgtgaaatctggagttctcagttgtaaataaataggcaaacacatgcaaaaccaaaaaactacacttcagattccatgttttccttttttttttttttttttttgagacggagtctcactctgttgcccaggctggagtgcagtggcgctatctcggctcactgcaacctccaccctccgagttcaagtggttctcctgactcaccctcccaggtagctgggattacaggcacctgccaccgcggctggcctaaattccatgttttctaaatgaatacaattatattaaatagaaaagataagcaatagatctattttaccaatgactaatccgggatcaaatacttatcagagtggaaaaatcaggactcagaacaaggaaaaattagggccatgtacaatatcagccactattaaatacgaatatacatcagaactatctgggtgattttaataaaaatacagataaatgtctgagcttctggggtctgagtatatatatttttaaaaagtgatctgtaaaaacaaggagaggggcaggataggctgggtgcggtggctcatgcctgtaataccagcactttgggaggctgaggtgggtggatcacttgaggccaggagtttgagaccagcctggccatcatgctgaaaccccatctctactaaaaataccaaaattagctgggcgtgatgtcaggcctctgtaatcccaactcctcgggaggctgaggcatgagaattgcttgaacccaggagacagaggctgcagtgagctgagatcctgacactgcactccatccagcctgggtgacagagtgagcctctgtctcaaaaaagacagggggagcaggatagtgatcttggaagtcagaatctgctacaaagtgtgtaacaactcacgaggcagaatagggagtgattctgaaacaaaaaacacaactgttttggggtttgtttttttcagatggggtatctcttatgtttcccagactggactcaaactcctgggctcaagtgatcctcccacctcagcctcctgagtatctgggactacaggtatgtgccactgtgcctagctgcaaaaacagaattgaacccacttccctagcaagacaattgtaaacaatcagaacctcctatcctatatctgaaacagtgaacaaaactgaagacaaacagatcccatgctgcttactgcagatgagggtagctgaaacagtacctgcttaggcttcggctttggaatcagaggctttataatgggagacttttcattatttgtagttcgactaagtgcagtggatttcttggatgatttgcccatattgtctaaaatattagttgaacgtgctgaattcattgacatggctggttctttggaactggctgatacctaaagagcaaactagtgttagcactgtatgtttaaagaagaaaaataaaatcccaagagacttattttttcttgaaatttctgttaagtttgtattgccatctcatctttagaactaaatacatttggtacaatccaaattaagaatgatacgtatattcccaaataccacatccccaagaaagacagaggtatctttcaaaaccataggtacttagaaggtaagtagaaaagacaactctcagcccaagtgctgctttcttctgtttccacacagatcagtctttcatgcctccaagtctggggagagtcatctcatcatttggaaatatttctttgtatacaaatgtatttaaataatataaaacatcacttggaagagtttaccttaaagggatttactcgtccttggctgctaaaggtaactgcacctttcacaaaaaagaaacccttgcttaataatggtagaaaatagatgacttctgacatctataatactagacagagtattttaatccccattaaatgaaaacaaatgtattttgcaacttttcaaaactattaacaacagatatcctctttcctacttctaagccaaaataaaagctattaaatgtgaaccaccccaacgtgccactatgaaacatattcagtatgtacagatcttttatcttctgttactgcggaagagtggcagctcgtctgagctaaggttagtaatccctttacttgtgttctgcatcccatgccctcctgctttgtcagaaaacctgacctatcaagtttcttgacatcctacatctttgacttttccctatttattggcccctaaagtctcccaacttaaaaagaaacaaaaaacaaaccttctctaccccacattccttccagtcaccattttctctcgcctcctccatccagccatttttttttttttttgagacagagtctcgctcttgttgcccaagctggagggcaatggtgtgatctcggctcactgcaaagtccacctcccaggttcaggcgattctactgtctcagcctcccgaattgctgggattacaggcgcctgctaccacgcccggctaatttttgtatttttaatagagacagggtttcaccatgttggccaggctggtcttgaactcctgacctcaggtgatccgtctgccttggcctcccacagtgctgggattacaagcatgagccaccacgcccggtcatccagccaaatttttccaagaactgttgacactattatcatttcctcaccacccatacattcctccatacaatatagcacttccagctctaccaccctacagaatctcctcttgctaaggccctcagtgatctctacattgtcaaatctggtggatacctttcagtcaccttgtttgctctatcaatggcatcccacatagctgactgttccttacttcttgatactttgtcctctcttgacttctgagatactgcattccctgacttagttccttcctctctggacctgtggactcattgtgttccaatagttggttcctcctcttcctctacctgatgctcaaatgttggagattccctaggcttaagctcatttttctttttgctttacattctcccccaatgcttgcttacccatgctcatggtttaaattgctatacttatgccaatgattttcactttgtatctcttgaccagaatacttccctgagctcctgattcaaatatctgtcttcacgacattctactcaccttacagtaattcatcatcttcctctctaaatctgcttttctctagtgtttcctgacttaggaaatggcaccatcattcactcaagtactcaagccagtgttaacaaactaatctctaattaagagctttcctggcatggtggcttaagcctgtaatcccagcactttgggaggctgaggagggaggactgcttgagcccagtttaagactagcatgggtaacatagggagaccctgtctctacaaaaacaaaaaacaacaaaacaaaaaacccaaaccaaaacaaaactagccagacatggtgacacatgcctgtggtcctagttacttgggaggctgaggtggaaagatcgcttgggtctggggggttgaggctgcagtgagccataatcacgccactgcactctaacctggatgacagtcacaccctggcggggggaagaggagggagggagggagggaagaaggaagggagggagggaggcaggcaggcaggcaggcaggcaggcaggaaatttctagctgagcatggccacttgtgcctgtaatccgaaaattttgggaggctaaggcaggagggtcacttaagcccaggagttccagaccagcttcggcaacaaagcaagctcctctctctacaaaaagtacacacaaaaaattaaccaggcatggtgatgcacaactgtagtcatagctactcagtagggtgaggcaggaggatcacctgagcatacgagttcaaggctgtagcgagctaggactgcatcactgcactccaactctgctccagtctgagtgacaaagcaagataccctgtatccgcaccccccccaccaaacaaaaaaaacaaacaaaaaaacctttccatctagccaataaaaattgttttatttatctcgtttctgaaaatactttataaaagtttccccttttgtctctcctggcagagtgctagccccttgcggtttggtgcctccctgattcatgaatcactgaatgttcaaattaatccttcaagattcaaatgtgcttaagtttttcttctattacaagaaactgagaatcactctttacgccctgaactcctacactctcttcatcatcttcagaaatagctctccaactctgcccattctttctaacatcaccatcaccaccctagctcaggcccttattcaatctcatttggactgcctctgtagtttgtttgtttatttatttatttgagatggagtctcgctctgtcgcccaggctggagtgcggtggtatgatctcacctcactgcaagctctgcctcccgggttcacgccattctcctgcctcagcctcccaagtagctgggattacaggtgcctgtcaccatgcccggctaatttttatgtatttttagtagagacggggtttcactgtgttcttcaggatgctctcaatctcctgacctcgtgatccaccctcctcagcctcccaaagtgctgggattacaggtgtgagccaccacgcccagcttgtagtctctttattttttaatttttatttacttcttcttattattattttagatgaagtctcactctgtcacctaggctggagtgcagtggcgtgatctccacttactgcaactccccactcctggattcaagcaattctcctgcctcagcctcccgagtagctgggattacaggcatgagccaccatgcccggctaatttttttttttgtatttttagtggagatgtggtttcaccattttggccaggctggtcttgaactcctgacctcaagtgctccacctgcctcggcctcccaaagtgctggaattacaggcgtgagccaccacgcctggcctatttattttttgatacagggtcttgctctgtcacccaggctggagtgcagtggtgcaaccatagcctactgcaccctcgaactcctgggctcaagatatcctcctgtcccagcctcccaaatacctgggactaccggtgtgtactaccatgcctggctaatatttttattatttactttttgtagagatagggtttcattgtttccaaggctggtctcaaacgtctggtctcaagtgatccttccaccttggcctctcaaaatgctgaggttacagacatgagccatcacacctggccagtagtctattatctgttcttcttcagcacagtgtgccatgctatacctctgcttaaaacctacaacagtctctcagtgaccttagaataaagagcaaaatcctgaccgggtgtggtggctcacacctgcaggtccaacaactttgggatgtggaggtgaggaaattgcttgagtttgagaccagcctggacaacagagtgacaccccatctctattaaaaaaaataaaataaaataaaaaaaagaccaaaatccttaatatggcctacacagatctgcatgacttggctcctgcccatcactccgaaacccttcagcaccactttctctttgctctctgagcttttcacaccacccttttgcagccttcagttcacacatactgttccttaagcccaaatgcttctcttctgctcctgttcccatgcacctttgccttgctgactgttattcatccttcaggtctctgctgtaaacactccatgaggcctgccttgaagtccctacccatcctccaccactggctagatgacagctatgtgtcatacgctcttttcatattctacatgttttttaagttaatttttttaaatcaaagtaacatatgtccacagtttaaaaagtcaaatggtactataaggtttatgctccccaccaaaaaagggccagcagtgccttacttcaaccttctcttatcccccaggcccactccctgtacgcaaccattttcaactccttttttttttttttgagatggagtctcactccattgcccaggctggagtgcaatggcacgatctcggctcactgctacctccacctcctgagttcaagtgattctcctgcttcagcctcccgagtagctgggattacaggcacataccaccaccctcagctaatttttgtatttttagtagagatggggtttcaccgtgttggccaggctagtctagaactcctgacctcgttatccgcccactccggcctcccaaagtgctgggattacaggcgtgagccactgcgcccagccttcaattccttttaactgtttctccagtatcctgcatgcttcctcagtgatacccagatctgtcttcaacatctgtcttctcagctgggctaaaatagcattaaaacagagatcaaccacacatgtctgtttgacttctgtatccaccattaagtaaaatgcctgacactcaataggcattttataaacatctgttaaatgaccatagcttcacaaacaacatctgagattaaaaaaacaaaaacataaacacacacacaccaaaagtggccttaagagttaaggtgtatttgcgtagatgtgtcactttgcagatgacttgcaaaatttccttgatattacaaatttataaatatttctcacctgacttagctgaaacatcagaggaatttgtacttttggaaaacgagttctgtcctacagattaaaataaagcaatataatgtaaatggggaaaatatagtcatcctcaatatacaacaaccagatagcaaagaggtctgaaaaaaagtatgagtattcaatttccctcagttaagcaaaatgggaaaagccacatccatgatagttctcatgatttatgggcttgaaaatgtatctcaccaggcttatgtatttctggtttttcttcatcatcagcttctccactgtcctcagcatcttcttcaacttgatttctgaaccttggttggctccactctgtagcagtattgctgtaactaagagaaaataatattattcaataaagagctatgcaaagaccaacttaacattcaagacagtaaaggaaaattcaaacaactaaattatttcttacccagcattcagcttttttctgaaatcttcttcttcttcttcctcttccacctgggttgctgtcaattcggctgccttctctacagccagttcacttagtttttgagccagtattaatttccgagagcgagaagcatatttaatggctaaattcacagcattttgagtcattagatcagcaagttccacacaacggaattctcgctccagtttacaagaaagctaatccaaaaaggggggggggggggagatcaaataacatcaagtaaaactttttaaagatactgacactactagtaaaactgagacaatagttttctagctactctatctccctaattctaagatgcacatttttacaagttttaacatctctgaaattggaattacaattaattacaattaatggtgggtcagtttggcagcatttttatgtctccatggcttaaatgaataaagtaatggtgcactatgcaataaacagtggcttagatttgatgaaatattacataccactttaatctactaattgcaagaaaattaagaaatttgtttaaaaaattcaagggggaggctgggcacggtggctcacgcctgtaataccagtgctttgggaggcccagatgggtggatcatgaggtgaggagttcgagatcagcctggccaatatggcaaaaccccgtctctactaaaaacacaattagccaggcgtggtggcgtgcgcctgtaatcccagctactcgggaagctgaggcaggagaatcgcttgaacccgggaggtggaggttgcagtgagccaagattgcaccactgcactccagcctgggcgagaaagcgagactctgtctcaaaaaaaaaaaaaaaaaaaaaaatcaagggggccaggtgtgctggctcacacctgtaatcctagcactttggaaggccaaggcagagggactgctagaggccaggagtttgagactaacctgggcaacacagtgagaccctataactacaaaaaataaattagctgggcgtggtggcatgcacctgcagtcttatctactcaggagcctgagacaggaggttcactagagcccaggaggttgaggctgcagtgagttacaatcttgccactgtactctagcctgggtaacagagtgagaccctttctctaaaaaatacaaaaaagaaaaacaacaaactgagaaaagttggtattttgaagattactaagggtctcctaattcatagtgtattagaactattttcttacttagatattccatgtctgatccatcagcacaaaagctttagatattcacctggatgcccttttcaagatttttagtatcatttatctataatcagtacttcttaatcgggatggtacactgcctcagggggcatttagaaataaaaaggaagccgggcgcagtggctcacacctgtaatcctagcactttgggagactgagacaggtggatcacaaggtcaggagatcgagaccatactggctaacacggtgaaacacagtctctattaaaaatacaaaaaattagctggtgtggtggcagacaactgtagtcccagctactcgggaggctgaggcaggagaatggcgtgaacctgggaggcggagcttgcagtgagcagagatcgcgccactgcactccagcctgggcaacagagcgagacttcgtttcaaaaaaaaaaaaagaaataaaaaggaatagtctggtttccacagtgactattctgaactaaaggcatttgcccgggggtcaggaatgctaaagaagaactcaacaatccccttgaactcctgggctcaagatatcctcctgccctggcatctttgatatgagtcccctggtatttttgatatgagaaacactgccacagggaaaagctcctctaggctaaatagcaaatacatgaaatatgtttccttatatgtgttgtacaaataaaaaggctactagttcctggaccacaagtaacactttataaaaggaataaaactttttctacaataaactgagttttcttaataccaaacttaaggccatgttgcataaaggtgacagtagtgagtactaccttttggagacaagagtggcaatttgctctgtggtctcatataccacttttctctaagaaccttttttctccaattttaaaattaaaagtctggaccattcactcttgtcaacaaatatcgaggtctactatgtgttaagccaccatgtcagtgcctggcatacagcagtgagcaggtctctgccctctggggcataaagtctagtgtaagacaaataaagaagaaatgatactatactcctctccataaaccaaccttgagtggggacacaagcacaggaactttaagacaccctgctccaaagataaatgtacttaaatattctagacaccaaacctggccactggtcacaaataaattttcatcacacacagctgcctaactcaaagaggatgacaaaaggcaggcatatctaacagcccgatcaaagttcttaagattgcccagccctggagattaaaaaacagtatatactcaaactttgtaaaataataacagaaactagagcagtggttctcagttaccttgagagcccgttaaaacatagactgatgggcaaaagcaaaagggaagtagccctagagatgtttattcctgcacatgatcttagctacaaggtactgttttatttattttaggctgggcacggtggctcatgcctgtgatcccagcactttcggaggccgaggcaggtgaattacctgaggtcaggagttcaagaccagcctgaccaatgtggtgaaaccctgtttctactaaaaatacaaaaattagccaggcatggtggcacacgcctgtagtcccagctactcggaaggttgaggcaggagaatcacttgaacccgggaagtggaggttgcagtaagccaagactgcacaactgcacttcagcctgagaaacaagagcgaaactccgcctaaaaaaaaaaaaagaaaaaaattttaactgcaagaccaactagaagatagaactttacaagggaaaacaccaccagataaaacttaagaatggctgggtgtggtggctcacacctgtaatcccagcactttgggaggctgaggcgggcggatcacgaggtcaggagttcgagaccagtcgggccaacatagggaaaccccatctctactaaaaaaaaaaaaaaaaaaaaaaaattagctaggcgtggtggtgtgtgcctgtaatcctagctactcgggaggctgaggcagaattgcgtgaacccgggaggcagaggttgcagtgagccgagatcgcaccactgcactccagcctgggtgacagaacgagactccgtcgcacaaaaaacaacaacaacaacaaaaaaaaacttaagaatcttaggttgtgggacttagtcctaatgcacagacctttaagaaattcaacctatagaaaagcatttaactttaacgttttcagtatatttattttactcaccgcaagcattttcattaaaagttcctgttgctcttttgttgcttgatttttagtgctctcttcatattcataaccatttttagctaaataatcaaggtggttgtgaaatataactgaacgccaaaattgctcctataaaagcaaataaaattgcttaaggccaactatcaccttaatatgaggcaagcgttaaatatttatcttaagataccagtttttgaataaaatatgttctgaactcttcctttctataagtttattttacaatttaaattctagtgtgatactacagcttaactttttcccctatccttaaaaaaggcagctggggaggaatacagcatttaaaacagtttcctagctatcataattaatgctcagagaatttggtaaacaagatttttaaaagctaacttgtttcttatttagaataactaactgcaagatttcaaatgacttttgatgacacaaggctaggactagggtcaggcaagccaggtgttatggcacaaaatgtatggaggcacttcttctcagggacatgccccatcctgagagtaagtctttccccagtgggtctctgacagtcacacccatttactttgtagacaaagtccctggaagcagtgatggcaatcaggtggcctggtgatcccaagcagtcctcttccctccctgctacccctatttatgtaattatacagtaatgaatattcaatactggccatcaggataattttaaagtgtgtgtatcacaggtgctgtattatcaaattcaaagtgtcaaggtaagacttccacatacctccatttgtcctttctctgttgcaatctgacagtaaggaagcttaaaggataatatagcaacagcagggcgtggaagggttgggggaaaccgagaacctttacaaggaatgcacctgttagtaaagaaaagttccatcataaaaatttactaacatgtcataaaaactacaaaatttaaaaagttttcaaaagttagtaacttagaatagtaatattataatagctgccttaatcatatataacaaatatctctttttaaaaaagtgttttaggcttgactaggcataaagactatccctacatgcatttcaagaatagaaaaattccttctcacatctcacttgatttattttttttgagacagggtctcactgtgttgcccaggctaaagcacggtggtgtgatcacggctcactgaagccccaacctcccaagttcaagcaatcctcccacctcagcctcccaagtagctgggactacagatatatgccaccatgcctggctaacttttgtattttcagtagcgatggggttttgccatgttgcccaggctggactcgaactcctgggctaaagtgtgcctcccacctttgcctcccaaagtgttgggattacaggcgtgagctaccctgcccaacctcacatctcactttattaaatgacaaccactaaaagtgaaatcagctctcttcatattttccttagcaaactaccacttttaaaacataaaaattgtaccattaatacctgtcatggaatccatgttatcaccaagataaatgctgatgaagctgcacatggaacatactctaaggtcaaccacatgcttggccgtaaagcaagtctcaaaaattttttttaaattgaaatcataccaagcatatattctgagaccatagtaaaataaaaatagaaatcaatactgaggatctctcagaaccacacaaattacatggaaagtaaacaacatactccagaatgacttttgaataaacaatgaaattaagcagaaattgaaatattctttgaaataaatgaaaacagacacaacatatcaaaatatatgggatgcagcaaaagcaatgttaagaggaacgtttatagcactaaacacctatatcaagttagaaagatctcaaattaacaatctaacattgcatctagggaaactagataaacgagaacacactaaccccaaagctagcagaagaaaagaaataactaaaataacagcagaactaaacaaaattgagactaaagaatccatacaaaggatcaataaaacaaaaaaaattgattttttgaaaggataaacaagatcgataaactcctagctagattaacaaagaaaagaagagggaagctccatataagcacaatcagaaaatggcaaaggtgacactacaactgattccacagaaatacaaaagatcctcagagactattatgaacacttctatgtgcacaaaccagaaaatttagaggaaatgggctcacacctgtaatcccaatacttttggaggcaaaggtgggagaatcacttgaggtcagaagtttgacaccaccctgggcaacaaaatgagacccaattgctacaaaaatttttaaagattagccaggtgtggtggtgtgtatctgtagctccagctgctcagaagactgagatgggaagattaattgagcttgggaggttgaggctgcagtgagccatgatcatgccactgcactccagcctaggtaagaccttgtttctatttatttatttatttatttttgagacggagtctcgctttgttgcccaggctggagtgcagtggcacgatctcggctcactgcaagctccgccttccaggttcacgcaattctcctgcctcagcctcccaagtagctgagactacaggtgcccaccaccacgcccagctaatgttttgtatttttagtagagacggggtttcaccgtggtctcgatctcctgaccttgtgatccgcccgcctatgcctcccaaagtgctgggattacaggcgtgagccaccgcgcccagcattaagactccgtttcaagaaaaaaaaaaaaaaaagagagagagaaagagaaagtcctcaaaagcaattgcaacaaaaaccaaaactgacaagtgggacctaattagactaaagaacttctgcacagcaaagaaaatctagaggaaatggataaattcctggaaacataaaacttcccaagactgactcagaaaaaacagaaattctgaacaaaccaataatgagttccaaaattgaatcgtaataaataaaaaacctatcaaccaaaaaaagccctggaccagaaaaatcacagctgaattctagatgcacaaagaactggtaccagtcctactgaaaatattccaaaataccaactcctctccaaatcactctataaagccagcattatcctgataccaaaatctggcaaagacacatcaaaaagagaaactacaggccaatatccttgatgaacacagatataaaaatcctcaacaaaacactagcaaaccaaacccaacagtactttaggaagttaatacaccacaaccagtaggttttactcctgggatgtaaggttggttcaacatatgcaaatcaatatatgcaattcactgcatcaacagaattaaaaacaaaaaccacatgatcatctcaatagatgcagaaaaagctttcgataaaattcaacatcctttcataataaagacctccaacatactaggcattgaaggaacataactcaaaataaaaagagccatctatggcaaacccacagacaacaccatatgaatgggaaaaagctggaagcattacccttaagaattggaataagacaaggttggccactcttttcactcatatttaacagagtactgaaaatcttagccagaacaatcaagtaagataccaaaataggaaaagaagtcaaatatctctccactgactatattactctatacatagaattgctaaagggctcctagataaaagactttggtaaagtttcaggatacaaaatcaatatacaaaaatcagtagcatttttatacaccaataatgttcgagctgagagtcaaatcaagtatgcaatcccatttacaatagtcatacatgtacataaaatacctaggaatatatctaaccaaggaggtgaaagatctctacaagaactacaaaacactgttgaaagaaatcacagataacacaaacaaatggaaacacattccacactcatggattagaagaatcaatatcattaaaatgaccatactgtgtctgcagcaaccttggtttgcatcgaagtcacagcaccaaaaaaaaaaaaaaagaaagaaagaagaaagaaaaagaccatactccccaaagcaatctatagattcaacactattcctatcaaattaccaatgtcatttttcacagaattagaaaaaactattctaaaattcatatggaaccaaaaaagagcccaaatagccaaaggatctaaaacaaaaacaacaaagctggaggcatcacattacccaacatcaaactctacttcaaggctagtgaaaaagaacatggcactggtgcacaaacagaaacacagaccagtggaacacaatagggaacacagaaataaagccacacacctacaaccaactgatctttgagaaagctgacaaaaacaaggaactgggaaaggaatccctactcaataaatggtgctgagataactggctaaccacatgcagaatgaaactggacccttaactatcaccatgtgcaaaaattaactcaagatggattaaacacttaaatgtaagacctcagaatataaaaatcccagaagaaaccctagcaaatacccttcaggatattggccttggtaaatatttcatgactaagtccacaaaagcaattgcaacaaaaacaaaaattgacaagtgggacctaattaaaccaaagagcttctgcgcagcaaaagaaactaccaagagtaaacaggtcaggtgcaatggctcacatctgtaatcccagcactttgggaggccaaggcaggaggattacttgagcccaggagtttgagaccagcctgggcaacaaagggagacctgtctctacaaaaaaatttaaaaattatccaggtgtggtggcatgtgcctgtagtcttgtgcaatcccatttacaatagccatatgcacacacacaaaatacctaggatatatctaaccaaggaggtgaaagatctctacaagaactacaaaacactgttgaaagaaaccatagatgacacaaacaaatggaaagacatttgcagatcctgaggtggatcactgagcccagaaagtcgaggctgcagtgagccatgatctcatctcaccaccgcactgtagcctgggtgacagaatgagactctgcctcaaaaaaaaaaaaaaaaaaaaaaaagacatcccacagaatgcaagaaaatgttcgcaagctatgcatccaacaaagatctgatatccagagtctataaggaacttaaaaaaaaatcagcagcaaaaaacaaatatccccaataaaaagtgggcaaaggacatgaacagacacttttcaaaagaagacatacaaggctgggaacggtgggtcacacccataatcccagaactttgggaggctgaggtgggtggatcacttgaaaccagtagtttcagaccagcctgggcaacatggcaagacatgtaatcccagcactttgggaggccgaggcgggtggatcacgaggtcaggaaatcgagaccatcctggctaacacagtgaaaccctgtctctactaaaaatattttaaaaaattagccaggcgtggtgatgggcgcctgtagtcccagctactcaggaggctgaggcaggagaatggggtgaacccgggaggcggagcttgcggtgagccgagatcacaccactgcactccagcctgggagacagagtgagactcggtctcaccaaaaaaaaaaaaaaaagttggccagatatggtggctcatgtctgtaatcccagcactttgaggggtgaggcaggcagatcacttgaggccaggagctcgagaccagcctggccaatgtggtgaaaacccatctctactaaaaatacaaaaattagctgggtgtggtggtgaacgcctgtaatcccagctactcgggagggtaaagcacgagaatctcttgaacctgggaaattgcactactgcactccagcctgggcaataaagcaagactgtcacaaaaaaaaaaaaaaaaaaaaaaaaaaaaaaaaaaaaatgccaatgaggcatattcactttcatccatcagtttgggaattcttagtactgtcggtatgagttgtcaaaaaagagaaaaaaatcaggcatggtagtgggcacttgtaatcccagatattcaggaggctgagacagaagggtatcacttaagccaggagaccagcctgggcaacatagcaagactccattccaaaaaagagagacagaaagatggtgaaatgcctaatataggttaagtgtttattagatattggtcagagtgaagcagaacatcattagaaagactataatctatatctactctgataaatatggtaacaggtcaacggggcaaagactgtctaaacctgttctgagtagtctatataaggcattcaaacacgcccatcatgagtagtgctctcgcagctgatttattaaaaagcattaattaatcacagaatgatttatatatatatagaactctttcaacttatgtactccgatttatttattagaaaagcactggaaaaccatgactgcacactataaataccacaggcaaatttcatattttcataaagtcatttaaaaagacgaaatctctttttgaatgcttactaataatcatccacttaatttatagtatagccttttaatcaggacattcttgaagggagatactaagtagaagctagaccctagggtttaaaaattttataaatatcttccagtattatcaaatgcccactagagtaattagaaaacaagtaagtgacaatgtctagtattctttttcaaactactcaggcccctttcttgtgagattcaaataccctcccttcttttttttctgactatacaataaaaatacaaatgtttttagggttctaatttttttgaacatacaatttcatttatttcttccttctctccttttatgattttataaaaaatctagttttcaccacacagtatgaggtggcagtgtgaatacctcaagtttgaaagaatcttgtggcaattctgtcataaatctctatttacaagaatcactactttactagtcatgcaaaatgaaaaagagcatgtgcattcacaaaagatgagtccaggtacatatatatgtacattaacaaaattagaagaaacactgtgagaaatgttaattgcctaaacatttttttctaaaatgtcctgtttaaaaacattttacagctcactttattgatttacacatagtaagcaattatcacaaagaaaaaggaaatactgagtaggattttattaagttactttctaagccacatttacatcaaagcagagcaccaattcgcatttttttatcctttccttagctttagagacttcaactaaaaagatgttttctctgttaaatatccccgtcatagaagaattcaaggaaaaaacaaacacatttaaactgctaatttggtgggttttgatgacgacggagtttcctggaaactatgtgcataaaccacctggaagaggaatttaaaaaaaaaaaaacaatgaaaaacctggtttactaaaaagacaaaagtggctgggcacagtggctcatgcctgtaatcccagtacataaggaggctgaggtaggcagatcgcttgagctcaggagctcaagaccagctcgggctacatagcaaaacctcgtctctacaaaaaaatacaaaaaatacaaaaaatttgctaggcatggcagcatggacctgtagctttagctactcggaaggcggaggacggaggatcgcttgaggccaggaggcagaagttgcagtgagctgaggtcacgccactgcactccagtctgggcaacagagagagattctgtctcaaaaaaaaaaaaaattacttcaatttgttttcaaattgaccacaaaacctgttttgttttgttttttttttttttgttatattaaagaaagagtttaaaaatgccaaaataatcaggcgtggtggctcactcctgtaatatcccagcactttgggagccaaggccggcagatcacctgagctctggagatcgagaccagcctgggcaacctggcgaaacactgtctctactaaaaatacaaaaaattaactgggcatggtggcacatgcctgtaatctcagctacttgggaggctgaggcataagaatcacttgaacccggaaggaggaggttgcagtgagatgagattgtgccactgtactagcctggatgacagaatgagactctgtctcgaaaaaataaataaaaatgccaaactggagaaaactaggtcgtgtccagattaaccttgccccagccagcaagttttgctttttcttctgtgttggaccggactgtcttctgcatttgaggggactttgctcacatctcttttaaagcacttatttgggagtagcataatgactttacaagcctacctcttccaggccacagcctcatttatctttgtgtggtatagcacatctagtcggtactataataaatgctaattcagtgaacacaactaggaaaaatgtctagttttcaagcacattaaataactcttgttttgaaaaactaaacagaaaaagaaagaaggtctctgttggtagagagcaaattagactgtaacacagcaaaatttattaactctcagttatgtattaaccagtagtgtcatgaaaaaatctttagaagaaacaatacttggtaaactgaagttcagctcaaagggggcagggatgacattaatacagatcagtaatttctcatattcataatttttttttttttgagacagagtttccctctgttgcccaggctggagtacagtggcgcaatctcggctcactgcaacctctacctcccaggttgaagcgattctcttgcctcagcctcccaagtagctgggattacaggcatctgccaccaggcctggctaatttttgtatttttagtagagacagggtttcaccatgttggccaggatagtctcaaactcctgacctcagggtgatctgcctgccttgccctcccaaggtgctgggattacaggcgtgagccactgcacccaacctcatattcataattaaaggaaaataggaaaattttatattgacttaaattaatgcttttttttttaaagagacggggttttgctgttgcccaggctgtctgcaaactcctgggctccagtgatcctcctgcccctgtcttttaagtagctggtattcaggtgtgcaccgatgtgacacgctctcaaatgaatttttaaaaattatttttcacaaaatgtactttcttttaaaggatctctgaacaaaaagaaagcataaataccactgagttgggttagaaaatgcatttaaagttaaaagaataaagaaagaggtatcactaagtcacttcatcttcacagaaattctgtgaaatgggtacactgtggttttagagatgaggaaacagtggcacagagccagggctactgaacgaggatttcagccaggataccacaagcaggcagtgtcactcgagagctcgagctctggaccactaggccacattggctttccagagaagcatgtgatttgctatctttatcacaaacaatgagagcaaacagaggcattaaaaatgcaaataaatatgaagatgaatttctttatttcctttttattttagagacaaagtctccttctgtcacgcaggttggggtgcaggggctgtataaccttgaactcctgggttcaagtcatacccttacctcagcctcccgagcagctgggactacaggcatgtaccaccatgcctggcagggtctctctatgttgcccaggctagcctcaaactcctggcctcaagtgatccccatgctttggcctcccgatgtgttgggattacagctgtgagtcacaaagcctggccaaaaatgaatttcttgctagccaaaataggtaaggctctttaaacacaacagcaggctactaaaaaagtgattgcagaattttattccccgaacttccatgtaccgctatccacagaaaggaaatgaatcatctctaaatatgccaacatgttaagcaaaactggtgtgaaaagtacagtaagccatactgagaagtgttgcttccaatctttgaaaaatatttaaggctatataccaaaaaataaataataaataataaataaataaatgttctacaagggtgtaccaaaaaaaaagaaaaatattcttattcaagtttattattccagcataaagccaggaaaatatgaaaatatgaaaacagtctgcagttatcaatttatcacataatatacaaataaatacatttctatcaacagattttttagtgtatcttctcagtgcttcaaatgcctactgtataagattcccctcagtaattcaattattctacaacaagctggtctttataggagaagtatttattctttcaatctacttatcagctaactccctttgttcctatattttaatacaaaaaaataaggttgttttttttttgccaataaatagatgtgtactctctaccaaattactttaatctttttggaccttagttttctcatatgtaaaaattggggagaagtgctgggggtgaagagagacagcaaatagaccaaaagaacttggtagttcccattcttttattcctgtagggctgctgagctattataaagtgtctaggaatgcacacaagcaccatgaattgtctgtagaccaaatacaaaaatagtttccactttacatactaaaattttcacatgtatgcagataacgtgatttgtaaatacaattttatattaaaataaaattttcaggtctacagaagcttatgttatcatgcctgtaatcccagcactttgggaggccaaggtgggaggatcactcgaggttagttcaagaaaagcctagggaacatagcgagactgtgtctcaataaagaaatattctttattagctgatactaaatgtagagctactagagctactattatttggaggcatgaactgttcaacatttaaaaaaggactcttgttcaagtccagcctggataacgtaaggagaccctgtttctaaataaataaataaaaagggctcttatatttgaaaatgtcaggagctactagtatagacggtttctaaaatccttctaagtgtaaaagctgtaatttacagtccattatttctttatccattattgaatataacagttaaatgttaccagctgtaattatcgtagtttttaacaagttaaaattctttacaaatcttaaataaaaagcaagtaaaaaatgtgttccaaagggttgtgtggaaaaaaaaaaaaagcatgttaagaaaaaaaaagccagctggataaattactaagggtgtgaaaactgcaattgatgaaatacttgtaatattaaatgaaatgaagaagcaaaattgttcattgcagatgactaatttcatatattgcaaataaataatttcatatacctctaagataatgacattcactaacaaaatgaataatcttacttgaataagcattaggcagaatagtaaaaatcctcataggttcaaaccttaacctactattaagatagactgtgaattctttaattcaaattactaaactaactagattcctgaaaatggacatgcaagaaatcactgagaacaacctacactataagaactactaaaaatagtgaatgtggcttggcatctggcttatacctataatcctagcactttggaaggctgatgcaagaggatcagttgaggccaggaattagaggtcaatctgggcaagatggtgagaccccatctttacaaaatatttttaaaaattagccaggtgtggtagcctgtgcctgtagttctacctactcaggagactgaggtgccaggatcacttgagcccaggaattcaaggctgcagtgagctatgactgcactactgcactccagcatgggcaaatgagtgataccctggctctaaaaaaaaaaaaccgttaatgaatatacttcttctgatactaaatatgtcaatatttagaatgtaatattcagtgattacaactgtaaaggcaaaacacacagaaataaccaccaattcctctgtagttctctactaattcaattttgcatcctctgagactatatgtcttttcttctcaaacatcccacaatgccaaccactgtctccagaaataactgaattctgcttcatgatctgccaacaaaacagaagccaaaaacagaagataggaatttgttaccttttggctaccaaatctatctgcatttgtgcctatttttttccctttccagaactgatgaaatgtctattttcctattttagacaggtgatctaaaagctactacttttttttcttttttcattcctttcattggctccttcttttaaattatcaatcttatcttctttactaaattcattgccaaaagattacaaaaatgctatagagtcacctaagctaaaaaatcccttcaaagactttttatcctcctttaggtgccaccccaaatctttgctcctcttcacaccaaagttctttttttttgagataggttctctgtcgcctagacaggagtgcagaggtgtgatcatgactcactgtaacctcaacctcctgggctcaagtgatcctcccctcttagcctctcaagtagcagagactataggtgtgtgccatcatgcctgggtaattaaaaaaatttttttttgttgaaactgggtctcactatgttgcccaggctggtctcaaactcctggcctccagcattcctcccgccttgggctcccaaagtgttgggattacaggcgtgagccacctcgcctggcccaatagtcaaatttcttgataagagttatccacatattctactttcatttctttacctcccatgcccaccccaatctggaatttaacattttatcacttttatcagagtcaccgttaacctccatgtagccaaattaagaagtcttcttgaacttaacttctggccttatctgatttagtttattgaattgctgctttgtttaaaaattcaatttatttaacttttgaactagtaattcaaagttacatgctcaatttacatgctcaaaaagtataaaaatgaatacagagaaaagtctcctatactatccactgagtttctctccgtgaggtaactattattgttagtttccttttcattcttctaggaattcttttgcgtatgtaaagcaaatacaattacatattcttattctttccccacttttacacaaatggtatttatttcacttaacacatcttgcagatttttctatatcattatatagtgtcctcatcctttttaacagctttgtcaagatatgattcacataatattgagttcacagagaatgtaccagccatatcatatggtaagtatacaattcagccaggcacagtggctcatgcctgtaatcccaacactttgggaggccgaggcgggaagatcccttaagcccaggaatttgagaccagcctaggcaacatggtgaaaccctgtctctacaaaaagtagctgggtgtggtggtgcgtgcctgtagtcccagctacttggaaggctaaggtgggaggatcgcttgagcccaggatgtcactgaagtgagcctgaagtgagacataatcgggccactgtgctccagcctgggtgacagagtgagactctgtctcaaaaaaaaaaaagacataattcagtggtttttttgtatattcacagaattgtgcatctatcaacactaatttctgaacattttcatcaccccaaaaagaaatcccatgccacacccagccaatgtatcattttatacatatgccagcagcagtacttcccaaactttaatgtgcacacggatcaatataaaatactattagtccaggaccaggtacggtggctcatgcctgtactttgggtggatcacttgaggtggatcacttgaggtcaagagttcaagaccagcctggccaacatggtgaaaccctgtctctactaaaaatacaaaaattagctgggcatggtggcacatgcctatgtaatctcagctactggggaggctgaggtagaagaatagcttgaactcaaagtggaggttgtagtgaactgagatcacgccactgtactccagcctgggtgacagagtgagactccacataaaaaaaaaaaaaaaaaaaaaaactcagctgggcgtggtggctcatgcctgtaatcccagcactttgggaggccgaggcaggcagatcacaaggtcaggagattgaaaccatcctggctaacacggtgaaaccccctctctactaaaaatacaaaaaaatcagccaggcgtgatggtgcgcacctataatcccagctactggggaggctgaggcaggagaatggtgtgatcccgtgaggcggagcttgcagtgagctgagatcacgccactacaatccagcctgggcaacagagcgagactctgtcttctattagtccttcctcctattacgataattaagcaaaacatctcaaaaagcagcttaattgtatatttcaattctcaattgaatatatattgttttattttcactttaacttttatatttattgttattttattaaaataaaagacagtaataaaaggtgaaatgccatgtttaatcagaattcctctccctgtgtggctgaaatgatggtaaggtcatcctaattatttctattttgttcaacatgtttcaagtaaagcaagtgactgaaaacttcagagtgaatatgaacaaattcctaatttagtgactatggaaagcaagtaattggactaagataaaagacaaatacacttaaagggcctcataaaaagaatttcaacatactttttaaaaagagtcaactttagacttcttttaatagcccaccttagttgctggggattttcatggataccaaccacccagtagtgatcagattttcctttgcagtgctctcttgtattacatataggagtccacgtattaccaagtcctctgttaagcattcgaacaattccttctgaatccacgtaacaaggggtacctaaacaccaacagaaaaatcacttggagacatagctacatgttgttaaaggaaccctatttcaaatatattatacataccaaggattcaactttgctttcaaaagcaaaacacaaaacagaagcaaataatctaagattattacgtaaaatttcattaaccatataaagtaagacctaactaaaaaaagaaaaaacattggatttgatatgactaaaatttacacaaataaagtgaaaaaactgagtttcagtgaaaactatgccacctgctggaagataataataatttcatttatttatttatttattattattattttttttttcgagatggagtcttgctgtgtacccaggctggagggcagtggcgcgatctcggcccactgcaagctccgccttccaggttcaagccattctcctgcctcagcctcccgagtagctgggactacaggcacccgccaccacgcccagctaatttttttttgtatttttagtagagacggggtttcaccatgttagccaggatggtctcaatctcctgaccttgtgatccacccgcctcagcctcccaaagtgctgggattacaggcgtgagccaccgcgcccggccgataataattttaaagccaattttagtaaaaaattaaacatgaatcagaaggctcccgcttgagaaacatttagaaaaatgaccaaaatctgatacaaagtgatctttacgaaatttatctttagtactcttcttcctctctcttctttttgttggccttgtcactactctgtccccaactactaggtaagcaattcttacctcgtaaaacagggaagcattcttgttttccacctattctgcttccaactcaggaaatctgtggcaaattacctgattatcccttttcttatctgtggcttcacacccccctcactctgcaaacattagtttccgcagggtctggatctaattggtacttcggagaaaaaaatctatacaaatggaagttatcaatggttcatattattaaagcctgaatgactaatagaaaacacatttagaaatggttgatattttaaagacaaagtggagtttccagcaatgtaaatgaagaacatgaatctccaaaaagagaaatatttaagtccccatgagacagagatgacaggtgatttaaaataaggtactcctgggccaggtgcagtggctcactcctgtaatcccagcactttgagaggctgaggcaggtggatcacctgatgccaggagttcaaaaccagcctagccaacatgacaaaaccccatctctactaaaaatacaacattagccaggcgtggtggtatgtgcctgtagtcccagatactcgggaggctgaggtacgagaatcacttgaacccagaagacagaggttgtagtgatctgaggtcacatcactgcagtccagcctgggtgacagagtgagactctgcgtcaaaaaaaccacaaacacaaaaacaaataaaataaaataaggtactcctcagtgtctttcaaatcatctgtcataagcctctagaatttggtctaaaatagcacttatccaaaagaaatatcatgtgagccacaagtgtaatttttaatttcctagtgccacattaaaaaaaaaatggctacataccatgtatctgaacaacaaaaaaaagttaagtgaaaaaatttaggctgggggcggtggctcacgcctgtaatcccagcacttcaggaggtcgaggcgggtggatcacatgaggtcaggagttcaagaccagcctggccagcatggtaaaaccctgtctctattaaaaatacaaaaattagccgagtgtggtgacgcaagcctgtaatcccagctactcagaaggctgaagcaggagaattgctggaacccggaaggcagaggttgcagtaagctgagatcgcatcattgcactccagcctgggcaacagagcaagactcctaatttattccttaaaaaaaaaaaaattttaaatagagatgggatctcactatgttgcccactctggtcttgaactcctgggctcaagtgatcctcctgcctcggcctcccagagtgctgggattataggcatgagccaccatgcccagccaaaaaaaaaattatttttaaagaaaaaaaggatgaagttaatgttaataatacattttatttcatcgaagatatctcaaatattatcatttaacatgtaatcaacataaaaaaattgatttttatatcttttttcatgctaagtcttcaaaatccagagtattttacacatacaagcacatctcagccatatttcaagtgctcaacagacacacatactagttattgtagtaaacagtgaagctctagaaaattctaagttttctgtatgatctgctggaaaagacacaacttattattgatttgtatcacctccttgctatttaatactttcagaaaaatatatttccttctttataagttttctaatgagaattctcatgaagagagctcttagccgggtgcagtggctcgcgcctgtaatcccagcactttaggaggccaaggtgggtggatcacttgcgcctaggagtttgagaccagcctgggcaacatggcaaaaccctgtctctacaaaaaatacaaaaattagctaggcatggtggcacatgcctgtagtcccagctactaaggaggctgaggtaggaagatggcttaagcccaggaggtggaggttgcagtgagccgagatcatgccactgcactccagcctggacaacagagccagaccctgtcttaaaagaacataaaaataaaaacaagatcttatacataaaacaatggctaccttgcctaaagattgcagctcccagttctgccaacatattaaaatagaaatttaaaatataaaatagagataatttattcttaaattaattaggaataaaacaatgaaataattttcttcttgaagaatatctaacactttatattatacttgttttttttaaacaaatttatcttgccttcagctgaaaacccaatccatgcaaggtaggatttccttgtaagaggaagagggtcaccatgcaaaatttgttttttctttttccccagctctagcagttgaactccaaggcactgatccccatcaaatcctgtacctaatgagaaaatgtaaatataaatcaggcatcaaaggttatccaactataacgcagtctaaattattttctgtgaattgattttgtggtaaattactagactgactagcactactttttatgaataacccatccaactgaggcatcattcaggtattagaaacacagtaagatgttacatggactcttcacataaagtccttataagtgggcatttattcactcaagacatatttacagagagcttactacacgccagcattggcctagatactggggctacagcaataaacaaagtcaccactcttattaaattcaaatttcaggtagaagacaaattaaaaaacacaaaaagaacaaaaaaattatcacaaagttaaaataatgtgatacagaatgtcagagtggtttgttagactggttagtcagaagtgacctctcagaaagtaaagtttaagctgagacatgaactgcaagctggagcctgccatgcaaacattaggggaaggaacacggaagtggatggagggaacagctaatgcaaagtcctaaggtaggaagaatggagggctcgaagaacacaaagaggcagtatggccagaacatggtaatgagaaacaacggtaagagatgaggttggagaggcaggcaaaggtcagattatacgggatcagtagatcaccttgacagctatcagaagtttgactttgattctaaaagtgaaggaaagtcagagggatttgagaagaggagcatgatctatatttttaaaagatcacctaggctgctctgtggagaatggactgtggaaggcaagaactgaagctaaaagactagttaggaggctactatgacagtccaagagatgacatccaggttgtattagcagaagaaatgaaaagagacaaatttagaatgtgttattccatagaattgacatgatgatataattttactgttggagttgatgcaggggaaatggaaagagaagaatcgaggataatttttagatttttggcttcagccactagattgttagtaagccatttactaagatggggaaactacataagaagcaagcttggaaggaaaaaaatcagtttttattgtgagcaaattaagtctgaaatgtctgtccaaactctaaatagatttcaagtaggcaactggatgtgtaagtctggagacacaaggagagggtagggttggtgctatcaacttaaaagtcatagacactgagatgtatttaaagccatggattatgataaaattccccagggtggtttctcaaactgcatattttgacctaagagtcatggaatcaattttaatttgcaactagcattttaaaaaatgaaataaaaaaatttaaactgatatcaaaagagtaaacattgtccaggagacttttatttcagttacatttgcagatatttatagaacagttatatagaatatatttcttttcttctgtttttcttttaaaaatagaaacaggggcttgctattgctatccagacttgtattgaactcctgggctaaagcaactctcccgcctcggcctcccaaagtgctgagattacaggtgtgagccaccacaccacaccacaccatacctggtccagaatctatgaatctatttcttactgtggcaaagcagacaaaaagactgaaagaccctgacctagagagtagtagagaaaaaggggatacactccagctaaaagatagagccaacaaaaaagtaaaaagggagctgccagtgaggaaaaatattgaaagtatgatgtcacagaagtcatgagaagaaggtattttcaatggaattatttttttaaaaaagcacagagattatcggttaccttgataagaccagtcttagcatagtgacggggactgaagaaagacatgaggggaggaaaaaggaggcagcagcttttaaaaagtgtcacattcagagttgttttggcccttcctactaggagttatttttgtggaatttcaacgctgaaagttctctggtcgtgcttgccaaaatggtaagatttagacatggaagtaattaaccaaattccaccttggaattctctctataatatagttctattaagaaacattttcattttcattgctgctagtgaacacaacaaaattatctacatttaaagattacacggattcaaaaggaagtatataatccaagacaaaaagagtaacaaaaacagcaaaaaagctcaagtaatttccattttacttcaagtcataaaagactgaaaaaaatctacctctgtgataaacaatgaaaagctgttctccatgtcctgccattgacaccacaggtccagcaaggctgaatacctctttttgaacccctccaatagtaaacaatcgaagaagcagggcactagtagcggcagcagcccatccttgaccgagacatatggcttcaatatcctcattctgaggcaagtctattatccactctttgcttgaatcccaagaactaaagtgcaggcagtgaagcttgctaaaaattaaaacaagacagaaacaatcaaactttcatatgatatttacatatatatatatataagcaatcatgatattcaacaaaaaaaccaaatagtttacttcctattatacactagtataagaagttgctttaaaaaagtaattatgaaatacccttaaaatgaactatattgatatctttccagccttttttctttgcacatacatatatgtaagttattattaaatacaaattctttttttttgaaatggagttttgctctgtcacccaggctggagtacagtggtgtgatctctgctcactgcaacctccgcctcccaggttcaagcaattctcctgtctcttgcctcagcctcccgagtagctgggactacaggtgggtgccactgcacctggttaatttttgcatttttagtagagatgcagtttcaccatgttggtcaggctggtctcaaactcttgagctcaggtcatctgtccgccttggcctcccaaagtgccgggattacaggcgtgagccaccatgcccagcctgaaggatacaaatttcaaatcacatagaagatagtaaaatccatgaagtgtatcagtactataatcagctgaagaagggatcaagagagggcaatctcttgattaacaaaaagctgaaaaaatattttcttttcttttgaaaagaaaaacattctgcacccattgctttcccatcataatttttttcttgacatctatctacctatttacttacctacctacttatcaaaacatgtaaacatccaaaaaatattaagtagaaaaagcaaacgggtgactagtacattttttggtttgtttttccgtttttttttcctttctcgaagagagattttaaatttaatccatcatgacaaaaatgtagattaatagttggccaaggctcaggttgaattaactgcaaagggatataagaaaacattcttgggtgataaagacgtagtgacaaaaatctagactaatagttggccaaggctagggttgaactaactgcaaagggatataagaaaacattttcgggtgataaagaacattctgtattttgattgtggtaggggttatctgtgtatatacacctttgtcaactcatcaaatgggtgcattttattgtaaataaattacatctcaataaagtaaattaaaataagggaggttcaaatagaaagaaatctggaaggatacatatcaaattgtaaatagcagttatatctgagagtagaattctgggaggagttttcattttccgaaacttctatactgtatactggttttttttctttacaatgaatgtatattactcttataatagtaaaaaaaaaaaaaagcacttaacaatgtaaaaaaaaaatcccatctcttgcattactaactatgccatgtcattttgctatgtagttagagcatgtaatgagggaatcattatggcaaaaacagacatatgttctgaggtattttgggtgtgctggtgtttgtaccaaactcttctgaaatttcatattacaaaaaataaattttgttttattaactttttgtctttaatttcaacaactgtatctaacagttcaacagtgccaaattcttcctaataatcttgagtttaccttgctagttcatcagtgctttcacatgccaacaaaatagcttcgtgggaaagatctgctattgtataattcaaagtgtttgataagtgtgttgcatggtgtatggaggtatcatggaactccacatctatggcattgtcttgctcatcattatagcagcgaataattccaatagagttccacacctacaaacaggtaagattaaatataagtctgagaaaaactgaagctcctagaatcagtaagccacagtagtacaaattaacaaatattataattaaatttgtattaagatttaggttttgggagttactacatctcatctatctctaaatagtttctgacaggagtcataataccagagctacaattacttattatttccttggtgagaataagatacatatatacttattaattagcaaatagagtatttaataatatttaaaaataaattacatgactgttactttaaaagcacattacagttgtcctttgaacaaccaaaccattaaattcctcaaaagaaatatttcaaaaattgagttttcttacaaatatggatgcaaataacaacagacttttttcctaactattctatgataaaataaatacatacattttaagaaaacataatttttttttttttttggagacagttttgctctgtcacccaagctggagtgcagtggcatgatctcggctcaccgcaacctctgcctcctggattcaagtgattctcctccctcagcctcctgtgtagctgtggttacaggtgcatgccaccaggtccagctaatttctgtatttttttagtagagatagggtgtttcaccatgttggccaggctggtctccaactcctatcctcaagtgaccaacccaccttggcctcccaaagtgctgggattataggcgtgagccatcacgcccggcagaggcaacataaattgataccacttggaaaacttatcttccactgatgtccattataggctcacactaggccctagagtttctaataaaattagtgccaatattttatttaacataactataaataaaatattgacactaataaaaaaattaagacctatgacttgatgactactgatagcaataaaaagttttattaatattaatcaccacccttaatctttacataaaaatttatgccaggcctatactcttcaaatttatgccaggcctatacttttaaaaaggcaaaatcctcagaatggaaaacatcatataaccaacacagaaaaactaaactttttaagaactcaggccaggcgcggtggctcacgcctgtaatcccagcactttgggaggcctaggcaggcggatcacgaggtcaggagatcgagaccatcctgtctaacatggtgaaatcccatctctactaaaaatacaaaaattagctgggcatggtggcaggcacctgtagtcccagctactcgggaggctgaggcaggagaatggcgtgaacctgggaggcggagcttgcagtgagcagagattgtgccactgcactccagcctgggcaacagagcgagactccatctcaaaaaaaaaaaaaaagaactcaaatctaaggcaaaaagccaatatattcattttgtctattcatgaaatatatatttaatgtgcactgtatcataccttgttccaaatcctaagaacatatcagtaaacaaaacaaaaatctttatcctcgtgtagcttacattctggtgggtggtggagtgaggaaaagggtcagacttttccccccatagtacttgccaccttctaatatattatactagtagttgccttctaagaaagcacctccttactagtgttttggagtcagtataatcttctatgtaacaatgaccatgaagaataaggtttgaaagtattgccaagaaatattgcaagatagtaatatttacttatgttcatttaatgtcattttggaaagcagaattttatttaacatcattttcaataaggttgaaacaagattaaaactgtgagctaaccataaaataaaccaaccacaaaactgtaatcaaccaaagtgctccaggctacttaatcaaagtttttaaaaatatgttttatccaaaaaaattaactatagtaagaaaaaagtgctgaaaacctactaagaagttaagtgtagatccaagtcttaccatgaatctgtgagtgagatgcaacggtgtagaacctgactgaaatggcttttgccggggagttggcatgggtccatcataaaatggcctttgggatgttacaagtggtagattgtgaatgctgccttcttgaccatcttcctcctcctctttgagaagactagaaccagtttttagcattgaaatatctacaacacaaaggatcataattaagggaatcacgaataccaatgatttggaaaaaggaaagcattatggaatctagtaactttttcattcatattcaatgacactgacatgctatttgcctctttcactgtgttaaagagatgcagtgatggtgcaaaagcaatggtgggtaaaattcctggtgccttggcaccaatcaaggcagtggcacctaactgtattagtcgttactgcattgttaaccactactcacttgcagtaaaaatattaattttattaaatcttgacgcttacacagattttttttttaaagttctgtgtgctaaaatgagaagtgtgatggttgtcttgaaaaaaagcacttatgcaattgtttgagttgtaagctgaactaagtgattttttttcatacaacactacttttacttaaaaaacacatgccagataaactacggttatgcagaattggatctttggcaaacattttcttgtaaatgaatgaagtgagcctatcaattaagaaaaaataactggcagaatttgttgccaatgataacatttgagctttcaggccaggcacggtggctcacacctgtaatcccagcactttgcaaggccgaggcaggcagatcacttaaggtcgggagttccacgttgaccagcctggccaacatggtgaaaccctgtctctactgaaaatacaaaaattagccaggcatggtggcacatgcctgtaatcccatctactcgggaggctgagacaggagaatcgcttgaacccgggagactccgtctcaaaaaaaaaagagctgggcacagtggctcaggcctgtaatcccagcactttgggaggccaaggtgggtagatcatttgaggtcaggagtccgagaccagattgacctacatagtgaaaccccgtctctactaaaatacaaaaattagcctggcatggtggcgggcacctataatcccagctactcaggaggctgaggcaggagaatcacttgtacccagagggcagaggttgcagtgaaccgagatcgtgccactgcactctaggctgggtgacagagcaagactccctctcaaaaaataaaaacaagaaatttgagctttcaattaaaaattaagatattggaaagcttctatttgccattatgagcttcacaactttctaatacttagaaactactgatgagattggtaacaacactagcagatataatttacagccaggtgctgtgactcacgcttgtaattgcagcactttgggaggctggggagggaatatcacttgaggccaggatttcaagaccagcctgggcaacaaagcaagattccatctctacaaaaaataaaaaattagatgggcatggtggcatgcatctgtagtcctagctacccggaaggctgagtgggagaactgcttaagcccaggagttcaaggttacagtgaggtgtgatgataccactgcactccagcctaggtgacagagcaagatgctatctctaaaaacaaaaattaattaattaaaaacaacatataattaattaaaaacaaaaacaaataatttatattagataataaaaagtgtcagtataaagaggatctataaacttcagtgaaccaatattatcaattcatatgttacaaaattaaacatgattttaaaaaatccattcaacattcaagtcagaccaatgaattttttgattttattttgtttttttctgagacagggtctcgttctgttaccctgcctggagcccactgttgcaatcatggctcactgcagcctcgacctctcgggctcaagagatcctcctacctcagcctcccaagtaggtgggattacaggcacacgtcaccacacctggctaatttttaaagtttttttgtagagaggaggtctcactatgttgccctggctggtcttgaactcctggcctcaagcaatcctcctgcctgggcctcccaaagtgctgggattacaggtgagagccaccattcccagccagaccaatgaatcttaacataacagagccgtaagagttcactgaagttttcagattacactttgcaagtaatctttaggaaacgatcatcttctgagtcttggtgcaacatcaaagaatatccacaattaattgaatgtgctattaaaagatttcttaaaatacttctcccttttcaaattacatatttatgtgaggccaaattttctttatacacttcaaacaaaaacaatgtatagcaatagacttaatccagaaaagtagatgagagaatccagctatcctctatgatagacattacaaagattgcaatgccactcttctcactaattttttttgtttttcataaaaaagtactattcatgtttacatgagtttattaatgttatttttaagtgaataaatatttttaaatttctgaattttaatttctaatatgtaaatgacgatagccgtaactctgtataaataaatgctctcggaagggtcctcaaaattttttagagtataaaggctactgagaccaaaacatttgaggactgctgttctataaactctatatgactttaaaaagcacaacatagcactgcacattggcattttacttgataatgttcaagtgttattgtagcatgtaagttgttacaataagcactctatttgaagattttcaattacaatctcaatttcttcattttacttgataatgttcaagtgttattgtagcatgtaagttgttacaataagcactctatttgaagattttaaattacaatctcaatttctttaatagatacaatactattcaggttatctattacttcttgagttagcagtggtactttgtgtctttcagaaaattcgtctatttcatttaagttgttaaatttatgggcacaaagttattcataatattgccattatgcctttgatattaatagtagcactgccatacagacatataatgtgagttacagctgtaattttaaattttctaatatttctaaagtttaaagagtaaaaagaaacagccataatcttaataatatagtgcatttaaaatacatattatcatttcaacatgtactcaatataaaaaatttcccaagatttttacattctttttttcatattgtcttcaaaatctggttgcactccatggtgaaaccccatctctactaaaaatacaaaaattagccaggcgtggtggcgcatgcctgtaatcccagctactcaggaggctgaggcacaagaatcacttgaatccaggaggcggaggttgcagtgagccaaaatcacaccaccgcactccagcctgggtgacagagtgagactccgcctcaaaaaaaaaaaaaaaatccggttgcactcataacatatctcagtttgaactaaccacatttcaagtgctcaacagctacatgtggctagtggctactatatattggatagcacaaatctacagatctatagtgatggcccacctctctttcattctctatgttagtaatttgtgtcttctctttattgatcaaccacgatagatatttattaattttattgatcttttcttttctttggagatggagtcttgctctgttgcccatgctggcatgcagttgacgcgatctcggctcactgcaacctccacctcctgggttcaagtgagtttcctgcctcagtctcctgagtagctgggattacaggcacgtgccaccacacccagctaatttttgtatttttgtagagacagggttttaccatgttggccaggctggtcttgaactcctgacctcaagtgatctgcccatttcagcctcccaaagtgctgggattatagacgtgagccaccgtgcccggccttattgatcttgtcaaagaaccagcttttggtctcattgactttctctataggttttctgttgtcaattttattgaattttgctctgtattatttccttccatttgcttggggtttagttttctctttttctagtctgccatagcagaagcttggattatagatttgaaaccttttttaacaaagtcatttaatgctataaaatttcctctaagcaccacttagctacattctacaaattcaataatgactttaatagtgttaataaaaaatctaaaatattaatcaacagggtaatcacatgcacaaagtcaaattcttaccaactgagttttcatcatcttctaggatgtgacttcgctgtctaggacgacctgaagccatcatgaggtcttcatcatcctcatcatcatttataatcccttttgaaaaagaagggatctcaactgcattgtcatttagaaaatcaccagcattactcatatcatc

SEQ ID NO: 6897 - DNA, 312 bp, Homo sapiens
tttctttttctttttttttttttgagacggagtctcactctgtcacccaggctggagtgcagtggcacgatctcggctcactgcaagctccacctcctgggttgacaccattctcctgcctcagcctcctgagtagctgggactacaggcacccgccaccacacccggctaattttttgtattttttagtatagacagggtttcaccgtgttagccaggatggtctcaatctcctgacctcgtgatccgcccgcctcggcctcccaaagtgctgggattacaggcatgagccaccgcgcctggccgaacatc

SEQ ID NO: 6898 - DNA, 140 bp, Homo sapiens
ttttttgtaatttttagtagagatggggtttcaccatgttacccaggatggtctcaatctcctgacctcatgatccacccggctcggcctcccaaagtgctgggattacaggcgtgagcccccgcgcccggcccacaatc

SEQ ID NO: 6899 - DNA, 167 bp, Homo sapiens
tacaggcgcctgccaccacgcctggctaatttttgtatttttagtagagacggggtttcaccgtgttagccaggatggtctcgatctcctgacctcgtgatccacccgcctcggcctcccaaagtgctgggattacaggcgtaagccaccgcgcccggcctgaaatc

SEQ ID NO: 6900 - DNA, 5667 bp, Homo sapiens
agagcgactctgtctcaaaaaaaaaaaaagtgacagagaagcaaagaagctgcaaagaccttcacaataggccttaaatgatatgggattagacaaaggtctgatggaggccaagggcccatacccaggcaagtaccaaggggactcagaggcagccaatgcagcagataggagcagtcccactgggatctggagaccacttgcagtgaggggtgccataagggtgtggattctgtcacctgagtaggtctgcagtgagggtcagcaggaaccaggaaaacctccataactcgatctttcttcaagggcagtggcagcgttagatagcaaaatgggtcaaaggtcacagaaaccttagcacattctgggcaaaccaaagtagatttgaagaggccatggaaagtatccacaatcacagaatcattcctcaacctgtgattctcccaggcttcctttgccaccacctgcgtcaaagggataaacaggacattctcaacacctctcagccccttgcccctgcatccagaatgactcacagcaaacctggagatgaatcaggtggcaatctgtacagccaagagcttgatccaggacaaacaaggccaggactactcttagtgtatcatactcataccacatgccagctctacgcccaatccccaccccaacacacatatatatatttcacatatatgtttatatatatacatatttcaaatatatattatattgattgattgagacatggtcttgctctgtcgctcaggctggcgtgatcatggttcactacagcctcaacctcccggactcaaagcgatcttcctgcctcagactcccaagtagctaggactataggcatgcatcaccatgcctggctaatttttttaggtttggtagggatgggggtcttactatgttgaccagacagttctagagctcctggcctcaagtgatgctcccacctcagcctccaaagtgctggaaccgcaggggaaagccactgcgcctcgccctaatcctcacacttaataaggttggcaacataggacctattggaaactaggggtctgtgtgtcctgataagaaacagaagcccggagaacactatcggtacagagacatggccagggcaaggaaagcccccctatatgtttccagtgatctaaagtaaggtttttggcggggcacggtggctgacgcctgaaatcccagcactttgggaggccgaagcaggcggatcaccagaggtcaggagttcaatatcagcctggccaacatggtgaaaccccctctctactaaaaatacaaaaatttgctgggcatggtggcacgtggctgtagtgccagctacttgagaggctgagacaggagaatcgcttgaacccgggaggtggaggttgcagtgagccaagatcacgtcattgcactccagcctgggcaacagagtgagactccatctcaaaaaaaataaataaataaattttaaaaataaagtttttatctatactacagctcagctaactcatagtttttctaagaagatctaaattttactttaaagcattcatattgattatcccaatgtgatagggtagctgaaatactaaaatcctcttgcactgatcagataatcaaggcaaaaggtataaatgtcctaatgatactaataacaaattaagtaatcatggatggattttattgtgagcaataacaatcttaggggtcctcactataggtactttacagttttcagagtgttcttagtccctagttcaccagtgaaatatcaaacaagctcactctaatttgaaaaagcccaagaggaagccttaggagtaactagggtacagtgcctcacgcctgttgtaatcccagcactttgggaggctgaggtgagaagactgcttgagctcaggagctggagaccagcctagacaacacagcaagtttctgtctctatttaaaaaaaaaaaaaaaaaaagcagtaactacagttagcccctttctgaccagagaccatatccctataactagctacagtgagaagcaaccagggccctggcaacaacactcaaagaccagaagaatatccctgcactctcaataggaggcagcttctttggcatattatcattcagacatcattaatggcataccgcatctggccgcccattggcatccttcagctccaagtagggctttttctttacccggttcagatcttcatgcaatccatctagaagaaaggccagcagctcctgagaatcttgttgctggtagccagaaaattgaggagcaaaacgtcctacttgagtctacaacaaaagcaactgtatcagaaggcataatacgtaaagaactagttaaatcaaaaaagaattgccatcaaaaatagctctgaggagttagctggggcagtgagagagaacacttggttgagtagtccaattaactcctgaagagcctacaggaggccagtggttcccaccagaaagaaggcctagatcagagagccaggaggatgaacctggaacctgggccactgccctaagtcctaaggaggaagggtggagtaccctgagtaaccacacccaagtactgacatgaatccctctccaacatgtccttctttggttcagagtcttaaactccataaggacattacaaacaatactttcatcagctggaggaatcctcctgtacataacagccctcaggtccctaaatactgtctgtccagtaatactctccaccagttattctgagagtatggtccccagtcgcagcattagtatcacctgggagcttagtagaaaagcacattctcaggccccacaccaaacctattcaatcagaaactctggggatgggtctagcagtctgtgttgtattaagcactcccagagattgtgatgcatcctatggagaaccagccaggcacggtggctcatgcctatgatcccagaattttggaaggctgaggcaggcagatcacctgaggttgggagttcaagaccagcctggccaacatggtgaaaccccgtctctactaaaaatacaaaaattagctgggcatggtggtgcacacctgtaatcccagctacgcaggaggctgaggcaggagaatcacttgaacccaggaggcggaggctgcagtgagccgaaattgtgccagtacgctccagcctgggcgacatagcaaggctgtctcaaaaaaaaaaaaaaaaaaaaaaaaaaggagaaccactgttctacacctgttctctaataccatagccactagccacatatggcaattgaaatttacattaattacaattaaaaaccattaaaaattcagttcctcggtcaaatgaaccacatctcaagtgctcagaggtgcttgagctggtagctaccaaaacacagtgcagatatataacacatccatcactgaggaagctccacacttccctaatacccctaaacactaccttccagttgtttatttacattagcttcagcacagtgtgttgccacccaattcttttttatttttttttctgggacagggtctcactctgttgccaggctggagtgcagtggcgcaatctcagctcactgcaacctccgcctcccaggttcaagcaattctcatgccttggcctcccgagttgctgggattacaggcatatgccaccacgcctggctaatttttgtatttttagtagagatggggtttcacaatattggccaggctggtcttgaactcctgacctcaagtgatccacccaccttggcctccccatgggctgggattacaggtgtgaggcaccgcacccagccgttgccacccaattctagtttctttgtgacttagtatgtgaacagtcatttatatatttcccagggattcatgtgaccaaggggatgaaagataattagttttcaatttcaacaaaccacctgagattttagttttctcactgagctaaggtgctattttttttcctctctgaatcataaatatgcatgtcttttcttatcatatgcttcatgaagctccatgaatcccagtggtacaggctaaataggatctttcagatttcagcttaaatctgctgagcgggagggagcaaagcacctccacctcagcaggaaaaagcagttggggcaatggaaagcccaagttgctccgagtgtatccatgtcttctccttaaaccttcctggctgagggaccccagtgataactgcccctcacatcaccttccaagaatgtgagcccaattcctgacttagggggtcccaactcaaaccacgaagcctgtagaatccaggctcagagaacctggaaacagccttcagatgatactagaaattaaactgaattttcattttttttagagacagggtctctgtcgccaaggctgggtacagtggcacaatcacagctcactgcagccttgacctcccaggcttaagtaattctcccacctcagcctccctggtagccgggactacaggtacatcaccatgtccagctaattttgttgttgttgttgttgttgttgttgagacagagtctcactctgtcgctcaggctggagtgcagtggcgtgatctcggctcactgcaccctccacctcccaggttcaagcaattctcctgcctcagcatcctgagtagctggaattacaggtgcgcaccaccacgcctggctaatttttgtatttttggtagagacggggtttcactatgttggtcaggctgatctcgaactcctgacctcgtgatctgcccgcctcagcctcccaaagtgctgggattacaggaatgagccaccacgcctggacttttttgttgttgttgttgttttttctttgagacagagtctcgttctgtcacccaggctggagtgcagaggcgcaatctcggctcactgcaagctctgcctcccgggttcacgccattctccttccccagcctcccgagtagctgggactacaggcgcctgccatcacacctagctaattttttttttatgtatttttagtagagacggggtttcaccatgttagccaggatggtctcaatctcctgaccttgtgatccgcccgcctcagcctcccaaagtgctgggattacaggcgtgagccacagcgcctggcccagatcccatcttaatcccaaaatgcaacgaaaggaatgcctcataacaacactaaaccactctccccaaagtgggaaaaaggaagtacgggagagtatcccttatccaaaaatctgaaatccaaatgcttaaagatccataacctaacactgacatgatattcaaaggaaatgctcactgaaacattttagattttggaatggggatgctgaactagtaagcataatgtaaataccataaaaaaaaatcctaaaaaacctgaagtcccgaaacatttctggtcccaggcatctatatacagggatacccaacccatatatatatatgtctacctactttgaacatgcgaggtgccacatgggcgtcccttccagaccacatctgcttaatgagttcagcataggcttctgcaatttcccctttcatccccagagggttgtctctgttgatttcggcttcatactcatctttgagaaagtagtcagtcagtggtgcagtgttgctcaaacactgaaa

SEQ ID NO: 6901 - DNA, 141 bp, Homo sapiens; identical to SEQ ID NO: 6895

SEQ ID NO: 6902 - DNA, 153 bp, Homo sapiens
caccacgcccggctaattttttgtatttttagtagagacggggtttcaccgtgttagccaggatggtctcgatctcctgaccttgtgatccacccgccttggcctcccaaagtgctgggattacaggtgtgagccacggcgcccggccaaata

SEQ ID NO: 6903 - DNA, 131 bp, Homo sapiens
tttgtgtatttttagtagagacggggtttcaccatgttagccaggatggtctcgatctcctgacctcgtgatccacccacctctgcctcccaaagtgctgggattacaggcgtgagccaccgtgcctggcc

SEQ ID NO: 6904 - DNA, 8247 bp, Homo sapiens
aggtttcttgccttgatgtactggagcaatcagatcacacggcggcttggagagtgagtgcaaggttttatgagtggaattagccctcagcagatgggggagccagaaggcagttggagtgggaaggtgattttcccctggagtcgggctgctgagcagcctgggctctcctctgaccgcccctgccaaactcatggttccatcagttgatggcctgctggtgcctgttggtgtgctttccacgtcctcttgacgtccagcggcttgtgtctctgcccactataaaaaaccactggggtttttttataggcacaggacggggacgtggcgggctcgggaaatgcaacatttgggcaaaaaaacagaaatgcctgtcctcacccaggtccctgggcacaggcctgggtgtggagccctggccagagaccacgccctcctctacccagcacttccctgcccccttccttatcatctggtcccttttctcagacaccacaacttccaagaaggatcactggtcctgaaccctgtgtcttgtccaggtgtggaccccagaaaagttggtcctggctgggcgcagtggctcacgcctgtaatctcagcactttgggaggctgaggtgggtggatcgcttgagctcaggagttcgtgaccagcctgggcaacgtgacaaaaccccatctctactaaaaatacagaaattagctgggtgtggcggctcatgcctgtggtcccagctatgtgggatgctgaggcaggaggatggcttcagccagggaggcggaggttacagtgaaccgcgatcacgccactctcctccagcctgggcaacagagcaggatcttgtctcaaaataaataaaggaaagttggtcctggccctccagcatttctccagggtccttttttcagcagggacctggcggaggcatcgccctcagagtcctctggacctggacctgcacacctatgggagcaggaaggacccttgtgacttccagtggcccccctgggtgccaggtcccacagtagccacagcaggagcagagtgggtggggtataaactcctatcacaggagggaggactagccgggcctggctgggtggacctgtgtctacagccacacatttcctgggaatctggaagcctgctacagagaggccaggtcccactagactgaaagaagttcctgttaatccaaaggcctgacctgaggaccacaggataaactgcgtggttattttggtgccaatcaggcacggggactgttgttcctcactgtgtgcctataagcagggggttcctgggggtagacgcaggagcaagagcacgctctggaaaggtgatgttgtcctctgcacctgagtactgacttgtggagaaggaaggtagcgccggcctctgctctgcttgatcagccctgctgaccactgggttctgtttctaccccagaaaatcactggttcaatggcagttttccacctgccacaagggaagccacacgtggcagggctggggagttacagcatacccccccgccccccactgcctcccagagcacgtccccttcctcctggcccctggcacgtgcttcctccacgcacgtcatggctgactctgccctctcaccttcctttcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggaggtaaggatggggcaggtctggccatagaaccggctttcccagggcacagggattcgggctgtagggccacacccttggtttcaccactaagagctaagtgacctggagcagggggttaagcgtgagcctcagtgtcttcatctcagaatgaagaacagtccgcagcccttcggactcttgtgaagataaaatgaggaaatgaactcgaaggacttagaacggtgcgcggtgtgcggtgcgtgctgagtgcgtgttagctgttgtggtgcggtggtgctgggggctgcagggcgtatctggaagcctctgtgcagcagcttgaattgaaccctcccagcaccctcactgttgccgaagggctcgtcagtcacttggttcctctgtctgttcagtggagctgatgatcgctttcatctcacactcgctgtgcacaaagcctcactgcatcctcaacacagccagcttcacctaggaaggaactgaagcccagagaggttgagccgtttacccaagatcacacagtcctccagacgcccctcaaccctcacagggtaaatgagatcatctgtgtaaacatcgctgcacagacgttagcccccgttcgtgtttttgttctgagaaaggtaggccagcttgcctggagaggagaactacagagtaaagagggtcctggcacggaggaaagccaggacgctgcagcctagtggctttccaattttttcatcacaacctgcagtaagaaatacgttttgtactctgatagagtgtacacactcaggtgtgcaggtacagctaaagtaagttgcagtagccgcccttattacataaaagggggctctacttttccgattcatttctctttttttctccagaggtgggatctcacccatggcacactcttggctcactgcagcctcaaactcttgggctcaaacgatcctcctgcctcagcctcacgaacagctgggaccacaggcacatgccaccacgctcagttcgttttttaattctttgtagagatggtgtctcattaactcccaggctcaagcgatcctccctcccgggcctcccagagtgctgagattgcaggtgtgggccactggcttgacccttttttttttttcaattgcaatccactaagccgatttcccggggtacatgggtcccaaccctcagtttggagagccctgtgtgtgcttcccctccaaggcttgggaccccagaccgcagccacacggacacgttcgatcagtcactgtggcaggtgccagtgcgacaggctctgtgctgggggccgcagctggggaggaggaccactgggtgtgagtcgggcatacagcgtgtccctgccaggagtgtgtgcagagcgaccacagcacaggaaacaggaaaggtggccccgggggttctctgcccagccctttgtctttgatctgctaagactgcccatcagctcatggatttctgtagcgctgctctgtgtggggcctggggacatgaggaggaacaggtcagtccctgcctctgtggagctctcgtgtcatctggctgccgggttcaggagacctgcagaaggaggtctggtccatacctcgtggccaggggcctccaggagaaaggaagggagaataactgggcaccaggaaaatgctctgagggcctgacgttggctgggagagtgtggaaggagggaggaaggagacatttgcagaagcacagagggctggaggagcgccagctgtgcagagaagtggtgggtgtgagtggagcaggcagcggtgctgaggaggctggatggaggaactccaggtggctggatttccgcttctcgtcctgctggtgacaagcaaagcacaggccccctcggcagccctgctttattttcttctgaactttgtcacggtcgaaggaactttcctcctaccctctgtaaatattacacaaacagagggaccatcactccagaccctcaaagctgaatacagtggtggcttgctgtcagaccagggtttgagggggggaactgaggcacagagccggaagcctgtgacttccatcctcgggtgtaacctggagacgggggtttcaccatgttggccaggctggtcttgaacacctgacctcacgggatccacccgcctcggcttcccaaagtgctgtgattacaggcgtgagccaccgtgcccagccgagaccctgtcttaaagaaagaaagaaaaaaatccttcgttggggagcatctgcaagcatgaggaatgggggacactggagccagacaggctggtgcttaggggtcccagggccccgggaacccagcagcaaacagcctcgccctcaggggatgacgtaccatcagccacaggccaccagcacggccctgggcttcagtacctgcgagtctgaatggatttgctcctggggcaaccccaggcccgtgctgctcaggagcgggaggcagggaggagcgtcggcagcccggtctctggggaggctggttcctgctttatccacgcaatacccagtcctattctatcaggaggaccccaagatgggccctaactcccaggccaagagccggtttaggcaccctccccgcttgcctgcagggggcaggcctgagcgcctaaccccagtccagagggctggactcagaccctcctctgtggggcaggggacaggcacgtagggagtactgaattgtgggggtgtgcagatttgggcttcaggcgcacagtgtgagccgacctttctagacagcatccctggtccccaaagactagcgaggccggggacacaggagcagcgatgggaagcaggcccgccggaacctccgactcccacctccccacgccacggacgctgcaccaccctgtgtttttgtttcatgtatttctcaccctgttccccgtgttccgcctggggaaccgagtgccatggacagagcagacacttgggcagaactgaacagcgtcatcttcgcctgcctggcgctccctgcctgggaaatggagcttcagctctgtctcccggcggattcttgatgcttcctacgctgccatgtgctagggaagattaactaaaatcagtcacaatatcccactgggaggtgacgctttttaagacgagcaacagccggccgccaagaggcgggtgaggccccactgagcacttctattgcatctaactggggagccatttatacccaagtagaagcacacgttcactttgtagctcaagcccaactttaattagccatctgtatgaataaatgctgattccaggtccgtttcctctccagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaacatagcaagaccctgtctctacagaaaaacacacacacagaaaaattagccgggcatggtaagaggaggagactgaggtgcccagcggctgcagcccgtgcatccccagggtcccagcacagagtgggtgttcagaagtgtctgctgagggactgagcaagaacccgactgagcacagcaagcaaacgctcagaacgggaggtcagcagcaccgctgtgcccaacacgggtttccaccataacccgaagttggaacgttttattcttccataccaaacaggagttgagaaggcggctgggttccttgaggtgtggaatgtcatgcactcctcctttcttgcgtggaaagcccgaggtataaagtgtgtatgatgtttgcttttttttttttttttttttttaagacagggtctagctcggttgcccaggctggagtgcagtggagtaatcccagctcactgcagcctccaactcctgggctcaagcattcctcccatctcagtctcctgaggagctgggactacaggcgagtgccaccatgcccagctaatttctgtcctttttgtagaaacagggttttgccatattgcccaagctggtctcaaactccggagctcaagcaatcaatcctcccaccttggcctccaaaaatgctgggattacaggcatgagccaccctgcacccaacctgtttgcatttttattttttaactttaagctattaagggttaatgtttgcatttcttaagggaaaaacagaggagaaagagccaaaggaaaaacactgaaatggtagcattcctgggtgatgagtttatggcgttttgtttcctggttgtctataacaaatatgtaatttttaaattagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtcccgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaagacatttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacggtgagtctcacagggcctgctccccctccccactatgcgggtcccatctcctggctgggagaaaggccatccgcccaaaccatctctgagtgccagggaccgggcagcctgcgtccccctccaccccacagtgccagcgtggggcccatgagccgtggtctctgcaccgaggctccagtagcgtacctgcccctgctctgcgcccaccctaaaatgagaaacacggtaatgaggatgaaatataaacgatcgtcaggttcctcacgatcactcagtgaactcctcagagagtcagtgtacgtttgggctggccagacgcagtggctcacccctgtaatcccagcactgtggactgtgggaggccgaggcaggaggatcgttgagcccaggagttcaagaccagtctgggcaacacagtgagaccccatctctacaaaaaaacatggttttgttgttgttgctgttgttgttttgagacgaagtctcgctctgtcgcccaggctggagggcaatggcgcaatctcggctcactgcaagctccacctcccaggttcacaccattctcctgcctcagcctcccaagtagctgggactacaggcgcccgccaccacgcccggctaatttttttgtatttttagtagagacggggtttcaccgtgttagccaggatggtctcgatctcctgacctcgtgatcctcccgcctcggcctcccaaagtgctgggattacaggcgtgagccaccgcgcccggccaaaaaaaacatgttttttaagcatgaagtttgggttgcacctcagtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtggttttttttttttttttttggaga

SEQ ID NO: 6905 - DNA, 83 bp, Homo sapiens
aaggtgatgaggggcctctccatctgcaccacctgcctcctgagcatgctccaggccattaccatcagcctcagcacctcctg

SEQ ID NO: 6906 - DNA, 354 bp, Homo sapiens
gttgagtctaagaagtttgtttataacactggagtaacttcctgcttccatgcaggtagctctcagtcactgctgagtaatttaagatggaaaactcagtgagtttactcaagagaaaacatctccatgttagatcaggttgcacaaaaaaaagctttattgactcactggactctaaactccatgttcattgttttgatgaacaggaccacaccccgaggttggcctggagaaggtaaagaaatcggatctagaaagagccaagggaaggcagattggacccaaagttaacacctacgaccaggagactctggagaaaaatgaaagtgctgcctcataaagggtcaacgagaa

SEQ ID NO: 6907 - DNA, 149 bp, Homo sapiens
gatagcattgggagatatacctaatgctaggtgacgagttagtgggtgcagcgcaccagcatggcacatgcatagatatgtaactaacctgcacattgtgcacatgtaccctaaaacttaaagtataataataataaattttaaaaaaa

SEQ ID NO: 6908 - DNA, 83 bp, Homo sapiens; identical to SEQ ID NO: 6905

SEQ ID NO: 6909 - DNA, 636 bp, Homo sapiens
ataactattcttgttttatattttattatagtggaacagctcgtgtcctcggtctcttgcctcggtgcctgggtggcttgccgcccacagctaacacggtgaaaccccgtctctactaaaaatacaaaaaattagacaggcgtggtggcaggcgcctgtagtcccagctacttgggaggccgaggcaggagaatggcatgaacctgggaggcagagcttgcagtgagccaagatcacgtcactgcactccagcctgggagacagagcaagactccgtctcaaaaaaaaaaaaaaagagattcatcatctaatatacactctttatattaaatgctgcaaataacagtttgatactaatggcagttaaaatcattgtgtgcggaaacagaaagttaaccaaaaaagaagagtcaattcctcagatgtgtaaaatactgaactagaagctttagaattacaaagagaaaatagcgtcagagatgagctttgatctcaaggatcagttgggaaacattaaagaggcacctcacagtactatactttccacagtaagcgccaaatgaatgctacagacaatgagtagagcaggaacatcaaaagagattattcatagtcagaaatcagggttttttgttt

SEQ ID NO: 6910 - DNA, 101 bp, Homo sapiens
cctgtaatcccagctacttgggaggctgaggcaggagaattgcttgaatccgggaggcagaggttgcagtgagccaagatcgcgccactgcactccagcct

SEQ ID NO: 6911 - DNA, 461 bp, Homo sapiens
aagccagacacaaaagatcacatattgtatgattccatttatacggaatgtccacaataggcaaattatctgtagagtcagaaggtagattaatggttgcctagcgctgggggaggaggctgagggaaaacaggaagtgactgttcatggatatggagtttctttagggtgatgaaaatgttcaggaattactggtcatgactgcacagctctgtgaatatactaaaaacaactgagttgtaaggtgtgtgaattttatcccaataacgctgtttaaaaaaacagaagcatgggctgggtgcggtggctcccacctgtaatcctggcactttgggaggccaaggtgggcggatcacgaggtcagagatcgagaccatcctggctaacacagtgaaagcccgtctctactaaaaaatacaaaaaattagctgggtgtggtggtgggcacctgtagtcccagc

SEQ ID NO: 6912 - DNA, 101 bp, Homo sapiens
acacctgtaatcccagcactttgggaggccgaggcaggtggatcaccagaggtcaggagtttgagaccagcctggccaacatgatgaaaccccgtctctac

SEQ ID NO: 6913 - DNA, 222 bp, Homo sapiens
gccagagctcacaaatagttggaactgccctaaggatgccattttgttcttaaatataactagcaaatattactcaaagctgtgcacgatccccaaaccctggtccccaataatttgaataatctgaatatgcaagttaaggtattgagatgggaaccctcctgtgtggtatatcttgctcttatcctttgtgaagccaataaacttcaatttctactctca

SEQ ID NO: 6914 - DNA, 374 bp, Homo sapiens
gaaagcttaaatgctgacatgttacaaagtagttttgttgatagctagcaagaagcacacattttctttattctgttgaatcttcatttggatttacagttctgggcagatttggaaacggggatggtggcggcattgtttccgaaaaccagcgcatccgtgcaaagaatttaattccctcaccatcttgctactggtctgttgcagtggggtgtggttagagggctaggaagcaatccaaaacagcagctcaggctgcccaaagccgtgtccaagcgatcattttctccattttgggccaagtcaatttgcaccggcaagaggcagaatgtttgttttatggggaggaggaaaataaaaaaggaagtcagaga

SEQ ID NO: 6915 - DNA, 100 bp, Homo sapiens
ctctactaaaaatacaaaaaattagccaggcatggtggggggcgcctgtaatcccagctactcgggaggctgaggcaggagaatggtgtgaacccaggag

SEQ ID NO: 6916 - DNA, 159 bp, Homo sapiens
ttttttttttttttgatatggaatcttgctctgtcgcccaggctggagtgcagtggcgcgatctcagctcactgcaacctctgcctccagggttcaagtcattctgctgcctcagcctcccgagtagctgggattacaggtatatgccaccacgcccag

SEQ ID NO: 6917 - DNA, 159 bp, Homo sapiens; identical to SEQ ID NO: 6916

SEQ ID NO: 6918 - DNA, 6041 bp, Homo sapiens
gagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccatttaactgctcattgactcttactgtagatgaggaggtggccagcagcccctgccctcccccagttggtaggcccaaggtaaccagcaattgactggatataatggaagagtggtgcattcggaagtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtaaaatgccaataaaacaattgcctatataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacatttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccgtttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcagaaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgcactgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagaagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtgctaaaaattctgatggctcatcccatttaggggctgaaagttgcagaggtttaggaagctcacccacgatactggagcccccatctcctgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcaactcctataatattgaaatgcataggttagcatttttggccaatttactcagcattctgggttaaaggcttttatttattttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggtgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcttttactaattattgtttacatttgaagtgttttatgaatgaatatttaattgcatagatgaagattactagttataggcattttactaaccaatactcattaagcatagcgtggattcatatgacatcaaggagctattttatttggtaaaatgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttggaagtacctatctatattaaaattccaataacctgggaatttcatcccatgtcaagagtcttttatgtaaaatatttccacaattaggagaaatatgtgcatggggattttctatgtagcggtgttttgatagaacagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgtccgccttagtgatttcacatgtggctaaattgagctaatgacaagctgttcgaagtatggcaaaatggaactttaaaacagtatcttgtcaacaaccaagaggacctttttcacataaagcccacgcattcatctgcctgtccatcattctgtctgtccacacgggcatcattcgttagtggaactgagtgcccactgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccactttgacctcctctccaagacaaaacaaacaaaattagcattttaaaacttagttgtaatctttcttccttcatgaaaatttctccaacagccactcccacggtcctgtgtgttccggatattttaaaataatggctataaggttgagcacttcaggatacgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggactctctacatatctacattgtttgcagattttacaataatcatttattcttgcatggctgatcattgttaaccaatacaaataaaataataaagaaatgacccacatttta

SEQ ID NO: 6919 - DNA, 656 bp, Homo sapiens
ttccatttatgcagccaacagacacgtgaaaaaatgctcatcatcactggccatcagagaaatgcaaatcaaaaccactatgagataccatctgacacctgttagaatggcaatcattcaaaagtcaggaaacaacaggtgctggagaggatgtggagaaataggaacacttttatactgttggtgggagtgtaaactagttcaaccattgtggaagacagtatggcgattcctcaaggatctagaactagaaataccatttgaaccagccatcctattactgggtatatacccaaaggatcataaatcatgctactgtaaagacacacacacatgtatgtttattgcagcactattcacaatagcaaagacttggaatcaacccaaatgtccatcagtgatagactggattaagaaaatgtggcacatatacaccatggaatactatgcagccataaaaaaggatgagttcatgtcctttgtagaaacatggatggagctggaaaccatcattctgagcaaactatcacaaggacagaaaaccaaacaccgcatgttctcactcataggtgggaattgaacaatgagaacacttggacacagggtggggaacatcacacactggggcctgtcctggggtcggggaaggggggagg

SEQ ID NO: 6920 - DNA, 413 bp, Homo sapiens
tagggaggtagcaccgcatggaagctgaaaacagtgacagagaaaactacccagaccaggcgttgtccttgatcccttcaggaacatcactgggcaatgtgaggcacagagagagctagaaagtgtttgggggctgatttgtttttcctgagacgaggtctcgctctgtgacccacgccgaagtgcagtggagccaacatggctcactgcaacctcgaccgcctgggcccaagcgatcctccttcctcaacctcctaaagtgctgggattacaggcatgagccactgcagccagcttggtggctgatttttaaaaatttattggctagttgatggatttgtctgtatatgctatatgttctctatattatctgtcacacttccaaagtataccagctcattctctcccttcac

SEQ ID NO: 6921 - DNA, 1829 bp, Homo sapiens
taacatttcgacctgttaaataaaatgggaagccacacttcataccaataaaagtagatactgaataaattaaaagtttgatgagaaacaggatatttacacagtttcaaagtactctcccacaaaatacatattattaattaccattattacatacatgtgatacaggttcattctgcccgcatgccataaatccatcactgtgacaggttttgtaaaagagaaaagatttattcgcaaggcagcccagtgaggaggcaggagaacagctctcaaatcttcctccccaaagataagtcttagggatatttaccggtgagagaagcagggtggtgtaaggtatgggcaaaggtgattggcagtgggggaaaatgaggcagtcggtgaccactgcaagcatagtcagggttcgtggcacttcacagggcacatgttcaaaaaatgacagccttagcgtgatctgagggtgtcgcttggggcctctgatgtcaaaaggccacttcttttgtttgcacaagcctacttgaaagctcacggtctcaactggtttgaactaggcaggagctgccccaagttcctgaaaaacaatttgaacgatcatgacagtagtgacatacatgttatctgtaaggaagccggcaaggttaagttacagcgctcagtggcgcggccttcagcttcacagaaaaaaaataacaaaagcaagtgacccaaagcaagcagggcaggctaaattgggcagacctaatcagatgaaccccatggtctcatatgtaatattacattataactataaagaatgtaattaatgtaaatattcggtacaagaaagtcatcagtgcggggaacactggaattgcgtgccaccagaggacagagtggagccagcgcggtatcacttctgtgctgttcccatcgaaggtcagtaaccggaaccccttcgccaggacgcgggtcctggccaacccaaatcgaggggcattctgcagatcagctggtctgccatcttcaaacgattcatgaaaatcaaagacagctttgaggaacggctccagactggcagagaccaaagaggtcatagatgaacaggagatccccaactggatcctttggctgtaaaggacaatattggcacaacgggtgaagcttgaatggggtctgaggattaggtggtagtaacttcacaggcggggatttgggagaaatgcaatgtcacgtggaaaactgactctcaaatagttcaagaaggaagttctttggactatacttgcaacttttctgtaggcttaatactgtttcacaattttaaaatgtaaaataatagtaccaggtagtagttttttattaagacagattgtgctttttgaaagcattggtggaaagatttctcaaaatcatgcgcgaaagagtttataatgaaattgtgtaatatttgtttcaaaagaaagtgtgggccctgagaagcattttctgtagtttacacagtatttctgccaatttgggatactttcagtgtccctggaattctcatcatctgaatttcttactctttttccctttaaaaaaaaataaaataaagaagtatgaggcaaaaggccacacctacctacctcactttaaaattctgtctaaaaacctggtcacagaggaagatgttggctaactttaatgcgataatctagttcccctcaaaatggaaagctatttagaaaaaagctatttgcccaacgtgaggaacaatttatagaaactgacaagaatttttgtcctggggaaaggacagggtttgttgcatgggataaggggaagtgatgtggccgggcatgatg

SEQ ID NO: 6922 - DNA, 300 bp, Homo sapiens
ttgttggggtttatgttactgaagaatgaacagagatgagtaagtggaggtgttatgtaaaggcatactgtactcaaaatctgaagacctgcagcagatttaaattccagctcttattataactttttaaaagattgtgaaaatatcaaaatatagatgaatcaagttttaatatactgtatgatgggtggatgaggctgtccattgtaccatttgtttgaattctcaggcatggtttggcagtgcaagaactctgtaacgttaacaaattcaataaaaagtaaatatatggaaaaaaaa

SEQ ID NO: 6923 - DNA, 168 bp, Homo sapiens
tatatatatatatatatttattatactttaagttctagagtacatgtgcacaatgtgcaggtttgttacatatgtatacatgtgccatgttggtgtgctgcacccattaactcgtcatttacattaggtacatctcctaaagctatccctccccctccccacacccca

SEQ ID NO: 6924 - DNA, 83 bp, Homo sapiens
aaggtgatgaggggcctctccatctgcaccacctgcctcctgagcatgttccaggccattaccatcagccccagcacctcctg

SEQ ID NO: 6925 - DNA, 83 bp, Homo sapiens; identical to SEQ ID NO: 6924

SEQ ID NO: 6926 - DNA, 279 bp, Homo sapiens
caaatcacatgtgaggcatccaagaaatccctttgaattaggtttgatcaaagtggaaggcattatttaaagcagagcctgccccgcaagagtggttaacctgaatggtttagacaggaggttgacaaactttatctgtaaaacaccagagtaaacactttaggttttatctgccatagtcccaactactcaactttgtccttgtaatcaaaagcagccacagagagtttgcaaatgagtgggtgtggccatattccaatacaattttatttacaaaaa

SEQ ID NO: 6927 - DNA, 471 bp, Homo sapiens
ctacaaaacccatagtctttgcactacaacacaagcaaagacgagtcctctgccaacccacatggcagcttggtgcaaattggaaatggggccttttctgcccagggacctcagggcacagagcctggcaactcagtcaatggccagtttctgccctcgactaacccccttggctgggcccctcatgaaaggccttgcaccactgcacaccctcgccctgttcacagaggtagcaaagcacctgcacgtagtcactggtgtgtttccaggttcccctggcatgagacacacacctatgaaatggcaactgtgatcagaggcatagcgagggtcctggagcagagtaaatctaaacatcttcaaaggagctgagccatgatgttggtctcactgagaaaagtggaaggaggaacatttagttttatcctgtggggctgatacccaaaacctgtcatgtacagactattccgt

SEQ ID NO: 6928 - DNA, 232 bp, Homo sapiens
cgggtgtggtggctcacacctgtaatcccaacactttgggaggccgaggcgggcggatcacgaggtcaggagattgagaccgtcctggctaacacggtgaaaccccgtctctaataaaaaatacaaaaaattagccgggcatggtggtgggtgcctgtagtcccagctactcgggaggctgaggcaggagaatggcatgaacccgggaggcggagcttgcagtgagcagaga

SEQ ID NO: 6929 - DNA, 6150 bp, Homo sapiens
aaagtagagaaaacagtgtaatgaaccactacatattcatcaccctgcttcaaaaatactcaacatttaggcctggtgcggtggctcaagcctgtaatcccagcactttgagaggccgaggcaggcggatcacctgaggtcaagagtttgagacaagcctggccaacatggtgaaaccccatctctactaaaaatacaaaaactagccaggcgtggtggccggcacctgtaatcccagctacttgggaggctgaggcaggagaattgcttgaacccaggaggcggaggttgcagcgagccgagatcctgccattgcactccagcctgggtgacaagagcaagactctgtctcaaacattttgtcagcctttttcatctatctgccccctcctctttttttgcactagagctgggattggcaaactgtaaccccatagaccacatccaacctgctgcctgtgttttaaaaattgagatataattaatataacacatcataaaactcactctcttaaaatatacaattcagtggtttttagcattttacaacattgtgcaaccatcaccattatctaattccagggcattatcatcaccccagaagaaaccccacacccattagcagtcactcattctccccttccaccagccccgggcaaccactaatcaactttgtctctctggctttatctactctggatatttcatgtaaatggaattatacaatatgtggcttttggtgtctggcttctttcacttagcttaatgttttcaaggttcatctatgttgtagaatgcaccagtactttgttccttttcatggttgaccatttcacattttgtttgttcattcatcagttggacagttgggttgtttccacatacattttcaattctactgggtatgcacctaggagtggaattgctaggtcatatggtgactattgtttagctttttgaggaactgccaaactatttcccaaagtggccacaccactttacatttccatcagcaatgtataagggttccggtttctccaaattcttgtcaatatttgttattgtttatctttttgattctatccatcttagtggatgtgaaatggcatctcattgtgtttatttgcatttccctaatgactaaagaggctgagcatcttttcatgtgcttattggtcatatgtataccttctttggagaaatgcctattcaaatcttttgtccagttttcaattgggttattattatttttgaggcagagtctcgctctgttgcccatgctggagtgcagtggtgggttcttggctcactgcaacctccacctcctgggttcaagtgattctcgtgtgtagtctccagagtagctgggattacaggtgtaccccagcaagcccagctaatttttgtattttaagtagatacagggtttcgccatgttggcctggctggtcttgaactctacccaggcctcccaaagtgctgggattaccggtgtgagctaccgtgcctagcctatttttttcaactattaagttgtaagaattctttatatgttctggatactagactcttttcagataagtgatatgcaaatatttccttccatcctatgggctgtgttttcactttctatcttgaaatagtcctttaaagcacaaagtttcaaattttaattattttttctttcattgcttgtgctttaggtggcatatctaagaaaccattgcctaatccaagatcatgaagatttacatgtgttttcttatgagttttatattttagctcttacaattagttcttatgcatctgaatttttaaaaaacttatgtacttctaaggtacaactaattttagaaagtaagagtgagtagattttgatggcctccaagagtttagaaaaaggtatgagctttgatgcacaattttacccaacatatatatgttggatgattggaactttttttggtctactttagggttttttgctcttttgcagcagacagctgggttgtccagagagctgattctggaaaggtgtatattactatttaggtaaatggtcagcttctagtatcagcaaaataaaatactccaaacatgtttaggaggagccccttacagtcccaagtttaaaaacacagactgttattttaagacattttctatgtatagagccccacagttctaacacaggtatttggaaatgtagagaaaaggaagcaaaaatcagcagctgggacttagtttccaaccaagggaggatggcatggatggctgcacttctttcatttgcagacataaccacaaaccatcagttgctggttgacagtttgttctggagatgtgaggccagtggttcttaaacttgagcgagcattagaatcacctggagagtttataaaaacccagattcctgacccccatctgcagagattctgctacaggaggctggggtggggccattaatttgcatttctaataggcttccagatgctgctggccctaagaccacactctgagtagcactactttagatacatgggccaaccatctcgccctggtgcttaccaaacattgaccaagcaaacatgaagctaggtgactctccttggggatgaatatgataataatctactgagaaattcaagaggctgtaagtatcccaatttcattaaaatttctaaccattggtgatgtcatttcaggttccaggcttatgctctttttcttcttcttttttcttttttttttaatttttttatttttgagacagttttgctctgtcacctaggctggagtgcagtggggcaatatgagctcactgcttcctctgcctcccgggttcaaatgattatcctgcctcagcctcccagatagctgggattacgggcacatgccaccacacctggctaacttttgtatttttagtagagacagagtttcgccatgttagccaggctggtctcgaactcctgacctcagatgatacacccacctcagcctcccaacgtgctgggattacaggtgtgagccactgcgcccagctggcttatgctctttttctaaaaatttgtccacttaggaaagtgtcttgatttcaataaaattagcatggattaaattactttttttcttttttttttttcttttggtatttgatcttgctcgatgaatgtggacatcagctatgggttaggaatgctattcaggaacatctaatgtgtttgtgataatgtatttgacttgtggccaaatggtactcttgagagatgtggttgtgactttgacagattaagccaaagttaaattctgatgaagtgcaaaggaattttatcggtcccaggatggttgccaactgtgttgggcaaaagagtgattttccaaaaaggtccagagcaatccgcatgtattctgtcacctctacttccagtttcttcaaaggccagccaaaagcttcattttcctacttcctgtcatttccaaaaccacagcttaaacctgaaaaacaaatgggaagctgtgttcctgcctcttatgattgctgccacttacaaaccagcaagaacagagcacagcaagcagaggagagttcagtcttgctgatgtcacatgaagcagaatgaggactctgcttgtttggctcctgagtttaaaagataagtagacaatttattgttggtaggttgagaaaattcaagaacagagagaaatctgacagtctggccataagaagaaatttttgcatttatgttcttatagccatacctgaagtcaactaattacgtttggagagaagtagaatgcttgctttaagaagaaaaaacaggctagggcgcggtggcacacacctgtaatcccagcactttgggaggccgaggcgggcagatcatgaggtcaggagatcaagaccatcctggctagcatggtgaaaccctgtctctactaaaaatacaaaaaattagccgggcgtggtggtgggcacctgtggtcccagctgctcgggtggctgaggcaggaaaatggcatgaacccgggaggcagaggttgcagtgagccgaggtcgcgccactgcactccagcctgggtgacagagcgagactctgtctcaaaaaaaaaaaaaaaaaaagaaaagaaaaaacaaatgttctatgttgaccctatccccaacacccttgcagcaggtctattgtaccttaagctgtgctctaacttcattagcaggctctaggcctctctcccagagatcacccatgggagggatccagcttccttcactcagcagctcttacactgctcccaggaggaaggaagcattttgttttaaagagactgcaacacaacccaaaggaaagacagttatcttagtgtccatatgtccacaagaggaaaatgtgggtgtagcattttaatcccagtaagtgacaattagtcactaggcttctaagaagtttgacactgttattcctctcccccttttctaaattgcaagggtaatactgcatttgcacagaaaccatgctaactggctagctacttcattaaattaccatatgattcttattttatgggtacaaaacagttgatctcagtgaaccggcaacttagaaacttaggaggcaaattagagcaattactaataaattatacatgtggtaactaacaatttgtctatcacctagaaatatgagaaaaaactgccagactccctggctctgcaattctgaacaagtcttttcatttttttcttttccaagaccaaaagctgtcattatccacaccagttataccattactcttgctgctttcacagagtccaacatttataatacaaagttaggagtacaacgagtgggatttgcattctgtttggaacagagtgtttgactgcttaaaattaaagaactaaaaaaaaaaaaaaaaaaaaattcccagaacctcaaatcaccccctaaaaaccaggaagtgagattcatgttagctttccctaagtaagtttatggaagagataatggcaagaggtaggggcaaagtatctgttcattcataatcactactgtgcttcgtttctgggcaaggtagtctgatgaaattaaaggaagttctgtgttacaagtcatgtgcttttatgggggaggaggtgagatgaggtcaattaacaagatatgatctttctcttctctccctgcttgtctcacccaggcctcgggtgtgccattcaacatgaaaggtgttgatgccattcattaattgagggtcagattcctctatcagcatattcctcccatctgagactgccttacctccatccacttccacccccaacaggtttcattttctgcagctgctgtcaagagctacgtggaggaagagagtggttttaacaactgcatgctcaaatttattctcactggcctcttgtttgaaggaagtccaatgtctagaccctggatgttgaaacaggatgtaaaaaaaacaccaaaaaaaccctgtatatttgagagagttttgaaacccatcccaaatacactccagcaatggagaaaaatttgattttggcataatttatataccacatttctccccgtacccaacaaaagtgtatgctaatgtctctatatcacatgatatatcagtttaaaatattctttctctttgcctttgttcgtagtctcatttccacttttacttaaaattttaatatcttctccccaggttctttatttatttttgctatatgcctgaatataagacctaattccatgtcaccaatatctcccttgagaagcactgatgttaagtagaataaaatgtaatcaacactcattgtttcctaccaggacaacagtagggtttaaaacaaaaccaacctcgttatgaattccaaacgcccttctaaataactctgggtgccatttcacaacctgacctgcatagttcctttaggctgctgtgggagttgtgactatcctgtgtccacgtttgcatgctaggttgcactaacccagtaaacacattctgtatcagcctgcagtttgtggaggtccgagcacaacgcatggaattccacctctctggggttcctgccaggtggagcaatccagaagtatagcttccacctgtaggggaggcgcctgcaaacctggcagctct

SEQ ID NO: 6930 - DNA, 114 bp, Homo sapiens
ttttttgtatttttagtagagatggggtttcaccgtgtcagccaggatggtctcgatctcctgacttcatgatctgcccgccttggcctcccaaagtgctgggattacaggcgt

SEQ ID NO: 6931 - DNA, 327 bp, Homo sapiens
tttgcagtagtgtgtcttattttcagtctatatgaaaacctacaacagtaacttaaatattgtagaacatgtattaaggtattaaggtttttcccagctgacttaataagttaatttgaattaatggtgtatgattttgaatacaagttcgaagaccttgggtgctgtgtgtgatgtcattgagctggctgtgaaagatgtgagacaatgagtgtcttcttgtatcgcatggtaagaccataaccgtattgtaacactccaccacgggcctcctctcaggggaaagggggattacttcaggttgggccaccgctctgacgtgcacgt

SEQ ID NO: 6932 - DNA, 413 bp, Homo sapiens; identical to SEQ ID NO: 6920

SEQ ID NO: 6933 - DNA, 232 bp, Homo sapiens
tttttattttattttatttttttgagacagagtctcgctctgtcacccaggctggagtgcagtggcaccatctcggctcactgcaacctccacctcctgggttcaatcgattcccctgcctcagcctcccgagtagctgggattacaggggcctgccaccacacctggctaatttttgcatttttagtagagatggggtttcaccatgttggccaggctggtctcgaactcc

SEQ ID NO: 6934 - DNA, 327 bp, Homo sapiens
tttgcagtagtgtgtcttattttcagtctatatgaaaacctacaacagtaacttaaatattgtagaacatgtattaagatattaaggtttttcccagctgacttaataagttaatttgaattaatggtgtatgattttgaatacaagttcgaagaccttgggtgctgtgtgtgatgtcattgagctggctgtgaaagatgtgagacaatgagtgtcttcttgtatcgcatggtaagaccataaccgtattgtaacactccaccacgggcctcctctcaggggaaagggggattacttcaggttgggccaccgctctgacgtgcacgt

SEQ ID NO: 6935 - DNA, 84 bp, Homo sapiens
ggtggccggtgcttgtaatcccagctacttgggaggctgaggcaggagaatcgcttgaacccgggaggcggaggttgcagtgag

SEQ ID NO: 6936 - DNA, 510 bp, Homo sapiens
cccacctggttctgtttgctagcgtttactcttatttcaagtgtctttttgggatttttcaaccttggacgtttccatgtcctgcactgtgaagagaccctatagcagctttcctagcaattgtcagcacaccaactgcacccttcccctggaggaaacaggccaccttgccaggctcctgaggccccattcccaagaaggcaggtcaggttaaactagcagcgaccctaggcccttttctctgggtgccagaggtcattttcttttgagctgagggataatcaggctaaccaaaacagtccaggttaagccctgcccaatccaactggcaaaggtgctgggagtaaagagaaacaccctggaatttgagcaaagtcagatctaaggggccatgggaggctgacagcttggtttttggtcctgggaagtacagcagcctggctgggcccagtggggaggagctcctggccagcagccaggaccagcactgggaggctgggcgccaccctg

SEQ ID NO: 6937 - DNA, 5131 bp, Homo sapiens
atgaagaactgtgaaccatttgtatccttccctctgttggccattgacaagagaaattctttgttgtgtttaacagcgaaactctcgtctatagagaagtaaagttttcagttacattatagatataacctccaaaaaaatttcatcttcacttctattcatatctgatgtattatttagtgccacacacaacttacttagataataaagttaggttatgaaagaagagaatcaaatatgaatcaatttcccctctcatctttttttttgagatggagtctcgctctgttgcccaggctggagtgcagtggcccaatctcggctcactgttaagctccacctcctgggttcacgccattctcctgcctcagcctcctgagtagctgggactacaggcgcccatcaccacgcccagctaatttttgtatttttagtagagacggcatttcaccgtgttagccaggatggtctcaatttcctgacatcgtgatccgcccgcctcggcctcccaaagtgctgggattacaggcatgagccaccgtgcccagcctcccctctcatctttttaagattcaaatattattaattttctattatttgcttataaaacccaaatattatctcaatccccttcctttccatttatatttgtccttcacaatttttggaaaagataacaccactttatttaaataaaaaaatgaaactatctttaaaaagcaagaaacagctgagcacagtagtgtggctgtagtcctagctactcagcaggttgaagcaggaggatcactggagctcaggagcttgaacctaaagtgcactatgatcacacccatgaaaagccactgcattccagcccgggcaacacagtgagatcccatctcttaaaaaaaagagtgagacagtccagattagattcttttacatttcatctgtttcatttctgagcacacagagtattatttagtctggactcattaacttaacctctgccatagcatcacttaccgcaaaaggaggaatttgttttccaatcttgggttagaatattaagaacaaatcatgtagaatgggaaacaaaatgctactaaatgttaaaagtgaaggatgaaaaatattaaattatttccacattaaatatgcttatagaccattttccaaatggtcttcacatcaacaaaaaaattccagcaagaaaacttaaatttttggaaaatattatagtcaaattttagaatatcaaagattttttaaaaatgttcatagaaaaaatgacctaaaatttggatgttgtaagaaatattgctgaatctcctttaataaaagttaagattgacctacggaagttcctattctatcattaaaattctaagaattaagtacagatcattgaaaccctttcaaatcatgttgtaaaaatgtcctaagaagaaaaaatacccatctgtataaaaagcaattttttttaccagaaaattaaccttcagattagttgaaggcagctagacattagtataccctttaatgaataatgttattgattccatagagaataaaatagaataaaagacaaaatatttaaaacataatataaatgtaaacatttttaccttcaaaaaatcctccatagatagattcccctcctcgtccatttcctaaaaatgaaaaacatactcttataactctcagtaagctcctcaaaggtgatacctaaacacaatacttcttgtaaagtagatttttgaataattttgaattaacaatattcgaagattgcagcaaatcataaaagatattaatgtcaataacgacaaggtcccaaattactttctttcccctatgctatgatagcaagaatgtgacgaagactattaaaatatattttaaaaaagaactttcagattctaattatgattatgcaggtcttgcaacaggttaacattttttcaaagttttttaaaactatagttttgatatttttacaataaaaaagtaaaaatttttattgtagtaaggattaccacttgtgacaaaatcaaacagaaacacttgacagattactgagatgaatgcagtgttgttttgtatccagaagcctatttctgaaattcatgtgtcaaaggcaaaattattttctatgagcttccttcttttttttttttttttttttttttttgagacagagtcttgctctgtcattcaggccggagtgcagtggcacaatctcagctcaccgcaacttccacctttcgggttcaagccattctcctgcctcagcctctcaagtagctgggactacagccacgtgccatcatgcccagcaaatttttctatttttagtagaggcagggtttcaccatgttggccaggctggtctcgaactactgacctcgtgatccgcccacctcggcctcccaaagtgctgggattacaggcgtgagccaccgcacccagcctatgagcttccttcttttacatatttctatgagtacttctaattgaccaaagattaaatggagtgagagtgacaagaatattggactaaaacttctagggacttgtctaactttgagatctgtgatatttaacagaaaataatacatgatttttccaagtctcaccttcactgaagtcaccaccttgaaccataaaatccttgacaactctgtgaaagagacaactcttataatgtaatggtttctgagttgatttcccggtccccttttcacctatagagataaaaaaataggacatttaatagaaaggaaatcaaagtagtatgaaagcaaaataaatgtaaaatatgcccctcttgaaccctgcagacttaaaatcatattttcattcctttcaggaatttttttttaaaaattcatttaaaaaatcacccacgttatttctggagaatgtagaaatcactctcaaataatatacctttacaactaatgtttggttttaggtttttttttgagacagagtctagctctgtcacccaggctacagtgcggtggcacgatcttggctcactgcaacctccgcctcctgggttcaagtgattctcctgcctcagcctcctgagtggctgggattacaggcacctgtcaccacacccggctaatttttttttttagtagagactgaatttcaccatgttggccaggctggtctcaaaattcctgacctcaagtgatccacccacctcggcctcccaaactgctgggattacaggcatgggccaccacacttggcctctatttttttaattgagacaggatctcactcttgtcgcccaggctggagtgcagtggagtgatcttggctcactgccacctccgcctcctgggctcaagcgaatctcccgcctcatcctccagagtagctgggactacaggcacacaccaccatacccagctgattttttgttatttatttttttgagacagagtttcactcttgttgcccaggctggagagcaatggtgcgatcttggctcactgcaacctccatctagggttcaagtgattctcctgtctgagcctcccgagtagctgggattacaggcacccactaccacgcctggctaatttttattttttcagtagagatgaggtttcactatgtttgccaggctggtctcaagctcctgacatcaggtgatctgcctgccttggccttccaaagtgctggggttacaggcgtgagccaccacgcctggccgattatttgcatttttagtagagatggggtttcaccatgttggacaggattgtcttgaactactgacctcaagtgatccacccacctcggccccccaaagtgctgggattacaggtgtgagccaccatgcccagccacaccgtgcccagccataatatttctttctttttttttttttagatggagtctcgctcttctagctcaggctggagtgcaatggcacgatctcggctcaccgcaacctctgcctctcgggttcaagtgattctccttcctcagcctcccaaatagctgggactacaggcgtgcgccaccacatttggctaatttttgtatttttagtagagatggggtttcaccatcttggccaggctcgtctggaactcctgacctcgtgagccacccccctcggcctcccagagtgctgggattacagacatgagccactgcgcctggctgcccagccataatatttctaagaattactttcacgccctagtcactgctgtgtaatcttcatgttaagagaaaagtaatatgcatggagaaatctaaaatagagtaaataaaaaattaaagcaagctatgccaggtgtggtagctcacacctgtatcccagctgaggacgcttatgtgtaaggattgatgagcccaggagttctagtccagttggacaacgttgcaagatcctgtctcaaaaaaaaaaaaaaaaaaaaaaaaacccaggcaagcaagcaagccagccatagtcaactgagactactattagggcagttgaaaatgtgaacaaacctgtacaaagacaacgaaagttctcgcatgttttggggcacacatcagaaaataattcaaagacaactcttccagctgaaaaagaaggtagttggttaaacttctttactaatttaaaatattaaacacccatttataaatgtcaactaatattcttaccaggttgattgttaatggcaatgtcaaaaaaacatcgaggacgttgaacctttattcccatggctccaatacttaatctgtgagtaaaatacagtttcagacaagcagactaaaatagcaaagatctttcacaaatttctggaaaaaaaattctgtgaaacaatattagaaatatagtttgaatttattttgatatttatttctatgaggtaaatcacatggattattagtgctttctttttagagattagattgcattttgtgaagcaattagaaaagacttgaaagttaagccttaaccattattatgtaatcaactttctatttatcaaccggaatacagattaatagctcaaacagaaaattgtatttactctgtatgattagtgaactcaataagcagattaccttcaaatgaagaaaagaccaaaaaaaaacaaggacaactgatccctgtgctcct

SEQ ID NO: 6938 - DNA, 554 bp, Homo sapiens
aataagaatgatctctataaactgttatggagtattttaaggatatactgttaagtgaagagtgaaacagtatacatggtatgccatctacggtgtaagaaagggaaagtgagaaaatgtatacatgtatttgcttatgtttacaaacagaaatacaggaagataaactggaaattaggttggttattaacatgtatagatggaactggggtgaaaaaaaaaaggaaatgggaatggagtggaagggttgggtgggagagacacttcacagtattctttttgttttgactttggaaatgttactatttcataaacttaaaaaaatgcaaaaaaaaaatatcaaaactaggtaggaaggagaacaaaatgaaatataaccagaaaggaataaacctaacacattttgagtgaatcacaaagccaaaccaaaaaagaactaatttaagtcacttttaaacttggtgtttaactacctacactcagtctaaaaacgaaaataaggataaagaaatagtgaactctagttagttggtctttctttacagcagtatggg

SEQ ID NO: 6939 - DNA, 456 bp, Homo sapiens
taaagaggcagaataaacatttggtgccacatgacccctcagaagcatttgccagcttcagtgctaggactgaaaacctgaacaaaaagctgaggttgagcagctaagcagagttttcaatagatgtcagaggcgggggtcacaaaaacgggagttcagggatgacagaccctggtaaacatcccaggcttttggttggaaccacccttcttaccccctaaaaaccccaactttttaccctaggtgtatggtgaacctaaaaattttcctgaaatccagccctcacaaaacacaaaaacttagttttgaattggctgaaatagattaaagtgattcacccttgctcttaaatgcttgtcagaagcaaaactaaatcctctctagaggaaggtaacattcacagcctcagcctatctccacagttttgtgcatgcaagattaacattcagtcaaaaa

SEQ ID NO: 6940 - DNA, 157 bp, Homo sapiens
ttttttttttttttttttttgaggcagagtctcgctctgtcgtgcaggctggagtgcagtggcgcaatctcggctcactgcaagctctgcctcccaggttcataccattcttctgcctcagcctcctgggtagctgggactacaggcgcccgccacc

SEQ ID NO: 6941 - DNA, 5158 bp, Homo sapiens
ttagagagagggtctcactatgttgccatggctggtcttgaactcctgggctcaagcaatcctcccgcctcagcctcctgagttgctgagattataggcatgagccactgcacccatggtgcctaatttctgcctgatatgctgttggctcttggatccctggccaggacaggacatggaacatgggtaagggccacagacccagcagggctgctctcgaacccagtcttgcttttgcagaaagagccccctgagaaggcctgcatgaggcaactgagtgaaacagaggcaaagcaaggaagagagaagaggtcaagccttaccaagggcacagagccaactgcccagagcaagtgaagtcagagagatgggaatccccaggccaggagccaagtttcctctaggagggacaagggagctattgccaggccatgaaggttgatcagaagcttcaggcaaggattattatttattttattattatttttgtctgtagggggcaggtatggaagctgaggccacatttccatgagtcctacttcccacctgagtctgagggccccctgctggtagaacaagttggtccataggggaaacccctcggggcctgtccttccccaaggctggggcgcttcttggggagctgactgtagggctggtgctgagctccccacctcccacaggggttgtcttcgctttctccacgggtaggtctgcctagacaggcctggctggcagcgctcccggctggggaaatggtatctctttgtatctgagggcctggggcaggctgacagcccaagggattgggtgtcagcagcatgggctgccttgcccagcctgagatgctcaggcctgcaggtaccttggggcagaaagccaggcttctcatcctggattggagacaggtttcgactcctggcgcagaatcagaaaagaccccagcctcacaggctagaacaaaaatccagccccagtttgcctggggatgacagcagtgacccctaaggtgggcagcactttgctgtcagttcttcacaacgtttgttgtttgttgtcttttgtttttgttcttgtttttttttttgaaacggagcctccctctgtcacccaggctggagtgtagcagcgcgatcttggctcactgcaacctctgctttccaggttcaagtgattctcctgccttaacctcccaagtagctgggattacgggcacccaccaccatgcccagctaatttttatattttttgtagagacggagtttcaccatgttggccaggatggtctcgaactcctgacctcaagtgatccacccgtatcaatctcccaaagtgatcggattacaggtataagcctctgcgtccggccaacaacgtttgtttttttgttttgtttttcagacagggtattactctgtcactgaggctggagtgcagtggcacaatcacggctcactacagcctcagcctcccaaggctcatatgatcctctcacctcagcctcctgagtagctgggactacaggcatgggccaccatgcccggctaatttttgtattttttgcaaagatgcagccttgtttatgctgcccaggctagtctcgaactcctggcctcaagagattgacctgcctcagcctcccgaagtgctgggattacaggtgtgagccactgcacccagcccatgtttccttaaatgcacaattcataggacacttcatggggactgtcccgttaagccttacaacaaggatcctcattttagatggggactctgaggcttaaggcagatccagggttaaaccttgcttgaatttatactcagaaaaggcagaatacagagaaaacccagagttttgagtcccacaggctggacaagttacagggtaatcataccaacactgacaaactgtcagaagcaatacatgatataaggatatatacatgacctggcacatggcaggtattcagcaaaactcattttctgccccttctcctttcccttcactgagcagaagccatctcccccttgggttcagcgtggccccagctccccttcagcctgaaagctactggaaaaacgtctggaacctgtcctgctggctgaggcagaggtggctggagggacctcaggctattgtccctgcagttcacagagccaaaatgctgaaacagaagaaactcagccatcagctgaactccttatttgacagacaggaacccaggggccagagagggctcgaggggctcacggctcctcagatgttgaaacagggccagtacactggaagctcagcaggcagtcatgcgccccctccctgatgctctgaagctctcctctgagttcttgctcccctagctggtgggaggagaggggcagcccagtaggtgggcctgtcttctccacagacactgtattctaggggagatgacctccagggcaggaggcccgaagggtcctagcggggacaagctgaggccgctccttttggcgggcaggctggggagtaggctctccgtgctgggtggtgagtcactccctagcatggccaggcccaaactcaaagctcagcattctgggaggtgtgcacgtccacgtgaacgggggtggcgaaaacagactgaggaagtggcgatggggctggcttgggcagattagctgtggccattcccacagaatctctgccacttcctcttgtgtccccagcttgtcaagcccagtgagtccccttctttctcctgcctgggacctacagaagggccaaggcttctccactctctggggtgccacagcaggtggccctggctcctgaggtgacaatggtgagccctctcatctccatggaatggaaaactttccttaagctgggtgtggtggtgcatgcctgtaatcccaacactttgggaggctgaggcaggtggattgcttgagcccaggagtttgagaccagcctaggaaacatggcaagacgctgtctctacaaaaaatacaaaaattaggtgggcacggtggcgggtgtctgtggtcccatctacttgggaggctgaggtgggaggatggctcaaggttgcagtgagcctagatggcaccattgcactccagcctgggcaacagagagagaccgtgtcttaaaaaaaaaaaaaaaaaaggctgggcacagtggctcatgcctgtaatcccagcactttgggaggccgagatgggcgaggtcaggagatcgagaccatcctggctaacacaatgaaaccctgtctctactaaaaaaatacaaaaaaattatccgggcatggtggcaggcacctgtagtcccagttactcaggaggctgaggcatgagaatgcgttcacccgggaggcggagcttgcagtgagctgagatcacaccactgcactccagcctggatgacagagccagactccgtctcaaaaaaaaaaaaaaaaggaaaccttcctcagtagatcttcagtgtccaggaagaaggtacggcagggatcaccaagtccattttacagatgagaaaactgaggctcacagaggtccagtggctcatctattcctcaggtcccaagcctcatgaacttcccactctactacactgtcctcctgagttaaggcttccacaagctggcccaacaacccctttgaagcaattatcccatgccagttcatggaacccaagggtggtggggcagctgccaagggcaaacattggagctggcacagaaaggacacagaagaagagcaaacacctcttctctagtagaggcctagtggtttccaggcttcctgccaccttcttggcagggtccctggcctgggcatgaaaggaagtcaggctcatatccctgcctggctgggagggccctacagcctgcagaacttaggaggggagctgagccttacttagtgagcatctacttgaccctggctctattaattaattatttattattattatttgtagagaacgaggtctccctatgttgtccaggctgatcttgaactcctgggctcaaatgatcatcccacctcagcctccagtctgggattacaagctggagccacagtgcccagctgaccccggctcttcatatgtagaacctcagttggattcaggagactggggttctgaaatgagtacctgtggatggggcactggctcacgtagacagaaatggcttggcctaaagaagatgatcgacagaaggtgctagtgaggaggttttgagaaaacagccagggaaagaagaagccacttcacagggaggggccccctgccaggacccagggatggggccgcagagaggaaagctgacctgccgccccagcacagcaggcagcacgtgctcagatgtgcttcctcatccactgcctttcatcctcccaagaacctgggaagggaaacatcactcttgtcacaggccaagaaactgccagagacaaccacaggctgtcagtctgaaccttgagtggcctggactccagcgggaggaccctgtcagcagtgtctctgggctggctgagaggctggcagcccagtcctggagagaggcacatcaaaggctgggagcgcagatgccacttacaggtttacaacttccacaagcacaggcttctctgtcctggcctggggagctgtgagaggaaactcccaggaaggagggactctggggtatcacagtcataaaagaacaggacttaaagtcctgaggcctgggttccagccttcattcagacaccaaacagttgaatcacagaaagaaacttctcctgaggcctcctttgtaaattgtggggattagactggatgatttctatgcttttaacaactctaaatgaccccaaaatgactggagaagtccccagccacaccctccagtggtggttaagagcatggatgctagagccagaccatgctggctcaactataaactctgccacttagtagctaagttgaacttgggcaaggaatttaatcatttcctacctcagtttccttatacaggaatatcagcccctgtctttgcctgatagggtggttatgagaattccctgagttcacacatgaaagggcagagcagggcctggggcatgcgaggtgctctttgtgcatgagatgcttctgctagttgtcagcacatgcttgtctgtctgtgcc

SEQ ID NO: 6942 - DNA, 125 bp, Homo sapiens
atggagtctcgctctgtcgcccaggctggagtgcagtggcaagatctcggctcactgcaagctccgtctcccgggttcacgccattctcctgcctcagcctcctgagcagctgggactacaggcg

SEQ ID NO: 6943 - DNA, 87 bp, Homo sapiens
ctcacgcctgtaatcccagcactttgggaggccaaggcgggtggatcacgaggtcaggagtttgagaccagcctgaccaacatggtg

SEQ ID NO: 6944 - DNA, 780 bp, Homo sapiens
ctatgaaggaaggagtcttgttgctgatatagtttcctgttgctgccgttactaataaccactaatttagtggcttaaatcaatataattatgatttatacctctgctggtcagaagtctgaaatcagtctgaaagggctaatatcatagtattagcagagccatgttccttctggaggttctagaggactggagaatctgtttccttgtccttttctggttctaaaggctgtccacgatccctggggtgtggcttccatccattttcaaagccagcaatcacattttgacttgtgctttcatcatcacgtttcctttttttactcacctgcctccctctatcacttacaaatacattgggcccaaccagataatccaggataaccccctctcaagatccttaatttaattgcacttctaaagtcccctttgccatgtaaggtaaggtatacataggttttgtaacgaaattcaggtccagaccacttgtcacttgaaagtttaagagatgagcattggtgaaaggatggttagctctattcaggaatccaacaacccaggggaggcagtgaactagtgttcaaagaccgccgagttctgtctccatatcaggggtttttaagggaaattagaaaaaatgatgatcaaaacattcttgtgaaatgtgcagtctcaggtcattgctttgttggtcattgctttcttggtcagtgttttgtggccttctgtaggtgccatcagcctattcttatcaggctggtcagcccattcccagagttg

SEQ ID NO: 6945 - DNA, 1459 bp, Homo sapiens
gaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgataatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtccatcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagcttg

SEQ ID NO: 6946 - DNA, 396 bp, Homo sapiens
tgatacaaggcctggctctatcacccaggctggagtgcagtggcacgatctcagatcactgtaacctctgcctcctgggctcaggtcatcctcccaccttagcctccagagtagctgggactacaggtgtgcaccaccatgcctggctaatttttgtattttttgtagagacacggttttgccatgttgcccaggctggtctggaactcctgagctcaagcgatacgtcttcctcagcctcccaaagtgctggattataggggtgagccaccaagcagaatagtttcttttttccttttcttttttttgaaacagaatctcattctattgcccaggctggagtgtaatggtgcgatctcggccactgcaacatccccgtcccaggttcaagcaatt

SEQ ID NO: 6947 - DNA, 129 bp, Homo sapiens
agatggagtttttgctcttgttgcccaggctggagtgcagtggcgcaatctcggctcactgcaatctccgcctcccaggttcaagtgattctcctgcctcagcctcctgagtagctgggattacaggca

SEQ ID NO: 6948 - DNA, 130 bp, Homo sapiens
ttttttttttgagacagagtctcgttctgtcccccaggctggagtgcagtggtgcgatctcggctcactgcaagctccgcctcctgggttcatgccattctcctgcctcagcctcctgagtagctgggac

SEQ ID NO: 6949 - DNA, 465 bp, Homo sapiens
ggctggtctcaaactccgaggctcaagcagtcatcctggttcagcctccgaaagtgctgggattacacgcatgaaccactgcacccagccttaaaatttttttgtagagatgaggtcttgctatgttgccctggccggtcttaaacccctaagcccgagcgatcctcttgcctcagcctcccaaaatgctggaattacagggatgaaccatggtatctggctgtgcaactgtcttttaaggtggagtagatgaaggagagagagagcatgggggttttattattttttaaatttttggtttgagagagggtctcactctgtcacccaggctggagtgcaatggcgtgatctcagctcactgcaacgtctgcatcctgggctcaaatgatcctcttgcctcagcctcccaagtagttgggactacaggcatgcaccaccatgcctgcctaatttttgaatgttttt

SEQ ID NO: 6950 - DNA, 354 bp, Homo sapiens; identical to SEQ ID NO: 6906

SEQ ID NO: 6951 - DNA, 485 bp, Homo sapiens
aatgaaagggagaggggaaggtatatgtgtggtgtttggggtgggggttagttttagacaggcaggcaaggctgcctccctgggccgggggtgagacgtgagttggggagcacagcaggtgcttttgcagaagagagctccagggagagggaacagcaagcgcagagcctcaagcaggagcttctgcagcagcagagggagggaggtgtggcagggtagtggctgaccctcagtgtccttgtggcccttggaaggtctgtggagggggtatgacaagagtggtattcctttcattttaagggcccctctggttatggtgtcaagacacagagagatagagctgcagggcaagggcaggagtgaggggaccagttaggaggctgccaccatccgccagggacgcactgatgtggctcagagcagggtggcaggggtggcatctgctgagactcctgagatccaactgaaagagacaacaagtttta

SEQ ID NO: 6952 - DNA, 116 bp, Homo sapiens
ttttttgtatttttagtagagacagggtttcaccgtgttagccaggatggtctcgatctcctgaccttgtgatccgcccatgtcggcttcccaaagtgctgggattacaggcgtga

SEQ ID NO: 6953 - DNA, 1628 bp, Homo sapiens
tggagtctcgctctgtcgccaggctggagtgcagtggcgtgatctcggctcactgcaacctccgcctcccgggttcaagcgattctcctgcctcagtctcccaagtagctgggactacaggcgcatgccaccatgcccagctaatttttgtatttttagtagagatggggtttcaccatgttggccaggatggtcttgatctcttgacctcgtgatccacccgcctcagactcccaaagtgctgggattacaggcgtgagccacagcgcccagccttttttttttttttttttttttttgacacagagtctcaccctgtcacccaggctggagtgcagtggcgtgatcttggctcactgcaaacttcatctcccaggctcaagtgattttcctgcctcagcttcctgagtacctgggtttacaggcctacacaaccacacctggctaatttttgtattttcagtagagacggggtttccccatgttggccaggctattcttgaactcctgacctcaggtgataaacccacctcggcctccaaaagttctgggattgtaggcgttagccaccgtacccagaccctcataaaccttttaaatggaagtaaacataactgtgctctgaaaactgatgtttaataaaatgagatgaaaaagtgtttctaaatccatacattgaaaaatacttgatatgagtaaattaataactaagtgctataagaagatattcaaccattccatttatagtcctaaaagtttgtgtactcaagctgacaaaaaattgtttttggattttctaattaaaaaaaatggggaggccgggcatggtgtctcatgcctgtaatcccagcactttgggaggccgaggtgggcagatcacgaggtcaggagatcgagaccatcctggctaacacagtgaaaccccgtctctactaaaaatgcaaaaattagccaggcgtgggggcacaagcctgtaatcccagctactcaggaggctgaggcaggagaatcacttgaacccgggaagcagaggttgcagtgagccgagatcgcgccattgcactccagcttgggcaacaagagcggaactccgtctcaaaaaaaaaaaatggggaggccaggcacggtggcccatgtctgtaaccctagcactttggggggctgcggtgggtggatcacctgaggtcaggaattcaagaccagcctggctaacatggtgaaaccctgtctctactaaaaatacaaaaaattagcagggcgtggtggtgggtgcctgttatcctaggtacttgggaggctgaggcaggagaatcgcttcaacccaggaggcggaggttgcagggagccaccattgcactccagcctgggcaacagaaggagactttgcctcaaagaaaaaaaaaaatttttaatggaggactgtgcctcatatttatgatgaaggcgataaaatgttcacagatgtgaaattagcccagctaatttttgtatttttagtagagacggggtttcgtcatgttggccaggctggtcttgaactcctgacctcaggtgatccaccggcctcggcctcccaaagtgctgggattacagccgtgagccaccgtgcccagccaaaattttttttc

SEQ ID NO: 6954 - DNA, 1366 bp, Homo sapiens
ttattgatatgatgatgattaataattaatttatttccattttcactttcatactattcagtcccaattctctggaaaaaaaaaaaagaacactggaaaaaaacaggtttactattatatagcagagaaataaggataatgtttcttggtttcaaagttctgatttgtaagttaaaccaagtcaatacaaaaaccttccttcagccaaaaaaaagtagggaagtaaaaacccttttgtaaatccttgttattaggttgctatgaatctgaaatacaatatacacagattatatccttaagcattaggttggcacaaaagaaatcgcggtttttgccactgaaatggcgaaactgcatttacttttatatcaacctagtattataaaatatatacaaagcaagttgaggaaccaaacacaaaatacatgtctacaaacatgctttccaatgtactataaataaacctttacttaagatcttgaaatcaaaattagtttgtatagtattcagaatcaaacctaatgacaaagcaagatgaaataaccaacagcatcatcattatcagaatagtaactaacatttatataaaagattactatgtgtcagaaactaagggctttcatttcattcaattctcataacaacctataaagtaggtactatcattatatccattttacagatgagtgaatgaaggctagaatttgggtcaccggcccaacatgacccaactattagtagtaggtagagaagcgggtctccgaacctaggtaatctggctttggaatctgtgctcataaccactgtgctataatgtctctgatagcagctactaattaaaaaataaaaaatgtatgttttcctaactttaatcatcaccagataaggaatattcttggttcatttatgtctaaattttcaacatactttttccctttcaacctattaactatcctcaattttgagtcagctgattttatgtgattgtttccttccctcccacccccagtacactgcctttatgtggctgcatttgtattagtctctgcttagaaaaccaaaaatgtatgacatgattaaaccttgtttgttcaatataaaataagagttaaatactttccataactttgctctcttctcaggccttcaaagtcttgctcagtaaagtactgttgatgctgataatcagagtatcccaccaagagcacatgatgccttggactgcaatactgtcacagcagtgtcttcagttcttctctactgtgtataatgcagagcaaaatgggggtggtggtagaaattatggtagtaaatatatattttctagaaatatatccatttcgtggaaagataatattaagaccat

SEQ ID NO: 6955 - DNA, 786 bp, Homo sapiens
gatggtgttggcctaaggcctcttggcccttgttaggacttggtttaccatggcgcaacacatccatgagattggcaaaaattaaaaagtctgacaacagaaaatctggtaatctggtgaggatgtggagcagtgggaattctccaatactgccagggagcatgggcatcaatcccaccacactggaatgcaaaggggcattctgagtagaactgaagatgtgcccatccttgaccccacagttccagccatgggcatgcgcatgaatgtgcacacgtgttgactgcggcatttgtttgtcattatgaaaacatctaagtttccatctatgggagaggggatatgtgggagtgcccaacagtggagttctagagagcagtaaaaataaatggactagagctgcacacgtcaaaatggatgaagataaaagacatgagggatggagagcccccccctggccacagaagtatatgtccaatatgatgctggtgtatccagagtgttcaaacaaacaacacacccactactcattgtttccaacgtgagtatgaaagtatggagcagtgcggagggccaggagtgctgaatccacatggttacttctccaggcgggggccgaggaccagggctggaggtttactccaggagcttcagtggtgcatgctgaatgtgctgtttcttgggctgggggacagagatgtgcatgctgttatacactctatattgaaatgattgtataacaatatactaatttatcatgtaataaatttgaccagaaagaaacaa

SEQ ID NO: 6956 - DNA, 485 bp, Homo sapiens; identical to SEQ ID NO: 6951

SEQ ID NO: 6957 - DNA, 116 bp, Homo sapiens; identical to SEQ ID NO: 6952

SEQ ID NO: 6958 - DNA, 913 bp, Homo sapiens
tttaataacagttgttcacacatgtttattgataaaccgtccaaaatgtaggtcatgtgtaaacaattccagttgttgggtatattgggtattgatccctgcagcctcctaaagtgctttggacatgaactgacccgcaaagcaagggcaaaggcctcagatgcacagagctgccctgacatcccttggctcggagtccctgtgccccatgtcagagccctaaacctgtctcccctgcctgcactgtgtccggcagacaaagggcagctgtctgcacggtgaccccgagtacccaggacacggaccacgaggacccaatgaaaatgtcccctttcaccatgatcggcagcccccttcccacagccccgccagcccacaacccccctcccacggccccgccagccgtcctcacagggcaggcggcatctggcatctccaccagcatcacacgcagctgtccctgccagctaggcaaggccgtaatgaccggcacaagcttgggcttgggccgtgggcagcaggagggctggagaggcatggggggaaccccgctctccctccggcatggggcctccacctgcagcagtaagcagcctctcagcccctgagcctggggacctgcccgggcagcacagggccagggccaagaagtatttgtgagaaggaaggtggcctccgccacccctgcctagcaggcctctttctgctgccctttagaaggcactgggtggcagaggaggaaggggagggaggtgttccaaagccagtgcccacccctccacagagccaaccccagggcacacaggaagcagccaccacacgtgggagacaggctgccctcgtcaccgctgccctccagcccccccttcaccctgccctcctgaccctcccacccctgccttcctgccccccc

SEQ ID NO: 6959 - DNA, 634 bp, Homo sapiens
tagcatagtgcctgacatatagcagtttcttaataaatgaagtcattggtctattactattattgctactaatgtgcaataataatagacaaaagcaacgtagaggtgaaagtgcagacgcctggcctttgccctggggtttcccctctgctgaggaatctgtggctgctcagctttaagggtgcagggaggtggccacattcctcaggccccagccctggcctcaggcatgaggcaacaaggaaagcaggtttaccttcagggcaatccttgggaaaagaataattttagggacaactagaaggctccgtggtctctcaaatatctctcctaaggcctggatgctgcctaaaactcatttcagggtagccacaccactcatcctgctaggacagtaagaaagctcaaatacgccaatacccaggaaagggtacacaaaatgtgagtatagttcaggcaaacagcataaaatgatatgagatcttaagagctgtgacactagagacttttctcttttttaaaatttttttatttccataggtttttggggaacaggtggtgtttgtggtgtttggttacatgagtaggttctttagtggtgatttgtgagactgtggtgcgcccatcactcgag

SEQ ID NO: 6960 - DNA, 634 bp, Homo sapiens; identical to SEQ ID NO: 6959

SEQ ID NO: 6961 - DNA, 1403 bp, Homo sapiens
actgtaccaaggcttcagagtgagcagggggacatctggataggttagccagggccacagagagaagagctgcttacacctgaattgtttcacccttttcaagaacagggttgtccttctccccatctggatccttgggctagatctctgccgaggggctccgtcaagtcccgcaaggctagagaagggagccccacatcatttccactttcaaagagggaagatgctcgtcattcaaattacttctgttgatttccatggtatccccctgtccgtcccacaatctcttaccaggcgtcaatgcacatgcaggggatggaaagaggatgagccgatgagcagactttgcattaatcaaggagaaagaaaaagcagatggaaggaggtaggtagatggagaaagcaacagctccttttagcccttgatgatggccctgaaggcctgtctcttttagtgactcctctttgggtcctcttcccctacctctcagtgactaggttcctcatattaattccctgctgtgagtttggctccttgtgctgggcaattcagtcatcctcagaaagagcaaagttggtcttggaattaaggtgcaggtggggaaaaagagggactcagctagacacgaagaaaggctctcttcccagtctaagcccttctaccgtaaggggcattttatcaagacagccacccaactccccatcccatctcccctcctttgtagaaacagcatttgactcaccaagcctttctctccctttccgtgtgtcttgcttagtttctggattgagagaatttctatccttgctccctcgaactctaaaagagcttcttttgaaaactggggagtatcaggcctacctctacatgtgcaacagtgccaggattcaaaggaaaagctcattccagcctctgcctcttgggagatggttcagagtgccacatagggactgaaagagggtgtctgaatccttcaggaatgctttaagtgacattgttgaaaagagataaagaaaaggaaaacaatggaattgggtttctaaggtccctggaaatatcctgggggtctaatagagaaagaaaataagaggaaatttgaagactcacttcttccttcatctgaatccactcagatggcaactgatctctgtcccaaggaccctctaccccacccaattcataatcatctcagattagaaaaggcagaattccttcccattctcaaatcagcatttgggttaggggcccctaagttacgtgagcatgttagaaatgtgaccccaggcctcaagagagaggctctgccacatgagaggagataggaatcatgactgaaaggggattagcacagaacagagaaaactgatttgatagacaaatcaaatagaaaatataaaaaaaa

SEQ ID NO: 6962 - DNA, 10337 bp, Homo sapiens
gcctcatcatcgttgtcatagttgggcacagtgctgaagctgccagctcgctgctcatgggtaataccacattcgggcaagttttctacggacctcgtactccgaattcggttctcggggatccgggcagggacactggtggtgtcaaagttttcacattcaaggacttccacataaatcaggtagggagcctgggggaagagtgagacagtatttgcaacttacttccaccactaacccccaaatctcaactctgttagcaaggttcttcctgctgtcctttctcctagctccagccttcatccaatagtcctctgaaactatgaacactatatttagggcagatacttgtcctatgatcacctatgtaaagaatttgtgtgacagaatccttaagtcttcaaaatatttcaactgagctccaaaatgtacagatgatgtgcttgggccaaaccactctagactatcaattacaggctgtaagggaggcctagatgcctctgtgggctcgtcctgaagacagggcccagggagctacagtggacaaaaagactgggacaaagctgggcactgtcccaaggagtgtcccaaacttcagtatttcctttgaaagaagaatatgggccgggcgcggtggctcacgcctgtaatcctagcactttggggggccgaggcgggtggatcatgaggtcaggagttcaagaccagcctggccaagatggcgaaaccccgtcgctactaaaactacaaaaattagccgggtgtggtggcaggcgcctgtaatcccagctactcaggaggctaaggcaggagaatcgcttgaacctgggttgcggaggttgcagtaagccaagattgtgccactgcactccagcctccgcaatagagtgagactccatctcaaaaaaaaaagaagaatctgaaccatgaatactcattccagtcagcacacaaattcagctaattctctccagtgtgaattgggcatccttctctccttttgtcggctcattctgatcagaaaaggtcttagaaacaaaatatttctctatccttatggttgctgtatctggaaagcccaagagttatagaaaggctggagaaaagctaccaaaatgaccataaggtggggtgaagagcaattctcctaagatacagcaagaaggaagctaaaaagattaggtttctttggtccagaaaaacaaaacccaaaaagggatacaggggggctctcaaaatcacaatcgcactgagacagagtcatggttgacatatgcatcatgaactatgaagggagtctaggatgttggtgagggcctcactggtcatacacgcaaactctgaacaaccatgggtgaagagtcacgtccagggtaggggtttgggccagaacccatctaccttgtccttggagttgaggacaacagcctgtgtgtggggtacacggaccacgtggtggtcaaagccagcagtgggcagccagactcgggcagggagcttatggttgagcagggagagctctgagatcagcctctgtgttttctgctctttggtggggagcgtggccagccgcttgccgatcgccatcagggacttgatgaattctctctcaggagccagtcgaacaggctacaggggtttggggtaagacaaaagatggtgaagaaaccatagaatacaatggcacacccactcagtcactcctggccatgcaggccggggaccccactatctggagaactccaggaaaggagctgctttttagtcttagtaggagcttccacccacccttcacaacttgaattgagaatagccagcacattccttccctataggctatcccttgagggtaagggaggccatgagtccaggtaactgggatgcactcctcttctcctggacttgggttccttaaggactgtaccaaggcttcagagtgagcagggggacatctggataggttagccagggccacagagagaagagctgcttacacctgaattgtttcacccttttcaagaacagggttgtccttctccccatctggatccttgggctagatctctgccgaggggctccgtcaagtcccgcaaggctagagaagggagccccacatcatttccactttcaaagagggaagatgctcgtcattcaaattacttctgttgatttccatggtatccccctgtccgtcccacaatctcttaccaggcgtcaatgcacatgcaggggatggaaagaggatgagccgatgagcagactttgcattaatcaaggagaaagaaaaagcagatggaaggaggtaggtagatggagaaagcaacagctccttttagcccttgatgatggccctgaaggcctgtctcttttagtgactcctctttgggtcctcttcccctacctctcagtgactaggttcctcatattaattccctgctgtgagtttggctccttgtgctgggcaattcagtcatcctcagaaagagcaaagttggtcttggaattaaggtgcaggtggggaaaaagagggactcagctagacacgaagaaaggctctcttcccagtctaagcccttctaccgtaaggggcattttatcaagacagccacccaactccccatcccatctcccctcctttgtagaaacagcatttgactcaccaagcctttctctccctttccgtgtgtcttgcttagtttctggattgagagaatttctatccttgctccctcgaactctaaaagagcttcttttgaaaactggggagtatcaggcctacctctacatgtgcaacagtgccaggattcaaaggaaaagctcattccagcctctgcctcttgggagatggttcagagtgccacatagggactgaaagagggtgtctgaatccttcaggaatgctttaagtgacattgttgaaaagagataaagaaaaggaaaacaatggaattgggtttctaaggtccctggaaatatcctgggggtctaatagagaaagaaaataagaggaaatttgaagactcacttcttccttcatctgaatccactcagatggcaactgatctctgtcccaaggaccctctaccccacccaattcataatcatctcagattagaaaaggcagaattccttcccattctcaaatcagcatttgggttaggggcccctaagttacgtgagcatgttagaaatgtgaccccaggcctcaagagagaggctctgccacatgagaggagataggaatcatgactgaaaggggattagcacagaacagagaaaactgatttgatagacaaatcaaatagaaaatataaaaaaaatcagccaaactcccagaggtcctgcatttcctctcacgtctttgcccagcaacaaggtccaagaccctgtgggaccaaagggtcaggggttagtccagagggaacaagaaaggagaggggattaaggaacatcctgggcagtgagctgggaaaagggaagaactcagacctggaaaaaatgtggttgaagttaaaaaagaaaaccagttgtggagaggcaaaactttccttcaggccaagtcctatttgtttttggagtcagctcaccagcacagggcctagcatttagaagattatgaataaatatttgataatctgacggcagaagccatggggaaagggttctgggtgggagaaacaggatcctgggggtttctgccaggcagtttttggctctaatccaggagtgaattctacctctctcccagctgtttgctccagacactcaggagctgggggctgagcagcactgtactccagctgtctctgagagaaggatcagctgagctcatctcagcctgggctcaggatttccaccgcaaaggtcaggggaactccagcagatctgggaggtctgggagggaggagctgatctcccagtaagaaaaggggcattttaactccagccttggcctgggggctcagaagacctggggacggagaggaaatgcggccactgggggagcctgccaccccgtcccagcctggccccacttacggaactgaatgaattatcaatactctcggtgctggaggagagctcctgggaaagggccagagggcaaagggagaaggagggggtgggaagggaggggagagagacaaaggtaaagaatttagctccaacttggatcgtaactgcttctctagtgcagttctacctttctgctttaataaaagaaagtcaactcagaaatgctacttgcccagatgcttgaccacttgtaggagatgctggaagggcagctcagactttaaggtcagaaggactgaagagacaaagcagcctctgcttttcactttattcacttctattctcaactgaatggatcttccttctaggccaaagctctaaagctgggtccctagggcagtaactgcactgccaagcttccctgctctttttttttacccactcacatgctctcaaccaaatccttctccatggggaccaccacaggactgaacttaataagctgcatggctcccatactggaaaccccatgttcctccagctttttggaaacctcagggaggaagaaaagctaaactttcagtggcaggtatacctcttctctaattagcctcattatcaccctgggaagctgaatcccaaccttgaacctctgtgacaaagagcatcctagaccaataagcccaaaatctctgggctggatgctgatgggagtgaaggataaatcaatctcctatctaccaaacctccttaggcttcctatcaggctatccacatgacaatcaatatactacaatttttgatataagttggggagttagctatatccatctagaaagctgactagctggatagcagctgtcctagtcccagcccagaggatttatctaaacatcaccccattgctgtgtcatatgtgtccgtgtgcaaaaacaggggaaagagatggtgtcaaactctcactcagcagctctgaggcaacactcatgcacagggctcatcctgggttctgtccaacatggtctaccagggcagggaacagagcagcacgtgtgcacaaatctaggttgtgggggacgttgaggtcggggtgggggaggttagacttaaaagacaaagtcctaagagctcccagggcaggagggcagtggtgagtttctactctgaaatctgctgagtagattcaagcatccacttgaactcaattccatggtttcagttctattctagctggaggtcctatagtcaggtccttccttgaagaatctggggactggagcactttgagggagaagccacatttggaaacatgcccctaaggcaacaactcttccattttgggtagaaggtggtgggagaattaaggcagtgaggatgtcagagtctattatgaattagtggttctatttctacctatgagctggttggagaaggaacagcaggcaagatattggctccctgagcaacgctccagctgattctgtcacagacaggtcctgtctgactcattgacagccctgggggaagggaggtatatcatgacctgctcctctcctactccctgggcttgagtcactcacactgagtcagctccggggagtaaagatgaagcaagaagctgacatcacaccatatcaagctagaaggcctactggggcttccagtgtgacatgcggcagatttctctgtacaaaggttgcagtcctgaaaagacaaagctaatctactaacagtgtcatcatatcggggagggtgtgatacctaaatcactctctccttttagctcccccattctataccaaaatatttgccatttggttacaaatgggaggacaaactgcctgggcagagttccccgactaggctgataaaatggctttgaagcggcaggctttgaggagcagtggtggaaaatgtgaaaaatcagcacaaagccttctgactgtgggagagagtgtaaaggattcctcatagtaagaaagagaacactgtgagagctgagcagagaacaactctgcagggagaccatgggcaggaagagaactgtacatgctgcccctgagcctcttctttgaggcccgacctcatccttgggagcccctctactggtggtaggagcatagtattaaactcagaacctaaaagaaaagcaagagactgggagcagagtgttagggtctacctagagattctcctagagtatctctgcttaggtcttagataattatgtgcctcattttagtaagctgtatacttcctgcttatggcagaaaacaactttttcaagagagtcacaaactaaacagttccatagatactggggttttcattattacttcacatgttcctagagggaaggataacattttatcccccgtcctccacagcacagctcacggctttggacattgtacaaagtcaataactacatgttgagtgaatgaatgttacatgaaagggaagaaggatgagtaaaaggaaaaccaattcctttggtatttaggggacaaaagccttgacagacgcatcctcaaaatgccaaaggggctgggtctagtcactcatgcctgtaatcccagtgacttgggaggctgaggcgagaggatgacttgaagccaggagtttgagactagcttgggcaatagagcacgacctcatctttacaaaaaaattttttaaaaattagccaggtgtggtggtacatagctgtagccccaggtacttgggaggctaagatgggaggattgcttgagcccaggagttaaaggctacagtgagctatgactgtgccactgcacgccagcctgggcaacagagcaagaccctgttgcaagaaaaagggcggacggacagacagacgggtgggcggaaggaaggaaggaaggaaggaaggaaggacggatggaaggaaaagggctgggagagacccctgtgctgacgactctaatgcttagaaacctagtgatattcatgtttctgtctctttcttgctctcccattttctgtggagccataatgaattcaggtatttcattctgtcagtatcagataacgcaggagtgcctgggaacatagtatctccttcctctcctggatctagtgacccaagataaggagtcaggttggaagaacggcagctacagaacccaccctaaatgatgtaagtattcacctaatacctgcctctcagtgccatccataatcttatcctggagtgggagttagatgtaaggaaagagggaccaaggatcagcagagtaagaaaagccctgaggcctcagcttttctggtcctaagatgagcactacaaaatggataaagagaaaagccaagcctgacaagaggcaccaaggaattcacttccagctgctcaccctctgctacaggtttgactccaagatgagacagctatccaacccttcatgttccactagaatctggatgactcttcttgttctgcagcaacttctcttcatgacccagggctctgctgccaagctcaaccagatatgaaaacggttcattctagttctgacaacagttttggctttgcctgtgcatggatgtggaagctcagatggccatagcctgggccgttcttccccacatggcttctgacagctggggaccttgggaagtagatattgagaaataaccaaggtagttcagctgaatgattatgagcaccagctggagatttgagtcctggtctgacattcactagttgagggaccttgggcaaaacatctaatctttctaagcctcagtttccttgctggcaaaataatacctgtctctcagcatggttgtgaggattaaatgtaaagtacttggcaagatgcctggcacataagtgctgaataaatgttagcacttttagctttaccattattaaactatcctaacaaaattccaaatttccagagagcaggctctatagtctccctccctcttccttttctctagtcactctgacttccctctatttgaaagaagtcccattgtatcaaaaacgtgggtgggttatatgccccacagaggcagatgccaagaccatagctatccgcatttttcaaaaagtgcaaattcctcctttttttctccctcttttctaggctgggttggaagccaggatgggagcctggccaatggtgagtcagaggggaggactggagcaccattgtctggctgggacaccaggtcactgacacttggtagtccactgggcagctttccctgctatctgtccagatgtggagtgaagagtgggtataacctattcatgtggccacctcttccctgctctatatcctaagttatacctccaactgctgctgtagcttcctcttcttcccagcctccaggtccttgactaggcactatatttactctatactaagagtgctttctcttccctttgtgcttctcccaaatggtatgggaaagataccagcaaggcactcttccccctaaggaaaggcaggcaatgaaggcattctccagatgcctcagtgataagaaataaaccttacacttatgtcaacaaaaggtaggatcttcagagggtagtgaaaagggattagattatgaggaggagtggccaggagaatgaagccgatgttctaacatctcccctaccccagcacacagaaagacaatagtaccttttcctttcccacagatgctgctctgagaggctctggtagctatctcaagtctcaggtcagggtgtggagggcttctgccacagttctcattaacatagtagatgttaatggaatggcagtttatttatttatttatttatttagagacggagtctcactctgtcgcccaagctggagtgcagtggcgcgatctctggtcactgcaacctctgcctcccaggttcaagtgattctcctgtctcagcctcccaagtagctgggattacacgcgcccaccaccacgcctggctaatttttgtatttttagtagagatgggattttgccatgttggccaggctggtctcaaactcctgacctcgtgatctgcctgcctcagcctcccaaagtgctgggattacaagcgtgagccaccgcgcctggccagtgcagtttaataaaaatgatttgggacacagtcaggagcgtcagccttgccatgacctatatgacctgaggcaactcactttatctctctgggtctgagttcttcctttgtaaactaaggcaggcaaaatacatgaattctaaggcctttccattctaacattccatgcttttatcagtgaaatgaaacagggaggacagaaagaacagcgtaaccctgtgtgtatataggaggcatcctgtctccatgcagccctctaccaccttttgtctctggccctccccagaattttacctcatcctcattctccactttagggttgctggctgttcgtttcaggttgctgctgagacttatgctggcagtggcatctgacttagagcgctggtgagtccttttggagggagacagccctgtgtcaggggccgggctcaaggagggcagctccctcttcctgtgagctggctttagctcatctgagaggatcagcttccgtagcttggtcccacgggagtgtcgttgagtggaaatgtgcatgtctgaagaataggccccaagcaacagggcacactggagggaaaagttaatgctctggcggcaacggtggactatgtagggcttaatggcatcacccacgtcctcatccatgtggatgtacatgttaagcaactggggcagatagaagtccacgtcctcgttgcgaaagcagaagagccggttgccaatgtaggcttgtactccaggctccttggagttatacaggtatgaaatggccatggagatgtcaaacagttttgactcaaacagcctcagcagccaagactgtttagctgagttgttctgccgccgtcttcttgctcctttggctgtgcctgaggccacagcggcccccatctcatcttcctcctccctgatctgggcaggtggatcatctaggcaacggatctcactgtccacaccatccccattgaccaactccagtggggtgcctctgctagagactgccacgcctccatgcaaaagcttgactttctccaacacctcctggcaggccttctgggccacctcagggtcaatcactgatagttccccgaccccctccgtgatgacacttagcagggaccccccattattccctggtgggccagaagtgggctcagaagttggcttcaagggggcaggctccactactgtatctcccatggccacagccagacttcgagcttccaag

SEQ ID NO: 6963 - DNA, 274 bp, Homo sapiens
ctccatctcaaaaaaaaaagaagaatctgaaccatgaatactcattccagtcagcacacaaattcagctaattctctccagtgtgaattgggcatccttctctccttttgtcggctcattctgatcagaaaaggtcttagaaacaaaatatttctctatccttatggttgctgtatctggaaagcccaagagttatagaaaggctggagaaaagctaccaaaatgaccataaggtggggtgaagagcaattctcctaagatacagcaagaagga

SEQ ID NO: 6964 - DNA, 117 bp, Homo sapiens
ttgttgttgttgagacggagtctcgctctgtcacccaggctggagtgcagtggcgcaatctcagctcactgtaagttccgcctcccgggttcacaccattctcctgcctcagcctcc

SEQ ID NO: 6965 - DNA, 998 bp, Homo sapiens
ggccaacatggaagccacagggtctctcgtgccctgatctgggaagtggcaggccgccaccaacactgctgctgttgttgttcatgctaagtcttggcaagcctctgggtcgcacgtagggcatgtctccattcaggccagccgcatttcgagccacacgtggttcgtggcaactgttggacagcacagatgtagggcatcaaaagcctatgaccgtatgcaacctggtgcttctgagatgctcacgtggtccatgggtagaagttgttcacctgaggtcttggctacctggcattagcccacacacagatattagtgtgcccacctagtgtgcagagtagcttaggggtgcatccctctgtttctgccctagctgataattctcttgaccacaggatcccagtttcccttcctttatatgtaagacactttgttcagtgtctttatttcataatcactgtcgagaaatggaggtaaagtagtatcagttgtctgtagacttagtggcagattgtgggggaggctgcatcccaaagctgggctggccctggaggacaggctcagggacagctccatgtcccctctcatgggtgccaaaccattctgtgagtgcctgtgcttcaaaggtgagcccggagagctctgtactcggccccctctggccttgagggaacgggggctgggaggtttctggctggaccctgaggggctgcttgcgggctctgggtctttggacttggcaccgttgccttggcatttgttggcttgggagttgttgctgctgctttttcccagatgcatgggcctgctaatgtcagtgtttgacaaaccaaggagaggacactttcctgagctcttgaagtccatgctttatcgtttttgccttcagatttcagagcgacctagcagccgtgtgtaacaaacacgtcacttgtccctgtggagattggcccaccagcctccactggcaccctgtccactttaacaagcacactcga

SEQ ID NO: 6966 - DNA, 998 bp, Homo sapiens
ggccaacatggaagccacagggtctctcgtgccctgatctgggaagtggcaggccgccaccaacactgctgctgttgttgttcatgctaagtcttggcaagccactgggtcgcacgtagggcatgtctccattcaggccagccgcatttcgagccacacgtggttcgtggcaactgttggacagcacagatgtagggcatcaaaagcctatgaccgtatgcaacctggtgcttctgagatgctcacgtggtccatgggtagaagttgttcacctgaggtcttggctacctggcattagcccacacacagatattagtgtgcccacctagtgtgcagagtagcttaggggtgcatccctctgtttctgccctagctgataattctcttgaccacaggatcccagtttcccttcctttatatgtaagacactttgttcagtgtctttatttcataatcactgtcgagaaatggaggtaaagtagtatcagttgtctgtagacttagtggcagattgtgggggaggctgcatcccaaagctgggctggccctggaggacaggctcagggacagctccatgtcccctctcatgggtgccaaaccattctgtgagtgcctgtgcttcaaaggtgagcccggagagctctgtactcggccccctctggccttgagggaacgggggctgggaggtttctggctggaccctgaggggctgcttgcgggctctgggtctttggacttggcaccgttgccttggcatttgttggcttgggagttgttgctgctgctttttcccagatgcatgggcctgctaatgtcagtgtttgacaaaccaaggagaggacactttcctgagctcttgaagtccatgctttatcgtttttgccttcagatttcagagcgacctagcagccgtgtgtaacaaacacgtcacttgtccctgtggagattggcccaccagcctccactggcaccctgtccactttaacaagcacactcga

SEQ ID NO: 6967 - DNA, 998 bp, Homo sapiens; identical to SEQ ID NO: 6966

SEQ ID NO: 6968 - DNA, 314 bp, Homo sapiens
gcattcacagtgcatgattaggaccccaccccgaagccgccatggctgtcggtgcagagcgaggttaaagagatgggattgctgatgtctcattccgtgctggttgaatttgtagcttttacaagaagacgacgtagatgagaagctgagaagtaagcctaagccccgtgtgtttgactggggctcctcaaggtagtcctaggaggccagaagacataaagaagacacttgagttggggtcagtgctgccatctcagggtgaggccaggtctcacctccagaacccctctgcctctcctcttctggtgccccag

SEQ ID NO: 6969 - DNA, 314 bp, Homo sapiens; identical to SEQ ID NO: 6968

SEQ ID NO: 6970 - DNA, 314 bp, Homo sapiens; identical to SEQ ID NO: 6968

SEQ ID NO: 6971 - DNA, 1100 bp, Homo sapiens
gcaccgatgccaatacaactgctgtcgccctcaatgcgccagcccaccctgcaaggatcctaccacctggacccgcagtagccctcctactgctccgggggagctgcagtctctgttgctgccaccaaccgcataaggcgagctgcaaagccatgccatctgcaggctccaatgtaccatagatgactcctcctcttcctcctcctccagcctggcttggagcagctagatgggcaaagctagaaaagcctaaaacgggatgcagggagtggtagcattagagcctcaccttgtcacgctggccactgggtggcagggaccagtttcagcaaaggcactcacacccaccctccaaagtccagcctctccttctggcaaaagctggccaggaactggggcccagggtgagtgtgtgtgcctttgctgaaaccagccctaggtcaggtcctgctggacagaaattgctgggtccaccagggctgcactcctcagggagcaggagtaggagaaactcaggcccagccaggccctgcccacccaagttctggttcccgttcctgatgcctccacccacagtgccctatccccccacccccaccacagtggtgcccactactccctgcccagtagtcccaggttgtctctgcaacacagagcatgagagcatgggccagagaaccacggtgggtgtgggggccctgtcatactcaagattgtgcaaggaggaggagatcactctctagagtctggaattggggaagaggagaacggtcccttccttggagaccacctgaaggaggaaggaggccactgctgtcactgccacctccgcagcctgccaacgccactagcagtgtagcccctgatagcacccctaacctgccgcctgctgcctgccaccaacagtgtagcccctggatagcacaccaaacaaaccccgcaccagctgcagggtgtgtaaccccaatatcccccccaaagcaccctccctcccccagagcaggcagtgtagcacccaatagtgcccacaacctgacccagccatgggtgttgctgcactagatagcacccgaaacctgcccccccaaccccacctcgag

SEQ ID NO: 6972 - DNA, 1899 bp, Homo sapiens
tagaatcatcaacaaaactcgcatttaatgatggtgttgacctgaggaatcttcaggcagaagcttgtggtcagaggggaccaccagcaaagaactgacccaggtcttggaccaagagtctcccagagagagtcaacctcccagtagaagggaggccaacccctccactgcttcatgaaagaagactaaaaattctcctgggggaaagaaacacggtacaaaatacattcagagccccctgggtgggcctggggcagcccaaatcctacagatgagggaattggggaagtgtgccacaggtctaatccctgtgcccttgctttgcatggccaggttccaaggggcggaatgtattaatcatattcctcttacaaaaatatatctctttacacgcaccttctccatggtctctttgctacttgggaatgagcatttacctgcactccaaggcttcagagggactgcctagggaggctactccaatagaatagcaaagaggctatgacctatggctttttcatctacataatgatggatggtgcaggtttggactgggtgggaagctactggtatccagggttggggaagagatgggactctggaccaacactttgtaagattgatgctccgtgatttaggtcctcagaaatccttcggtttggcatttcagcatcaagagagcagtgtttgtatagaaatgacacaatttcattcaccccattccttaaagggcccccaagggaagctggccctgttggactatgatcaaggggagatatatggtctgggaaggtagtgggggtccattttgggtgtggttccatctgattaagaacactcttgctgtctcacctggatagcaaaggacccatttgtaggggtcagaagggcagtgtaagactgactggagcccaccatggagagatgtgtcactggggctctctcttaagtcaaattctgcacatggcatgtgaccatcctcgtgggctcactgttggtgcctgaggttccttgaaggtggtatcaggatctcaaggtcacctcctggacacagcatggatagaaaggggcagggttcatgccctggaggtggaaaggcaagcagctcatttctgagaagcagtgtggcctggggggctcataacaccaatggccccacatggtgtctccaattaacctactgtgagcaccattacctccccacactatccaggatgtcagaaacctaaggccacggagaaacttcccagcaatctttctttagaacagaaggtggcctgagttaaacatcggtgccagcacttcttgggtggagatgagaagggggctgcgaaatctcagcccagaagggacaagcatctggggccaagtttttacaatagccccctgggctcttgcatcaagagccttgacaattgccatggggcatccagcaagtctccatgatgtggatgagccctccctcccacaaatggaacccagagtggtgggggcagggacccaggagacagaaaagagtccatgtaactagaaccccctaaacaagatgccccacattgccaaggggggaacatgtgagcagagtggtagtgcctgggcaatctcttcccttgagcctcctctgtcatgcaggaaactcattgaaggcaaagagcagccaaggggattgtccccagaccaaagagaggacagatgagtgggggtaaccaggggtcttgagtccccagggcctgcgtggtcaggactcccagtctaccctccccctgtgtggacgcatcatcttgggtagtagtcatcggggacacccgttaggttccgccctttgagggctgcatccaccatcttgatgtaggcagagatggtcttctgcatgtccgcagtataggggtcatactcgag

SEQ ID NO: 6973 - DNA, 104 bp, Homo sapiens
gcaggctgaccatccggcccagctggacaaagaggtcctgcttcaggtcctcaaagtgcaccaccagcaccttcttgccaaacttgagccagtccagtgtgtga

SEQ ID NO: 6974 - DNA, 1190 bp, Homo sapiens
cgcatgggcagggaaagtgttttattgttatggactaataatttagaggctagggaaggaatggccttgtgtgctggcctcgttgtaacaatttttctcatgtgtcttccagcctgttcatctgtcgcgtttatttctaaaaagtcctctcacctgccctctgctgtcctcagatcccatccacggccctcacctccctcatccttctctgtaacctctgacaattctggatgacctggtccccgccatgcactttgggcttgcccctgccctgtgagtagcctgacaaccctgcacacacccctggggtggtgccagtgcctgctcctcctcctggcctccctgccacccagcccggcatgaagctgaacatcgagtgggccccaggagagaggctgagttggtatggccaggactctcccttggcccagtgggaaggtgcacctgcccacttgggagcaggcctcagcacccctcaccagtttcaggttgcccactctcaacagcagctaagtcagagctccgagggctgctccccacccaccttcagcctcccaggcctccccttgcccgcctgggccctggagacacatgcttcagccacaggcaagtctgtttcccttccatggggttttctccacaccacagcagtggtacctctgggcttctctccctggcccctgccccaaggagcccagatccagtgtggtgcttcttagactgtggtctgaggcctcctgcttatagaacaggcagattcccagacattgcctctcccctaaccaaagtttattgattctgagtctctagggctgtggcctatatttgcatttttaacaatctccctcgggactttttatgcactgagatttgaggccagggttgttctaggctgtaccggcaggtggactggaggccacagagaagaggcagagtgaaattgtgccgggcctggcttggagcacccaccagcccccggaagacaagtctcacccagagctctccggttaagcctgccgagagagaggcaccaggaggcaatctccacactctcagacaccagccgtacccaaagattgatgatttcagacaccgggcctcccggccacatcctcactgcctcactcacgcgtcacaccatagctcttggtttatgtgtttgtctcctggttacacgtgtgttcctcgag

SEQ ID NO: 6975 - DNA, 432 bp, Homo sapiens
ccctgctgtttgttccagctcagacctatatgttttgtccatttcacgctccacctcctgctctccccagattgtttcctgtaggttttgtttttgcatctgcccctgccaaagtatgtgggttgacgtggaagacctgaacactctgggagcctttgaagcaaggatggatttattcctttcaggccacagacgccatgccgaggccctggttcccctccagacctgtgcgaggtcctgagcatggcccagtgcatgctaaaatccccacccacacacagaggctgcggatccatccccgaacttcaggggcagcttctgaagtccaggccacctagaaccagggtccctagctccccttctggaacccaatcccctacatggcccaggacccaagcaaggcagggagagtgcgccgtgagtcagcagcag

SEQ ID NO: 6976 - DNA, 12473 bp, Homo sapiens
tgctgggactgctatgcatgaccttggagcactccatttgttcatcccacgagccggacagcacgtaatgggccttgccctggctgtcactcaccactcctgtcacctgtggacattggcaggaccagcgtaggtgcagactctgccctgggccccctggggtgcttagaggtggctggtcctgcttaccttccgggctgcctctttggagaagtagctgtagggcaggaacttcagctggcaccggtcattggtcttatggttcacaatctcgatgtcccctgactggcgaaggagggcagtggtcagcggccagcccccgggccatgcaccccctccccaagggcgcccctgacctggtcgatccagagcttgcccacgatgatgttgtgaacagttgaggtgctcttcctccacacgtagtgattcccactggcctggaattctaagtggatggcacctggaggcaggggacaggtcagaggtcatgcccccccatgcagggctctggccagtctgcccttaggcctggtgtcttgagaactaggctggggggttgaagaggcaggcctacagggaggtctcccttggaagcccccagctggcttttgcatcaccagaatcctccctcttatgcacaatgtctctgtgtcccaggaaggcaccgggccccagctcacctagcggcatgatggagatgtattttccccggaacttgctggagatggtgatctcctgccagaggctccagccatgcttggagaacacgtagtgcgcagctgagggggggtggtggctcacctgagaccagacccataggatgtgagcatctgccagacatgagcccaggttccacttgccccagccagggagggacagcttgccctgcctcagcaggcacagctctgtggccataggagcagtcctggctgttcctcaggtggccatggacccaaggcaggcccccaggaaggcactgccttgagcagaaaagcatccgggtgctgtcctgagcctctcagtgcctggctcctgggctgtgaaataggggtgatggtggacctcatgctcaaagacatgtctgtgacaggtgcactgagggctgataaagggtgtcacactatgccgaaggttccatgtccacttctcatctaatcctccccacacaccaggtgtgtctgctgtgccatgttataccaagggggcccagactggcagagtgattttagccaaggggcagtcgggccctgcctctggccagcctggctccagagcaggcatccacatcgatgcactgccccgggcccggccctcccctgccttgctggcagttccaccaagcctcccttgtctgttcttccttattccatgctgctctggctgtggggcccaggcttccctctcctaagtctacccactccccaggacagcagccctagcctagccctgcccctggcctccagctgcccttggacatctcatctcccctcagacaggcagagccgggatcccgctgcccgcagtgtgcctcgcctcacttcctgtctctgtaagaggtgcccacttgcttcctatgccccaggagatgggttagctggccctgagctcagctgatccctccccaaggagcccataggaagctctgcctcctcctcgcctatacctcagcatcctgcccttccagctgctcacaccaaacgctctgcagcctctctggccctcctcatgctcctcctctaaccctaagcaaacccttcctgcccttccttcaaatcgcatccagcatctgccccctccactcccacctccatctccccaggcttccctgtgggccactccctccatcgcagtggagggttcctctggcaggtcaggaggcaggccccacccggggtgcaccgccctccagctgctgcttcttcaccctcctttcctttcctcccctcactctttctgcatcagcaaagctgctccctgaccaccccctttctaaaagagctggaagcagccacagtatctgccttgctttcccagccccatgagaaccagagccgtgtctgttcacttcccagctgaaacctccatgtctgagcagcacctggcatgtcgagggcacctaatgtctgctaagtggagaaatacattcactccagggttcaggccaaggacccaagatcaccctgactgccccccacccccgtatccaaagcgtcggcaaaccagctggctcatccttcaaaagctgcctgtgttctggcctcccccttcccccaggtctggccaccacacccctgcgtgtgtcactgcagccacctcctaacggggccttgcagcagctgcagcctcttcaactagcagcagggtctgtgaatggccagcatcccacactcatgccaggagccagggcaacgccagcaccaacagaatcacctcgtttccaaccaggacgcccaggttcagcatggggctgccactgctgaggctcctgggcctgggtcttggcatatctctgtggggaaggggtggtggggacaggctgctgtcactggctggggcagagtccatcccaccgcacccaggctcctcctgccagccgccttcagctcggtagtgaccccatgctcctccccagcagtgcccacagatgcccctccacctctgctccacaacaccctggactggagcttatcctcccgctccctgcaaccaggcctgaccttgtcctcaccaagctgagttctcatgcccctcgccatctccaggaggccgtgtgcctgcccctgccatggaaggccctgctccctggctggacctcagcttgatggccccttgggtatgggcagtcagggtcagacagacgctgcctcccatttgtcaccttgggcctggcaggaacagcttggccagagtgtgggtgggcgccacccagtgccagcctagccccctcacctgctcacagagggagcgcaggcccatgtcgtcgaggcggtccagctcgaaggtctcccccagcatggggttgaagggcttggcgatgcggtgcactgtggtggagtaggaggacacagagaaggcggccaccaggcacatctgctccactgagctggtgcagtgcactgccttgtccagcaggtggtggtactccaggtcctctgtcagccgctggagcatggacaggggctcattgaagttcacctgtgggtggacaggtgggtggtcaggctgggcaccagccccggcttggcatggtgcccttgcttttctcggatgttcagggacatccctgctcagacagcaccttcacagtgaggctcctcagatggccctgtccaacagtgtggcccccaagccatcacctccctggcccctcctggctgttttctccacagcccttcccactttctggtctgctgcatcctacacacttttatcatgttcactgttgctctcctctgctcggatggacacccaccaaggccaggggttctgcctggcccactgctgtatcttgagtgcagaatcttaggaagcagtgactgaatgggcacatgagtctgtgggtggaggaagtgggtcttccccatgttgcgagctgtgatggggcccggcacaggatgggttaggcccaaggcccctatctcggtgtcacatagggcagggtcactctccccaccatgatgccatcgggtacgagtctcagcttcctcgtgttatcttgctccatcctcccagacactgaagaggacgctgtgtttctccccaccctacacatgtggacacagaggctggagatgtgaaggaacttgttctgggtcacacagcagaaccgtctggcctagtggagatgccactgtagccaggtggcatgaggatccaagctctgagcctgcatttcctggggatggcaccagggatggctgccagctgaaggagggcccacccctccacacacagccccatcctgccactccccatctacagatcgggacagctgggacatggtaaggtcctgtgagatccagaggtgctctggggctccccaggttgctgatccatgcagagcttctccctggctcctcctgtcagagcccaaagatccctgtactttggaagattgggcaatgcctatgtgcacgattagataattagttacatgctcctcaggtgccgttaagaaaatgacactccaaggctgtgtgtacttcacacaggccattactgctcatccacgcacaggaaagcagccccagaggacctgtcggggctgccctgcccgagccacccaccggcatggggatcctggagagctcccggccgatgcagttcttcatgatgctccagaggttaaggctgtagttgggcttgttgggaatgcggactcgcctcttgactttggatgaacccttgggcacgagcgaggcaccatctagtacctgccacataagtggggaccccctcaccgtcagcagaggccagagcgcccccttggcttccaagtttctgccctccaccctgaggactggcaccaagccggccactggtacgctgctggtggaaggccaggatggtgctcctggactggggcatgggcctgcctgctggcccccagttcttggtgctggcctgtccctcccaccccctaggccagaagctgccttctggcccttacagtgctccccctcacttacattgtctgctgagctccagtccacggaacttgtcccggtgctaccttcagcttttctgctggaaatacaaagcgggaggcaagttactaatgaatcccgaggtctccttgggacctggcccatcctctctccagacaacatcattttcattgctagtaaatgtcctggtcactgccgtgtgttctgtgtgtagacaggcaccgcaataacaacatttcaagggtggatagtgtatatgacagtggtcccataagactatcatatcgtatttttaatataccttttctatgtttagatacacaaatccttaaccattgtgtcacaattgcctacaatattcagtacagtcacatgttgtacaggtttgtagcccaggagctataggctgtgccatatagcccaggtgtgtggcaggctctatcagctaggtttgtgtaagtatactctatgaggctcacacaacaatgaaatcccatctggagcaagaccgatagattattgattttttgagacagggtctctctgttgcccaggctagagtgcagtggcatgaccatggctcactgcagcctccacctccctgggctcaagcgaccctcccacttcagcctcccaagtagctgggactacaggcctgcactaccatgcctggctagtttttgtattttttgtagagacagggtttcgccatgttgcccaggctggtctcaaactcttgtattcaagcaatcttcttacccttggcctcccaaagtgctgggagccactgggcctggccaaagcaagatttaaaggaaagaaaaccccaagtagacaactagatagctggtgaaaagaccagatgcagcctaagaccagggtgggggaggctctgcccagctgcagccaccttacctgtcttccttggcctcggtgatcacggtgatgaaggatgtggagtcttccatggcatcaaagtactcggtatcttcatcttcctcactgtcctctcctttgggagtcaagaggcttcctagagacacagacagagctttaatttgtaacctcacaaaaggctcaatctcgcctccctaagtccagagccaagggctcccccaacccccatctggcctcactcccctcctgcttcagtcacctgggcagccctgattccctgggctgcggccacccttgctccctctgctagaatcatgtgctttcaacgcattcaccgcacaggagcctctttctggaagcccccccgatctctcaacatgtgggtcagtctttctgtggcccagcttccctttctgatggacccctgtccagggtccccatgacccccaacccaaggctaggtgggtggccacctggcaccaggacacccctgtcacacaggggacagctgggctcattaaatttaactcttgagaatgtgaacctaggtgcagacaaactgttgccagtgggtgatggacatgggagatacaaaaccacgaagaggcagtcaagagttggccaaggccagcccacatgtgggcacagccagggatgtgcatgtgggggcgcagaagttgtgtatgcagagccagctggcagaaggtcatgggacagccctgccctggctgcccactcaccctcaatgaagctcttggaggggttggccggccggccaggggcactgtggaaggcccgctcgaggctgttgtgctgcttcgccagctgctcaatggtttcctccaagtgcacgcgctgctcctgctcatactgcagtgcccgctgccatttccgactgtgtatctctgctagttccaagaagtccctgcaggcctggggagggaggagtggcggtatgagaccctggcctctggcaggggcccatctgtcagaggcatgtgaaccagagcaactccaccttaaacaggagctgggtaagatgaggctgaaacctactgggctgcattcccagacagctaaggcattctaagtcacaggatgagatacaaaatacaggtcataaagaccttgctgataaaacaggttgcagtaaaggagccggccaaaacccatcaaaaccaaaatggcgacgagagtgacctctggtcgtcctcactgctacactcccaccagcgccacagttcacagatgccatggcaacatcaggaagtcatcctctatggtctaaaaaggggaggcatgaataatccaccccttgtttagcatatcagcaagaaataaccataaaaatgggcaacaagcagccccgggggctgctctatctatggagtagccattcttttattcctttactttcttgataaacttgctctcactttgcacagcagactcgccttgaattctttcttgtgtgagatccaagaaccctctcgtggggtctggatcaggacccctttcctataacacatctgctcccccacctccattccctgtgaggactaagctctgatattttttatcttgcccaaattcctatctaaggcgtctggggagtcatgccctaaaaaccatacattctcatcagatgggctttatttagccctatatatcgtgacttactttccaacctgactctggcataacattacgagtcaaggaagaaaaagtatttcatcccaaaacatgcttctttgccatattttgaagtggccctgcaaagctgtcctttgtgggggaaaacgtgcatctgtaaagaatctctattcacagagctagatcgttttcttccaggccctcccaaccctgaagagatgaagtaagagtcttagcacctttttaaaggtctgattaggaaacatttgtcatctattgtctccaaggggagccactataagacttaaaaagaaccttggtctccacaatctttcatcttaacctgaacatttcctttctattgatcccaggtctttagacaactcaaccaagtgccaaccagaaaatgtttaaatttacctatagcctggaaggccccctccccaccttgcttttgagctgtcccgcctttctgaaccaaaccaatgtatttcttaaatgtatttgattgctgcctcatgcctccctaaaatatataaaaccaagctgcgccccaaccaccttgggcacatgttctcaggacctcccaagagctatgtcatggctgtggtcactcatatttggctgagaataaatctcttcaaatattttgcagagtctgtttttgttgacacctgcagtgaagaaggccctgggggccatctagctgccccctctgctgggatggtcacaaacatgcttactgccccctttggcctccttggggatgtgggaaccctggccttctcagagcccgcccagcaaccagcacccaccttggttggcctcccacggtcaggatgccagttggggaacagcaaacctgggtgccacgggtctgcacgctgcctccccagcagcagctggtttggttcagcctggagctgaggtggctgctgttgctcattatggtagggcccgagcattctgcggccacgtcctccctgcagtgttaggcctcaggtttgtcactggcccttgtctaccctgggccagtccctggccgtggcacagaaggaaggaaagccacgttctgctatcctccccagctcagagaggtaattggtcttgtctggcagaagtgggactggcactttctaccaagctacatcagagtctgaatcacataactgcttttaaggttttcccttcaagcttgtggcctactgagacatccagaatcttttcagcttcccaggtccacagatggttccaccaccagttttgaagcaggggttggtcattctgccctgtcattacagtggagaggatggctcaggcttcagctgtccctggagggcagtgagatcaaatctaggaacctctggatttgccctttctggacacattcttgaagccagtaggaagggacgtttccttggcccgcatctgcatcagtggccccagctgccactccccagcacttcctccccacccaattgccccagctgacctggagcacccactgagctccatgcacatcacaggctgtcccaccccaaaggaggaagatgggcacaccagtcctcacctgtgacacagggacaaggcagctgttgaggaaatatcaggaggtgatgtggcaggcagggcgagggagcactcaacagacgtgcctcatggatcccctcccgcatctgccctggcacctggtgcccaggccacaaccactaactcccaccactcctcagacctctgcagcatcgctctcccaggcaacggcctgcccctcagtcagaaccgctcagatgcctgcccattgggtcggtctctccagcgactgtgccaggaatgcccctgaatcagcagctgctcccagacatttgctgccaagtgacacctaccggggggtgggactgacagcagtgggagcgagacgggggtgtcctgaggcggcctcaggagaacacctccaagggtgggaggctccccaaggctgtgcactggggcaccctgcctggggactcgcccaccccacagggagagcccgagctctcgtggctggcctggctcggtggaaaggggcccccagcctgccccagggatgccactccttgaacaagccctcctctgggcaccttccctcccccatctccctcaagcaccacacagggtgggcagggcaaggtgtgcctcctcatcccagagatgtgaaatggggcctggagatgcaacatggcctgcccaaggaagccagcagagtgtggtggccaggggtgcactatcaggagttggaaaacctgggttccagcagaagccccttggaccctctgagcccacatcctctctgtgagacagacggtgatgcccgacagatgctgtgcccacaagctgccctgtctccgctcatccggcaaaattctccaggtgggaggagtgcagtcacccccattggacagatgaaggtctcctccctgcaggttgaggcagggggaaaggcctcctcgaggaaagaaagaaacctccttatctcatgcgcctcatcctgatgatgtgtgagactgagtccagggtgttgaaggtctgggctattttgagttcatgggtcttataaggctgtcccttgggtgtgggactgcagtcactgtccatcatacaatttgcagaccccatagtgggcctgggtgagtcctgggagacgcagctccaggcctgactccactgctccctggcttgtgactgggagccgagcctttcaccacctggagtcctacagcggccgtcctgcttcacccacaaccctgtccctctctcactgctgtaggccttagagtgaggaccctgaaaacagactcagagacaatgtgccccagcagccagaccagatggcacctctttgctggttttgtgccagtgggtgtaagggcggtggcggaggcagggggacggtatccctctgggtgcctcaggaatgttccagacccttacagaagccccatgagttgggtagacagagactcccaccccatcccaagacagcaaagctagccctgagggcacccagcaaggaggtggcagagccagatccagaacccaggtcctcaactgagagcttgctctaacatcctacctggctgcagctcccaggaggccctcctccccacattgccctaagcttggcccagtgctctgtcaagttagtcttggttccagccacctgttcatgggctctctgacactgctgctctgctgaccctggcccatgcaggtctccaggctctgctgagctggtctcaaggctcagagtgcaagtgaggaaggacaccctcatctccctgggtgctgcttcagggaagtcccctgcatcccgggactgggagaaggggctaatcgggtcagtacagggtgaacaggatgggatcccaggtctgtctagccccagggccacctccacacaaggcacgatccccttgcctgcctgatgcaagtaggggtgcagaggccagggctgtgctgtgcatggtgagagtgaattggtgcttcatggttttctgggttcttgcctatctggctgcacaaggcctctgccccgccctccctcatccctgcaccatcacttcctgccagtctcctacagcccccagaatcatcctctccatccacaagttctcacatagatgggtgctttgttttcatatacctcatgtcatttacaagacttatgaaagagccatacaacagcagtttaaaatagtagccaaaggtcatggtaagaattcccacaaactcacatctgagggtgcctgggcttcccagcagcaaaagcaaagagggaaagatgaccagagaacaaagatgaattaggccccctacctcctacctttgctgttcacagggactctaatactttagaaatgactattttctccttcaagggaaaatggagtatttgttttttccacagatccgggcagctgatagcctctcatagaaaatggtttccaatcctctccagcctcatctcctggggctccgttccttcccagggccctgagtgtggcccaccaggtatcctgtcttcttgcctttccctggctcaaattcaaaccctcctgctgattctgatgccagccccacctccctcacaccgcgggcccactgtggggcagggcattgcaggcattcttacaagcactgaggtagattttttttttttttttatagtgtgcatgaccgaggaggaaatgaaggctcagggtgactgagggactcgcccaaggccacaaggaggtgtgtgtagggccaggatccaagtccctgagcatctcacctgcatgtcccccagggtatggaaccagtgctgttagggtttactttgtaaagccaaatcttgattgccgtctgggagccccttgagggcagggatgttgtgggatcccagagccttcctggtgtggagctaggttcctgggagatattcactaaccaggctgcctgggaataaccctgtccaagcaacagagcccagccctagcctcagggagaaggggtggcctcccagcacccttagccccagctgaggactttgtacacacagccagggttgctggctgatacactggccgtgagtgacctcagtccccctcaaggctaccaaagggccagctggcatcgtgcagcagggagacaggaagtccctaggacagctgggcctcatttgggtacatgtgcctaggctgggcacatgcaggtcgtagagtgtcacagtcacctaaaagcggggcagggtgaaaactgctgtgccctaatatcaaaggcctcatgtggctgcacccaagacctttacccccacagcacatgagctgcctggtcaccccatggatgcagagagcccgtccacctcccccagcccggatgcacccacctggtgtccatccctgactcccagggtctcctctgctgctgccggccttctccaggccccatcctggctgtgctgtggggagaggcaggcgcctggcgtggccctgctgttctcagaatgctgagctgggctgtgtgctgtgtgcttgataagctggattaggcttggggcccggcagagggactggcagggggaggttcccaggggcccagggagggcctggctgacccagcccaggcctgaacgtggtctcatttctctgaggctgtgtgacaactctacctggggccaggagactcgtgctcagctgtgagcaggaggagagacgggctgacctgaagccccctacccgc

SEQ ID NO: 6977 - DNA, 976 bp, Homo sapiens
tatccttgactaaaatcttttgctcctccctggaagctattagaattttttcttcggtcttcattttgactatagcatgatctagatgaacatttttctttatttcttgtcttcagcacgctataggccctttcagtacagggtctttcatctctttgcttttactttgggaaatttatcttcattttatctccctctttgttttttttcttcttcttcttctttccttctgggattccagctaaatgggttattttagcggttaccctaggaatcgcaataaacatacttcatacactcagaagcgaatgtgcatcttgatcctcttccagggcagcatggcgggggggcctttgagcagtttccctcccttcattcctcttcgtactgtgcagccacattctaaaatgttgtaccccacgttattcttgtttattcagctttaatttaggtgcacagtatccgttattctcagatcttccctctggggtcagtttcctcctgcctgaggtatatccttttgtgcaggtctgctggtgccaaagtaagctttttgtttgcctgaaaatgccttgatttcaccttcattctttaaagatggtctccctgggtgtataattctaggctggcagtgcatctttcaactcacggaagatatcatttgactgtcttcaagctcccatttctgttgataaggggacagctcctcggaaagtgatgtctttttaaaatctggctgcttaatagtttctctctgatttagtttcactgcatagatttaggtgcaggaatttctttgttatttttatcttcaggtacagtccctctttccttttgggactctcgctagaaatgccaaaccctgctctcaatcttgctgagcaagcttacagaaatgcagattccattgcaggaggtctgacgggagactgcactcaaactcgctcccaggagaggccagggagcctgctccagg

SEQ ID NO: 6978 - DNA, 1099 bp, Homo sapiens
gagccaccaccccagcccattatctctattgatcctcactccaaccttgcaaaataggtagcgtattccagtggagaaactgaggcacaaagaggtgaaagacctttcctgtcacagttaggaaagtggcagaagccgtatttgaaccccagcaggtctccctctgaagtccacacacgtcagcgcctctgtgttgtctctttgccagcacagggctccctggagcccagagatgggggtggtgacttgaaggggttggcaagcctgggctcctccagcgaagcattcccttggccctgggcattcctaagcgagaagaggctcaatcctattttcttctcctaattggatgccttttattcctccttcctaattgaagtctggtcattgctggttgccatggcagcagccaaagcgctcatctcactgtggcttgtctctgcctgcggccaatgggaaacctcctttcccatatacggtggggacatggagtgtcaggctgtcgtattctggtggctggaggaggagaggaagtgagatgggaggaaaaaggcctgtcctctcccacgcagagactccggacagcaggatgtgtggaatccccagtctgttttcagccaggcagcaacagcatctgtactgagttgagtctatgtgtctaccagtgggctaagaacttcatgtgcagtatctcatttaatcttcgtgatggccccaggaagataagggatcaaggcccagaaaggctaagtaagctgccaggtcatccaaggagaaaatggcaaagcctggatttgaacagagactccagcttccttatgtgtagccatctcaccatgctacttctcagggggttactatgagtgtctctcatgtccccagacccagattacaggtttggaggaatacacagcccaccttcccaatatcgcaggcaacagttccaccaaatgccctgcatggcatcacagggagcctagttgcccactgctctactgctgagctcaatgccacccagcccgggctctctcgagctagcctgcttctcaggccccactgacgtcccatggttcaccattacaaccgttcccttgcctcc

SEQ ID NO: 6979 - DNA, 1181 bp, Homo sapiens
gaaagcaggctcatttggggactgattccaagcagggttctgaagaaagagctagcccactgcgcagtggcccacctggagaggtagcagtctcctttcctgatgccagatccaagcagaggctaatgctggagaccagcgatgcccgtgggagaatccctgtagctagagggaattatctggaagtaatttatccctgtaccgccttgtggggttgggtgtttcttgcccactgcatgagttggtattactctaagagcgacagatacatgttttcacatgctttccatgtactagacactttctaggcatcagttctcaacatgacaaagagatccttctcagggaaatcagatccctcttccactgctgaaaaaccccacagtggctcccatttcacttggcataaacaccagtggccttgcagtggctgccaaggtcaaaccatctgcctttctgcttcctgctcacccttttccttcatcttctcatcttttctgtcttctccatagctcacactcccctagccacactgttctccttcctacaatgcagcacactgggcatgcttctaccccagggcccttgcaccagccgcaccatctggttgacatgcttctcccacagatacttgcttggctaactccgttgtgctctggtttttgtcaagcagtcaccttctccatgaggcccacctgggccaccatatttaacactgcagtctacactgcctctcctcccaccacccagcactcccaggccctcactctgcttcctttattttttccatttcgccagccatcttccaacacatgggaccacatccttatttattgagtgtcttgttgcaggtctctaagactgtgcctgccttgttcactgatgtatctctagcgcctacaacagggtcgggcacagagtaggagctcagtaaatacttgtggaatgaatgaatgagctcattttacctcaatcacaactccaggggtagacatggtgatttcactccattttatggttgaagctcagaagcttacggaacttgcccaaggtcacatagttagtaagtggctgagtgacgcatcaacccaaagcctgtcttactctggggtcctggatcttaaccaaaacactaagctcttccctcctccaggtgagcccctggtcctgatgcctcgagt

SEQ ID NO: 6980 - DNA, 869 bp, Homo sapiens
tgctctcgccacaggtctttctttttcaaaagcaaacagctacagtatccatcatactccagagcagccctcaaagcctgggctgttgagagtgcacatcctggcctgcggtgacagccgtcagatggtgaggggccccaggcgactgccccagcagcagggcctgggagctgcacaggggagaactcgataaggagcatcatgagcatagtgggtccattgacaacatgcagtccccacggtggtgcctaatgacaaaatgacatcatgccacctgcaaaaaaagtaaaaatgatcagaggcgagcttgtcagagaagctttgaactaggtgactgcatgaaacatctcagaggcggaagagtgcctccccctccccgggactcccacctggtgccctgagctcatcatcccttctcttgtagcatatgctgtcaatacccagggccttttcgaaacggcaatgggtccgaaggcctcgggaccacctttcacacctcccctttatgcagtgtccatacctccttggtgctcagctgctggtcagctccatgtgccctgtggtccctgccctcccaaggcctgtgaacaaatgcttagtcccagattagagtctacgtcaatctgggatgtgagctgagtggcacctgtcgtgaaccaggccagagtctacgcaatctggggtgtgagctgagtggcacctgtcgtgaacgtgcatgcacatgggcattttgtcagtctgcaccggtgaataaatgtcgctgcatttgccagctgagtgtcaccaggttccaggtcccattacacatcaggaattgtgtccgactcttctggatccgctgattggacctgagggatccctgactcgag

SEQ ID NO: 6981 - DNA, 851 bp, Homo sapiens
gtctttcttttcaaaagcgaacagtcagtatccatcatactccagagcagccctcaaagcctgggctgttgagagtgcacatcctggcctgcggtgacagccgtcagatggtgaggggccccaggcgactgccccagcagcagggcctggcacctgcacagggtagaactcgataaggagcatcatgagcatacccccccattgacaacatgcagtccccacggtggtgcctaatgacaaaatgacatcatgccacctgcaaaaaaagtaaaaatgatcagaggcgagcttgtcagagaagctttgaactaggtgactgcatgaaacatctcagaggcggaagagtgcctccccctccccgggactcccacctggtgccctgagctcatcatcccttctcttgtagcatatgctgtcaatacccagggccttttcgaaacggcaatgggtccgaaggcctcgggaccacctttcacacctcccctttatgcagtgtccatacctccttggtgctcagctgctggtcagctccatatgccctgtggtccctgccctcccaaggcctgtgaacaaatgcttagtcccagattagagtctacgtcaatctgggatgtgagctgagtggcacctgtcgtgaaccaggccagagtctacgcaatctggggtgtgagctgagtggcacctgtcgtgaacgtgcatgcacatgggcattttgtcagtctgcaccggtgaataaatgtcgctgcatttgccagctgagtgtcaccaggttccaggtcccattacacatcaggaattgtgtccgactcttctggatccgctgattggacctgagggatccctgactcgag

SEQ ID NO: 6982 - DNA, 1472 bp, Homo sapiens
tagtttaaaatacaatttaataagaaaatccgggatacattttatatgattccatttattaaagaaaaagaaacttctttccaatatattctacccaattattaaattcattttagatttttgggaagagcaaatccaacttaaaaaaaaaacttgctaggcagttgaaatcctctggttccaaagttttaaaaaatgaggcaagattgtatagtgagagtagaaaaaataagatgaagtggaatcacccatgacaatttgtcatatttgtcattacgaatttcaacatctgcaactgaaaagctacagaaatcaaaaaataaaacacaaagaagattctcaaggaccaaagactgtttgatgatgttgctctaagattttgtcctccatttatttcacacaaaaataagttaagtataaataagaagatgaggagagctggtatgtactcagatgtgttcactggtgcatagtcagagggggtgtgagaacagccaaatgtatttcttcgcccacactcactacacaaaactctcctccatgttgctgcagagtaagaaggagtccaccagccgaggctggaccaactgctgaaagtcagagtcctggaggccttcagggcagaccccagccaatctacgcagagcagcctggggagaagacagaagaggtgacacgtgtcagactgggccatgtcaggtacatgtatttccttcacctaccctgaaatgtgcatttcagaaagtggtgcatttaccagacaatttgggttgatcatcatgttagccacttggcatctcagtcaccatcttggtcacctggtcaacatagcaaccacatctcttggtcagctagctttatttgcaccttgatcactaagatagatgtcatctgaaagctgttaataatcttaataatggtctttattatttccagatccctagagtaaccttagaacagcaagaactattcattcatccataaattcagcaaggtgctatagaaagcactatggaaaaaagaggaaaagagagggagaacatattgtaaaagtagacagggattctgctactgagaaattcaacacctggcaagggggatgaacaggaaagagaggtgctggcagaataaaatcactccccagctccccacacaatgagcaatgagtatgctatttctattttgtgtccatgtgtccttgctcatattcttaatcttcagcccaatgctctacctctgagctataccccctcctccttgctcatactcttacttgtgacttgaagtgacttcctgctcctgcctattgtcacctcccccatgaaggcttccccaattatcctgaagcagagacagtccatccctccctcccctgtgcaaccagggcccctgggctgacctcaagcttctcacacttggccataactagcttttaggtatttatctcccacactagactctgagctcctcga

SEQ ID NO: 6983 - DNA, 898 bp, Homo sapiens
ccagaagagggattgctgggtcatatggtagtttaatttttttcagcaatctttgtattgttttccataatggctacaccaatttacattctcattaacagtgcaaaagggtttttgtttctctataccttgccaacttgttatctattgactttttgataataggctttgcatttgcctgatgattaatgatattgaacacattttcatatacctgttggccactttttatgtcttcttttgggaaatgtttgtttattctggtacttggcctattttttaattgggtttttgtttttttctttttgctattgattttcttaaatttttggatagtaacctgttatcagatatgtggttcacaaatattttctcctaatctgtagattgcctttccattttattgattatttcctttgctctgtagaagcttttcagtgtgatgtagtcctacttgtttgttcttgctttcattgcctgtcctatcagaaaaatcattgccaaggccaatatgtatcagcttctttcctatgttttctcctaggtgttttacagattcaagtcttatgtttaggtctttaatctgttttgagttgacttttgctcttggtgtaagataagggtccattttcatccttttgcatgtggatatccagttttcccaacactagatatgaaagagactaaactttacccattgtgtcttcttggtgcctttgtctaagacacttctatgacagttgtttctcagatgggtacttgtttacgtgattcacaacagtgaatggaaatgtttaccactcatcactccatctaacacaccttgttaagacacatgtaaaaactgttctaatagtaccagttgcaactataactgaaaatagtattattttagtaa

SEQ ID NO: 6984 - DNA, 306 bp, Homo sapiens
ttctttttttttttttcttttttttgagacggagtctcactctgtcgcccaggctggagtgcagtggtgtgatctcggctcactacaagctccacctcctaggttcacgccattctcctgcctcagcctcccgagtagctgggaccacaggcgcccgccaccacgcccagctaattttttgtatttttagtagagacgtggtttcgccatgttagccaggatggtctcaatctcttgacctcgtgatccacccgcctcagcctcccaaagtgctgggattacaggcatgagccaaggcacccggcc

SEQ ID NO: 6985 - DNA, 886 bp, Homo sapiens
cacgggaggcagaggttgcaatgagtcgagatcgtgccattgcactccagcctgggcagcagagcgagactccggctcaaaataataataataaattagagatggggtctcactattttgcccaggctggttttgaactcctgagctcaagggatcctctcgcctcagcctcccaaagcactgggatcacaggtgtgaggtgccatgcctggcccacaccagctgtgtttaatcaatgctgggcagccctgcagcttggtgacatcagtgggccactggctactgggtgttttttccatcctgccctgttccctgctggcaccaggggaaaaaggcccatacaggagtctgttccaggtcaccagatcctggggtggcccgtaaggatttgaaggggacaggaggcgcccctttgccgaggcccttcactgtgtcaggcacattgctggctgccgtgggtgcacaatcttagggaaccctcctgcctcctccgccttgctgcttccttgcaaagaaaatttcccactgcagagggcagcttaattgctcagcagtggctcttcagaatctcacagatgggccaggcgtggtggctcatgcctgtaatcccagcactttgggaggccgaggcgggcagatcatgaggtcaggacatcgagaccatcctggctaacatggtgaaaccccatgtctactaaaaatacaaaaaaattagccaggcgtggtggtgggtgcctgtagttccagctactctggaggctgaggcaggaggatcacttgagcccaggaggctgaggttgcagtgagctgtgactgcaccactgcactccagcctgggcaacagagcaagaccctatctcaaaaaaaaaaaaaaaaaaaaaaaaac

SEQ ID NO: 6986 - DNA, 103 bp, Homo sapiens
gaatggtgggaacctgggaggtggagtttgcagtgagccgagatcgcgccactgcactccagcctgggcgacagagcgagactccgtctcaaaaaaaaaaaaa

SEQ ID NO: 6987 - DNA, 11168 bp, Homo sapiens
cagactgacgacaacagtggagacttggacccaggagtcttgctgacagctcaaactatcacatctgagaccccaagcagcaccaccacaactcaaattaccaaggtaacagaccagctagaacctctttatggaacccaggggcaggctaagcttgctgccacctctctgcaagaaggaccctagtccataagcaaatattttcagctccatccctagtaagccacattattcaaagagtcctggatggaaaggccctgctgccttccccagcaataaatctagggagataccctgagagtatccctgcctacttagtagtctcctaaaggtaggtgtggttgttctctttacacatctgtctctctggtcagtgagtcccctgtctggctgtggaagtaagtttaaaaagtcagcatggccaggcatggtggcccacacctgtaatcccagcactttgggaggccaaggcaggtggatcacctgagatcaggagtacgagactagcctgaccaacatggtaaaaccccgtctctactaagaatacataaattagccgggtgtggcggcatacacctgtagtcccagctattcgggaggctgagggaggagaattgcttgaaaccaggaagcagagattacagtgagcagagattgcgccactgcactccagcctgggtgagcgagcagactctatctcaatagaaagttaacttaaggggccaggcgtggtgtaatcacacctgtaatcccagtactttgggaggctgagacaggtggatccctttagcccaggagtttgagattagccttggcaacatagtgaaacctcatctgtacaaaaaaatacaaaaaaaaaaaaaatgtgctgggcataatggcgcatgcctgtggtcccagctacttgggaggctgaggtgggaggatcacttgagcccagggcatcaaggctgcagtaagccgtgatcatgccactgcactccagcctgagtgacagagcaagaccctaaaacctatctctgtaaaaacaaaacaaaacaaaaagtcagcttcagggaaattatttttggtatttttatacaaccatattttccaagcccaaaatcagaactctgggtctgaggaagaatttttacagcattccagggacaaggccatgagaacttgtttggatgctgaaatattggaattattagaatgtagtttataggaagcaagagagagaaaatatctaaaattggaactacccccagaaaatcagaggcaatcgatgtttgctgtaacactagaggaaaatactttttttaataggtaagaaatatagcttcttgaccaagctctctcatcaatacacagatgactggaaactagttaacttaatgtgtctagaccttggttttcctcatctaccagaaagagaaatctactcaccctcaggagattatgtgaggaccttttgacatcaataatatgaaaatgctttaaaatacaagagcccagtttcaagctgtgtgacatatttgttcatagccttcagatttttttcctcttgaaaatgatcatggtggctcatgcctgtaatcccaacactttgggaggccaaggcgggcggatcacctgagatcaggagttcaagaccagcctggccaacatggcgaaaccccatctctactaaaaaaataaaaattagccgagcatggtggcacacgcctatagtcccagctactcgggaggcttaggcaggagaatcacttgaacccaagaggcggaggttgcagtgagctaagatcatgccactgcactctagcctgagcaacagagcaagactccatctcaaaaaaaaaaaaagaaaaagaaaatgatcaattaaaatgtatagcatcagtatccagtctctaaaacagaaatgtatgagagaagagcacagaaagtcctattttgtttacttgctagatttctgtggtattcaggaggaagaaaaaggagaaagtaaatacagaattgtgactttctgtttagcttaataaagattttagtaatccaggctgggcgcggtggctcacacctgtaatcccagcactttgggaggccggggcgggcagatcacgaggtcaagaggtcgagaccatcctagctgacaaaaaaccccgtctctactaaaaatagaaaaaattagccgggcgtggtggcaggctcctgtagtcccagctacttgggaggctgaggcaggagaatggtgtgaacccagtagacagagcttgcagtgagccgagatcgcaccactgtactccagcctgggcgacagagcaagactccgtctcaaaaaataaataaataaataaataaaaaagattgtagtaatcaaggctggatgtggtggctcacgcctgtaatccaagcactttgggaggctgaggtgggtggatcacaaggtcaggagtttgagaccagcctggccaacatagtgaaaccccatctctactaaaaatccaaaaattagctgggcatggtggtgcgtgcctgtagtcccatctactcaggaggctgaggcaggagaattgcttgaacccgggaggcagaggttgcagtgagccgagatcacaccactacactccagcctggacaacagagcgagactctgtctcaaaaaaaaaaaaaaacaaagattttaataatccaggggagtagaagtgtactctacaagggagtagaagtagcaggtctggttgagattttggacaagtaggttagaaagctgtcctttgcagtacccagcagtagattaaaatttggagtggagctttcggaataatctttgctatttttctttttttgtttgtttgtttgttaatagagacgaggtctcattatgttgcccaggctggtctcaaactcctggccgcaagcattcctcctatctcagcctcccaaagtgttgagattacaagtgtgaaccactaaacctggcctctttttctttttttttaattcttgttatatcgctgatctcatatgacatcttctctttggttccagactgtaaaaggtgggatttcagagacacgtattgaaaagagaattgtgatcacaggagatgctgatattgaccatgatcaggtgggaatgttgaagagatctgggcctgggaggggtccctgggcaggaagaccgatgaatacaggagtttgtttgccatcttcatctgcaaaaagcctctttggccactctagctcttaattgagaagaaagacaaagacaatcaaagtaagaggcctgtgggatggaggccacagattgaggagccaggaaatgtaatggaaagaacatgagctttggattccaagacttgattcaattgctggttcttaatatattctagctgttaactctctgggcctccattttgcatctgtaagatgaagatgatagtatctccctctcagggttgttgtgagaatcaggtgaaatactggatgaacagctggtggcacatggtgagctcagttaaatggagctattgttattccgaaggtaaaggtacctgaacccatgctagacaacatcaaaacaaagggaagcatgcccctacccttagagagctgtaacagccgagaagacacgagcgggagcatagtatggtggacaagacaccagcagactcgaaacttgttttctgccctacatctctaacttgctgtgtgaccttgggcaaatcacttttccgctgatttttttctcctttcctaaaagagagtgggttgatctagataatttctgggactgagtgctaaaattctatatttttatgttaattgggtgctaattgtgtgctgcaagcaattagcaaataataaggtcaggattaatgttcccagttctctgctgggtgaggttagaacagtaaagctgcagagaagagggggtggaagagattgcatgcaaatgcttctggaatcgttgactgggttgctggagcaataattctgtggcctttttatgctgatatgctgagtgcctttaaaaaaagaaaaactgagctacagtgctggcagttcccttggaggcagggttgagagttacagctgagaatagtggacacagggtcccagaaacaaggctgcaaagcctaaatatcttgcagcctgttggcccagctcagtgggtcccgctgctttagaagcctgcacccacccactcagtctggtgtgatctgagcccctgctacgtgctcagtctgcactagacagcaaaagcaatgtggtgaaaggtgtttgaggtttggagtgagacagacttgggctgaatcctgactctgcgacctaattggttatatgtccttgagcaacttatattaccaacctgagctctagttttaccatctgtaaaataaggatgatcacaggtttcttccagggtcataagggccaaacacacttggtagctcagagagatgctccagtgtccctcaggttttctagttactgagagtgcatggaaggggtaagctatggtacactctggctggcgagggaggcactttaagaactgttaaggagaagcagtgtggagcagcaggtttcatagagaggtgggcggaggcagagtcacaaagagaagacttgagctgggcctgaggtgtgagcagatgggttgggcaaacaggatcagggaggatggtcaggggcccacagaggtggtagttctaagaatgccattcatagagccaggagaccagaagagggttttccttcttcccttgccccttctagagatggttcttaagagccaggtgagtagtcagctggtcatttctagctgagtccttttccataggggagcctgcaaattcagagactgcagcccaaagaggatggtgtttttgctcttttgactttccctctgctctctttagcttttctaaagtaatcaaagctcctccagatcctcaaacagggaccccctcagaaactaaacaacagtgtggtaaagaggaaagtctgatcgacttgagttaaaatccctattgcacggctgggtgcgttggctcacgcctataatcccagtactttgggaggccgagcaaggtggatcacctgaggtcaggagttcgagaccagcctggccaaggtggcaaaacactgtctctactaaaaatacaaaaattagccagacgtggtcacggacacctgtaaccccagctacttgggaggctgaggcacaagaatcgcttgaacccaggaggcagaggtttcagtgagccaagatcacaccactgcactccagcctgggcagtgagactccgtctaaaaaaaaaaaaaaaaaaaaaaagtccctgtttcactacctactagctatgaaacagtaagctctttactgaaattcagtttcctcacctataaaatgcaaaaaattacattaccttaatgcactaagttgtcatgtttaagtaaaaagtaatgataatagttattatcttaataacaatatagttattaataaattataacttaatagagtttaagtaataagtaatgtacttaggctagtgcatggcatataacagtcccttgtcctcttccttcctttcttctactttggccaaggacatctcttcctttttcttgcacacttctttactttcctctcccgtcctgaacttgccacttacccatgctgaacacagatgttgttttgtcctttagattcacatcttgagtgaatcctctcagaccctccaggtataatgatagataatagataggtataatagataatataggccaggtgcagtggctcacacctgtcatcccagcactttgggaggccaagccaggtggatcatttgaggtcaggagttcgagaccagtctggccaacatggtgaaaccccatctctacaaaaaatacaaaaattagctgggcgtagtggtacacacccgtaatcccagctactcaggaggctgaagcaggagaactgcttgaacctgggaggcggaggttgcagtgagccgagattgcaccattgcactccagcctgggtgacggagcgagactccatctcaacaacaacaaaaaataaaaaaaaaataaaggatcatataacagatacagctatgacccccgaagtccctctccagttcctagaagacagcgctaaccttccctgtccctgtgttatcagtccagaagcctccctatgcaggatagggtgggtaaggtaattatcagcttggcttagcctaaagctgccctggtactgcagacaggagtattggatctgtcagaacatcagagaaatgatgaccactgccttccttcgccatcaggctattttctgcctcattgcccttgtttctgtcttttgtaggtccttgtacaagccatcaaggaggcaaaggagcagcacccagacatgtcagtgaccaaggtggtcgtccaccaggagaccgagattgctgatgagtgagctcaggtactgggcgttcctgctggggctgagggtgcccacagtcccagcctgagagggctctggatgggaccctcggacacactgggagcccatccccacaaagaggtgttcaccctgggacttgataaaggcagacgagaggctgatgtgggagatataggaaattaagtatttggctccaactaaagcagcctgtagcagtgccagcattattgggtaagaggagggacccaaacttggatataagcccccagctaccctctgagtcttcatgcatcctgctggagatccacttcaccttccccctctcttctctctactgctctgcttgctgctgtcacaggtctctcttttttttttttttttttttgagacggagtctcattctgtcacccaggcttgagtgcagtggcatgatcttagctcactgcaacctccgcctcccgggttcaaggaattctgccttagccttccaagaaggtgggactacaggcatgtgccaccatgcccagctaatttttgtatttttagtagagacggggtttcaccatgttggccaggttagtctcgaactcctgacctcaaatgatccacctggcttggcctcccaaagtgctgggctgggattacaggcatgagccaccgcgcctggccagtcacaggtatctttgagccagaacctgggaaagccagaggagaaaaaaccaagaagagcaggatcaggctgtctggagatgggtgggcatgcagagcagggaggtaatggctgaagctctgagaccagagtagagagctgggagcagggaagctgctttttgggaaccagggatccagataaattcatgcctaaaagtaattttaaaaagacttgaagaagccaccaatctcactaggtgggaccaggccctgtaaacctgctcacatccccattgtcactgatggccacaggaacttggcaatgggactaggaagctttttcctttgcaggattttaaattttgcttctttgttttctctaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaggcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccagtgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcggctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgaggattgatccacttttaaatttctcttctaccagcaacttgggaaaaattaaatatgggtgggggagacctaaactcaagtcattttctaaagtaagttacccacattgaccaaaatgcagcttcaacgttgagtaaagggatttctgagagctggccaatgccttttgccagctgcagtgagattctgcagcataggccacgataaaggaaggagagaaggggcttctcagacttatttgcagaggggcccagaactcagtatgaaggcattggcagtagtgtagctctagagggatataccccagatggctgagggaagaaagggattgaggtggtaggagttcaaggctcagtccccgtcccagatggcagtggagagtctcatcccgtggtccatcttcccagaggccccacactccatcaccagtgccgccttggagggagc

SEQ ID NO: 6988 - DNA, 12212 bp, Homo sapiens
gcagacatgcaccaccacacccggctaattttgtatttttagtagagatggggtttctccatgttggtcattctggtctcaaactccccacctcaggtgatctgcccccctcggtctcccaaagtgctgggattataggcctgagccaccgtgcccggcccctgcctcctatttctgatccattcctgtcactgactcagtgctaaggaaactatacccatccaactttcttagaaggaactttgtgcccagggaatttattttattttattttatttatttatttttagacagagtctcactctgttgcccaggctggaagtacagtggcgggatcttggctcactgcaacttccacctcccaggttcaagcatttcttctgcctcagcctcccgagtagctgggattataggcaagcaccaccacgtccggctaattttgtttttttagtagacacagggtttcactctgttggccaggctggtctcaaacccctgacctcaggtgatccacccgcctacccctcccaaagtgctaggattacaggcatgagccaccgagcatggcccaatttattttatttgttaagaggttaccctgaaaaaaaaaaaaaaaagaggttaccctggccgggtgcggtagctcacacctgtaatgccagtactttgggaggccgaggcaggcggatcacctgaggtggggagtttgagaccagcctgaccaacatggagaaaccccatctctactaaaaatacaaaattagcccggtgtggtggtgcatgcctgtaatcccagctactcaggaggctgaggcaggagaattgcttgaaaccgggaagcggaggttgcagtgagctgagatcacgccactgcattccagcctgggcgacaagagtgaaactccgtctcaaaaaaaaaaaaagaggtcattctaagggaatgagatttttgcatcagaatgtgcagctgaagagcaaagctgcagcctgcaacatttgcccagtcttcctgagaggcatgatgatgagccatgctttcttctgcagactgacgacaacagtggagacttggacccaggagtcttgctgacagctcaaactatcacatctgagaccccaagcagcaccaccacaactcaaattaccaaggtaacagaccagctagaacctctttatggaacccaggggcaggctaagcttgctgccacctctctgcaagaaggaccctagtccataagcaaatattttcagctccatccctagtaagccacattattcaaagagtcctggatggaaaggccctgctgccttccccagcaataaatctagggagataccctgagagtatccctgcctacttagtagtctcctaaaggtaggtgtggttgttctctttacacatctgtctctctggtcagtgagtcccctgtctggctgtggaagtaagtttaaaaagtcagcatggccaggcatggtggcccacacctgtaatcccagcactttgggaggccaaggcaggtggatcacctgagatcaggagtacgagactagcctgaccaacatggtaaaaccccgtctctactaagaatacataaattagccgggtgtggcggcatacacctgtagtcccagctattcgggaggctgagggaggagaattgcttgaacccaggaagcagagattacagtgagcagagattgcgccactgcactccagcctgggtgagcgagcagactctatctcaatagaaagttaacttaaggggccaggcgtggtgtaatcacacctgtaatcccagtactttgggaggctgagacaggtggatccctttagcccaggagtttgagattagccttggcaacatagtgaaacctcatctgtacaaaaaaatacaaaaaaaaaaaaaatgtgctgggcataatggcgcatgcctgtggtcccagctacttgggaggctgaggtgggaggatcacttgagcccagggcatcaaggctgcagtaagccgtgatcatgccactgcactccagcctgagtgacagagcaagaccctaaaacctatctctgtaaaaacaaaacaaaacaaaaagtcagcttcagggaaattatttttggtatttttatacaaccatattttccaagcccaaaatcagaactctgggtctgaggaagaatttttacagcattccagggacaaggccatgagaacttgtttggatgctgaaatattggaattattagaatgtagtttataggaagcaagagagagaaaatatctaaaattggaactacccccagaaaatcagaggcaatcgatgtttgctgtaacactagaggaaaatactttttttaataggtaagaaatatagcttcttgaccaagctctctcatcaatacacagatgactggaaactagttaacttaatgtgtctagaccttggttttcctcatctaccagaaagagaaatctactcaccctcaggagattatgtgaggaccttttgacatcaataatatgaaaatgctttaaaatacaagagcccagtttcaagctgtgtgacatatttgttcatagccttcagatttttttcctcttgaaaatgatcatggtggctcatgcctgtaatcccaacactttgggaggccaaggcgggcggatcacctgagatcaggagttcaagaccagcctggccaacatggcgaaaccccatctctactaaaaaaataaaaattagccgagcatggtggcacacgcctatagtcccagctactcgggaggcttaggcaggagaatcacttgaacccaagaggcggaggttgcagtgagctaagatcatgccactgcactctagcctgagcaacagagcaagactccatctcaaaaaaaaaaaaagaaaaagaaaatgatcaattaaaatgtatagcatcagtatccagtctctaaaacagaaatgtatgagagaagagcacagaaagtcctattttgtttacttgctagatttctgtggtattcaggaggaagaaaaaggagaaagtaaatacagaattgtgactttctgtttagcttaataaagattttagtaatccaggctgggcgcggtggctcacacctgtaatcccagcactttgggaggccggggcgggcagatcacgaggtcaagaggtcgagaccatcctagctgacaaaaaaccccgtctctactaaaaatagaaaaaattagccgggcgtggtggcaggcgcctgtagtcccagctacttgggaggctgaggcaggagaatggtgtgaacccagtagacagagcttgcagtgagccgagatcgcaccactgtactccagcctgggcgacagagcaagactccgtctcaaaaaataaataaataaataaataaaaaagattgtagtaatcaaggctggatgtggtggctcacgcctgtaatccaagcactttgggaggctgaggtgggtggatcacaaggtcaggagtttgagaccagcctggccaacatagtgaaaccccatctctactaaaaatccaaaaattagctgggcatggtggtgcgtgcctgtagtcccatctactcaggaggctgaggcaggagaattgcttgaacccgggaggcagaggttgcagtgagccgagatcacaccactacactccagcctggacaacagagcgagactctgtctcaaaaaaaaaaaaaaacaaagattttaataatccaggggagtagaagtgtactctacaagggagtagaagtagcaggtctggttgagattttggacaagtaggttagaaagctgtcctttgcagtacccagcagtagattaaaatttggagtggagctttcggaataatctttgctatttttctttttttgtttgtttgtttgttaatagagacgaggtctcattatgttgcccaggctggtctcaaactcctggccgcaagcattcctcctatctcagcctcccaaagtgttgagattacaagtgtgaaccactaaacctggcctctttttctttttttttaattcttgttatatcgctgatctcatatgacatcttctctttggttccagactgtaaaaggtgggatttcagagacacgtattgaaaagagaattgtgatcacaggagatgctgatattgaccatgatcaggtgggaatgttgaagagatctgggcctgggaggggtccctgggcaggaagaccgatgaatacaggagtttgtttgccatcttcatctgcaaaaagcctctttggccactctagctcttaattgagaagaaagacaaagacaatcaaagtaagaggcctgtgggatggaggccacagattgaggagccaggaaatgtaatggaaagaacatgagctttggattccaagacttgattcaattgctggttcttaatatattctagctgttaactctctgggcctccattttgcatctgtaagatgaagatgatagtatctccctctcagggttgttgtgagaatcaggtgaaatactggatgaacagctggtggcacatggtgagctcagttaaatggagctattgttattccgaaggtaaaggtacctgaacccatgctagacaacatcaaaacaaagggaagcatgcccctacccttagagagctgtaacagccgagaagacacgagcgggagcatagtatggtggacaagacaccagcagactcgaaacttgttttctgccctacatctctaacttgctgtgtgaccttgggcaaatcacttttccgctgatttttttctcctttcctaaaagagagtgggttgatctagataatttctgggactgagtgctaaaattctatatttttatgttaattgggtgctaattgtgtgctgcaagcaattagcaaataataaggtcaggattaatgttcccagttctctgctgggtgaggttagaacagtaaagctgcagagaagagggggtggaagagattgcatgcaaatgcttctggaatcgttgactgggttgctggagcaataattctgtggcctttttatgctgatatgctgagtgcctttaaaaaaagaaaaactgagctacagtgctggcagttcccttggaggcagggttgagagttacagctgagaatagtggacacagggtcccagaaacaaggctgcaaagcctaaatatcttgcagcctgttggcccagctcagtgggtcccgctgctttagaagcctgcacccacccactcagtctggtgtgatctgagcccctgctacgtgctcagtctgcactagacagcaaaagcaatgtggtgaaaggtgtttgaggtttggagtgagacagacttgggctgaatcctgactctgcgacctaattggttatatgtccttgagcaacttatattaccaacctgagctctagttttaccatctgtaaaataaggatgatcacaggtttcttccagggtcataagggccaaacacacttggtagctcagagagatgctccagtgtccctcaggttttctagttactgagagtgcatggaaggggtaagctatggtacactctggctggcgagggaggcactttaagaactgttaaggagaagcagtgtggagcagcaggtttcatagagaggtgggcggaggcagagtcacaaagagaagacttgagctgggcctgaggtgtgagcagatgggttgggcaaacaggatcagggaggatggtcaggggcccacagaggtggtagttctaagaatgccattcatagagccaggagaccagaagagggttttccttcttcccttgccccttctagagatggttcttaagagccaggtgagtagtcagctggtcatttctagctgagtccttttccataggggagcctgcaaattcagagactgcagcccaaagaggatggtgtttttgctcttttgactttccctctgctctctttagcttttctaaagtaatcaaagctcctccagatcctcaaacagggaccccctcagaaactaaacaacagtgtggtaaagaggaaagtctgatcgacttgagttaaaatccctattgcacggctgggtgcgttggctcacgcctataatcccagtactttgggaggccgagcaaggtggatcacctgaggtcaggagttcgagaccagcctggccaaggtggcaaaacactgtctctactaaaaatacaaaaattagccagacgtggtcacggacacctgtaaccccagctacttgggaggctgaggcacaagaatcgcttgaacccaggaggcagaggtttcagtgagccaagatcacaccactgcactccagcctgggcagtgagactccgtctaaaaaaaaaaaaaaaaaaaaaaagtccctgtttcactacctactagctatgaaacagtaagctctttactgaaattcagtttcctcacctataaaatgcaaaaaattacattaccttaatgcactaagttgtcatgtttaagtaaaaagtaatgataatagttattatcttaataacaatatagttattaataaattataacttaatagagtttaagtaataagtaatgtacttaggctagtgcatggcatataacagtcccttgtcctcttccttcctttcttctactttggccaaggacatctcttcctttttcttgcacacttctttactttcctctcccgtcctgaacttgccacttacccatgctgaacacagatgttgttttgtcctttagattcacatcttgagtgaatcctctcagaccctccaggtataatgatagataatagataggtataatagataatataggccaggtgcagtggctcacacctgtcatcccagcactttgggaggccaagccaggtggatcatttgaggtcaggagttcgagaccagtctggccaacatggtgaaaccccatctctacaaaaaatacaaaaattagctgggcgtagtggtacacacccgtaatcccagctactcaggaggctgaagcaggagaactgcttgaacctgggaggcggaggttgcagtgagccgagattgcaccattgcactccagcctgggtgacggagcgagactccatctcaacaacaacaaaaaataaaaaaaaaataaaggatcatataacagatacagctatgacccccgaagtccctctccagttcctagaagacagcgctaaccttccctgtccctgtgttatcagtccagaagcctccctatgcaggatagggtgggtaaggtaattatcagcttggcttagcctaaagctgccctggtactgcagacaggagtattggatctgtcagaacatcagagaaatgatgaccactgccttccttcgccatcaggctattttctgcctcattgcccttgtttctgtcttttgtaggtccttgtacaagccatcaaggaggcaaaggagcagcacccagacatgtcagtgaccaaggtggtcgtccaccaggagaccgagattgctgatgagtgagctcaggtactgggcgttcctgctggggctgagggtgcccacagtcccagcctgagagggctctggatgggaccctcggacacactgggagcccatccccacaaagaggtgttcaccctgggacttgataaaggcagacgagaggctgatgtgggagatataggaaattaagtatttggctccaactaaagcagcctgtagcagtgccagcattattgggtaagaggagggacccaaacttggatataagcccccagctaccctctgagtcttcatgcatcctgctggagatccacttcaccttccccctctcttctctctactgctctgcttgctgctgtcacaggtctctcttttttttttttttttttttgagacggagtctcattctgtcacccaggcttgagtgcagtggcatgatcttagctcactgcaacctccgcctcccgggttcaaggaattctgccttagccttccaagaaggtgggactacaggcatgtgccaccatgcccagctaatttttgtatttttagtagagacggggtttcaccatgttggccaggttagtctcgaactcctgacctcaaatgatccacctggcttggcctcccaaagtgctgggctgggattacaggcatgagccaccgcgcctggccagtcacaggtatctttgagccagaacctgggaaagccagaggagaaaaaaccaagaagagcaggatcaggctgtctggagatgggtgggcatgcagagcagggaggtaatggctgaagctctgagaccagagtagagagctgggagcagggaagctgctttttgggaaccagggatccagataaattcatgcctaaaagtaattttaaaaagacttgaagaagccaccaatctcactaggtgggaccaggccctgtaaacctgctcacatccccattgtcactgatggccacaggaacttggcaatgggactaggaagctttttcctttgcaggattttaaattttgcttctttgttttctctaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaggcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccagtgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcggctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgaggattgatccacttttaaatttctcttctaccagcaacttgggaaaaattaaatatgggtgggggagacctaaactcaagtcattttctaaagtaagttacccacattgaccaaaatgcagcttcaacgttgagtaaagggatttctgagagctggccaatgccttttgccagctgcagtgagattctgcagcataggccacgataaaggaaggagagaaggggcttctcagacttatttgcagaggggcccagaactcagtatgaaggcattggcagtagtgtagctctagagggatataccccagatggctgagggaagaaagggattgaggtggtaggagttcaaggctcagtccccgtcccagatggcagtggagagtctcatcccgtggtccatcttcccagaggccccacactccatcaccagtgccgccttggagggagc

SEQ ID NO: 6989 - DNA, 4804 bp, Homo sapiens
aggtccttgtacaagccatcaaggaggcaaaggagcagcacccagacatgtcagtgaccaaggtggtcgtccaccaggagactgagattgctgatgagtgagctcaggtactgggcgttcctgctggggctgagggtgcccacagtcccagcctgagagggctctggatgggaccctcggacacactgggagcccatccccacaaagaggtgttcaccctgggacttgataaaggcagacgagaggctgatgtgggagatataggaaattaagtatttggctccaactaaagcagcctgtagcagtgccagcattattgggtaagaggagggacccaaacttggatataagcccccagctaccctctgagtcttcatgcatcctgctggagatccacttcaccttccccctctcttctctctactgctctgcttgctgctgtcacaggtctctcttttttttttttttttttttgagacggagtctcattctgtcacccaggcttgagtgcagtggcatgatcttagctcactgcaacctccgcctcccgggttcaaggaattctgccttagcctcccaagaaggtgggactacaggcatgtgccaccatgcccagctaatttttgtatttttagtagagacggggtttcaccatgttggccaggttagtctcgaactcctgacctcaaatgatccacctggcttggcctcccaaagtgctgggctgggattacaggcatgagccaccgcgcctggccagtcacaggtatctttgagccagaacctgggaaagccagaggagaaaaaaccaagaagagcaggatcaggctgtctggagatgggtgggcatgcagagcagggaggtaatggctgaagctctgagaccagagtagagagctgggagcagggaagctgctttttgggaaccagggatccagataaattcatgcctaaaagtaattttaaaaagacttgaagaagccaccaatctcactaggtgggaccaggccctgtaaacctgctcacatccccattgtcactgatggccacaggaacttggcaatgggactaggaagctttttcctttgcaggattttaaattttgcttctttgttttctctaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttgggacttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcaggggcccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaactctctctgtgaggattgatccacttttaaatttctcttctaccagcaacttgggaaaaattaaatatgggtgggggagacctaaactcaagtcattttctgaagtaagttacccacattgaccaaaatgcagcttcaacgttgagtaaagggatttctgagagctggccaatgccttttgccagctgcagtgagattctgcagcataggccacgataaaggaaggagagaaggggcttctcagacttatttgcagaggggcccagaactcagtatgaaggcattggcagtagcgtagctctagagggatataccccagatggctgagggaagaaagggattgaggtggtaggagttcaaggctcagtccccgtcccagatggcagtggagagtctcatcccgtggtccatcttcccagaggccccacactccatcaccagtgccgccttggagggagc

SEQ ID NO: 6990 - DNA, 661 bp, Homo sapiens
acctcccagtcttaggggcccttgcccaccactttcttgggtttgccaagacactgggtacatctcccagtcaccctggcctggacctccagccctgttagggctaaggccacttacagaggctgaagaaattcctgaggcgagtcctccacaccccacagtgaaacgcaccctctccagctcactgagccctggtgcagctggcatttctctgcccgcatgcaggtcaggatgcccttcacagctgctgtggtcagagcatccatccccagcctgggatgtgactgaaacatctattagacgttgggactcctggtcctttggtcctattagcatggtccatgctgcagcctcagagcaggctgtctcccctctcttcagacccgggcccccaagtcccctcctcctcccaatttggcatagcccccaagactgaggcggtccagccgtggccagcttcggtgagcacagtcccgagctgctggggccccaaggaggagctccccaaggcccagatccagagacttggaatgttcaatgcaggagccagacggctgcacggtgatgatcacatggccagtctgcgtccgtggaccccagggtgggggcagcccggggcccttcagcgggtagctgttgagcaaggcaggtaaccccaagc

SEQ ID NO: 6991 - DNA, 124 bp, Homo sapiens
gcggatcacctgaggtggggagtttgagaccagcctgaccaacatggagaaaccccatctctactaaaaatacaaaattagcccggtgtggtggtgcatgcctgtaatcccagctactcaggag

SEQ ID NO: 6992 - DNA, 661 bp, Homo sapiens; identical to SEQ ID NO: 6990

SEQ ID NO: 6993 - DNA, 518 bp, Homo sapiens
cctggctttttttttttttttttttttttttgagacagagtctcgctctgtcgcccaggctgaagggcagtggcgcgatctcggctcactgcaagctccgcctcccaggtttacgccattctcctgcctcagcctcccaagtagctgggactacaggtgcctgccaccacacctggctaattttttgttttttagtagagacggggtttcaccgtgttagctaggatggtctcgatctcctgacctcgtgatccacccgcctcggcctcccaaagtgctgggattacaggcgtgagccaccgtgcctggccccggctaatttttttgtatttttagtagagatggggcttcgccatgttggccaggctggtctcaaactcctgacctcaagtgatcagcccgcctcagcctcccaaagtgctaggactataggtgtgagccaccaagcccggcctgtgaaccaacttttatcaccttctccagttccagaaactaaataataatttggatagtttacc

SEQ ID NO: 6994 - DNA, 661 bp, Homo sapiens; identical to SEQ ID NO: 6990

SEQ ID NO: 6995 - DNA, 875 bp, Homo sapiens
gacctcatcttaatgaattaagtctgggaatataattatgtctgggaatataatagagaagactctatttcctgtgttctgggtgagtatgaacttttgggggatactaacttactatatactcactaggttaatctatgctaaatacccaacaggaaggcagctgtagggaaaagcaagagtatgaaacctggaaaaacaattgccagactctgctgcttgtgggtatgtggccgtgggtaaggtagttgctctgtgctttcagcttcctcatgtacaaaattgagataataatgatgcccactttgtggaattcttgtaaagatgaaaagattccaaatatgtaaagtgcatagaacaatccccagcaaaaagtggaacatgttagtgataattgctgtcatagtcggtcttcttgcttagtaggcctgagataaaactttctcctatttcatccctcctcctccctcttcctgattttacatgttatttagttgtttctccctctcactataattatttgtgagaagttacaagagttatactatggtagagcagacaggctttgcacaccttcagggtcagttctggaccaaaccactcagaaaccactgcacggatgaatggctggagattgtggggcctattgtgtctccaggtggctgtggttacatgggatccctggaatgttaattaattttcatatttccctttaaggtacttctgtggctcaaacaatgaatttctgagttaggtcccaaagtggcatttttgtttgccaacaccctcataggaaactgtattagaagctttcttgtaatatttaagagcctttaaaagagcgagactccgtctccaaaaaaaacaaaaaaaaa

SEQ ID NO: 6996 - DNA, 524 bp, Homo sapiens
caagaaatgccttctgtctcagggaagcccttaccagaacctctaggtagagttagaggctaactccacggcaccctagagtccatagcatgttgttatcatgtgtgtatcgttgcatgtaaaaatattcctatttgttacggtttgcttgtatgtgtttgtcattaatctattaattcattcagtgaagagatgccaacttgtatactagcctgggaaacctctgtgtcctcagtgcctaatttaatactcctttttctatctagtagtaaaatgaatatgaatgtacatgtctgaggtctctataaattaaaaggtaaaaagtcttaagccaggtgtggtggcatgcacctgtattcgcagatatttgggaggttgaggtgggagcattgcttgaggccagaagtttgaggctgtagtgtgcaatgctcttacctgtgaatagccatggccctccaacatgggcaatgcagtgagaccctgtctttaaaaaaaaaaaaaaaaaaaaaaaaaaaaagaaaaaa

SEQ ID NO: 6997 - DNA, 561 bp, Homo sapiens
gaatcatcagagatgaaactgtttgagagactcatgtgaccttacgaaaattacaacagcagtcttaaagtatgaaaaagatgcatcacagcagagacattatggcccagttgatatcaaatgtaaaatgtaaatgcatgtaaatgcacacttcattttatgtattatttagtaatttgcagtggtatgtgtttaatatttttgctacctacacattaggcaaaaaaaagatgtaaataatttgggagaaaaagaggaagaacagtgtaaaataaaactttctataagtactccatttcaatgtgttcaacatcatcctaaaaggcaagattttcccacgcaggtgacaaggtggtttatgtactatttaagggcggaaggtgcgtgcccgttcaataagcatgttttttgccaggtaggaaatatgttccatatctttacttatcattgcatttcagatgggaactagaaaaactggagagaaaaatgtaatgaaactgctgctgtaaattattccttttagcatgtattcacttgctaaatacacatttcttcaaaata

SEQ ID NO: 6998 - DNA, 561 bp, Homo sapiens; identical to SEQ ID NO: 6997

SEQ ID NO: 6999 - DNA, 561 bp, Homo sapiens; identical to SEQ ID NO: 6997

SEQ ID NO: 7000 - DNA, 1741 bp, Homo sapiens
gaaaaatggaatacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattccgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggtaaaagactaaaattcaagatttgcttccttcattgtcctaagacgattcgttgagaatcactgactttgagatatttaaaactttcagcattatactgtggtttcttttgcactgcactcacctattcaggactcctcccccaggttcctcatcatgcacaaaaatgcaaagaaaacatcttattagtaattaatgaagcaacattgaaattctaactctagctgtctttggattctaattaactcagcatcaatttctcacctcagactacagtgaatttttatttcctatcagctgaaatatttcacagatggaagctcatgtttcagttttaatgactgccttgaataaacaagttgttgccacttgtttcaaacaaaagcctaaaaataatctacattcaattttaggctccattgactaatatggtgttgcttttggaagtactgtatatcctcacatggaagccaaattgttaaattatttgaaggacacaccactgtacagaaagtagtgtttcaaatataaatcgaagaacaaagagtgctccaaaaaataggtcattcttttattttcataaagtatctaaactgtactaacattcagtgttgtgtttcattctaaatttgcagctgaaataaatttatttgcgatagcagaaatatcttattattcatcctcagaaataaaggatttgaagggatagagattatatgataaatttatagaagactttcagaatttgaatgcattttgtttagtgttatgaaatgacaatagaaaaaagtctcgacttcaattaaaagttacacaaacaaacaaatctacaggcatgtctttatataccatc

SEQ ID NO: 7001 - DNA, 354 bp, Homo sapiens
ctgggttctatatttatggtgatgatgtgaatttttatgccctttaaattaagtattgttctttttaatgtcatacctaaaaaggaaatgtagggataaatttttataatgtgtcattttcataatcagtttggttttattcaggatccacaaagatgtcagatgactgttattgaaattgcttatcttaaaggtcacagacaagcattttattaatatggagccactagtataatatgttaaaatctttgttttattagctcattttaaaacacaatttccattcaatttaatgaaactgtatcaggtttcatggtttcaaagacagacttaaataggattcaacacccccgt

SEQ ID NO: 7002 - DNA, 1741 bp, Homo sapiens
gaaaaatggaatacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattctgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggtaaaagactaaaattcaagatttgcttccttcattgtcctaagacgattcgttgagaatcactgactttgagatatttaaaactttcagcattatactgtggtttcttttgcactgcactcacctattcaggactcctcccccaggttcctcatcatgcacaaaaatgcaaagaaaacatcttattagtaattaatgaagcaacattgaaattctaactctagctgtctttggattctaattaactcagcatcaatttctcacctcagactacagtgaatttttatttcctatcagctgaaatatttcacagatggaagctcatgtttcagttttaatgactgccttgaataaacaagttgttgccacttgtttcaaacaaaagcctaaaaataatctacattcaattttaggctccattgactaatatggtgttgcttttggaagtactgtatatcctcacatggaagccaaattgttaaattatttgaaggacacaccactgtacagaaagtagtgtttcaaatataaatcgaagaacaaagagtgctccaaaaaataggtcattcttttattttcataaagtatctaaactgtactaacattcagtgttgtgtttcattctaaatttgcagctgaaataaatttatttgcgatagcagaaatatcttattattcatcctcagaaataaaggatttgaagggatagagattatatgataaatttatagaagactttcagaatttgaatgcattttgtttagtgttatgaaatgacaatagaaaaaagtctcgacttcaattaaaagttacacaaacaaacaaatctacaggcatgtctttatataccatc

SEQ ID NO: 7003 - DNA, 354 bp, Homo sapiens; identical to SEQ ID NO: 7001

SEQ ID NO: 7004 - DNA, 1102 bp, Homo sapiens
gacccttgatagcttttctagtaccatgtggatttctagagaagggaatattcccagaggaaacaggggcaccaaacaacaaatatcaagtatacatgttaagacaggtttttttcttcccgctatgtttagggccagtaagaggtctcttaaggacagtcagtgtgattgaagggttatacagttttcagctttgaacagtattggatcaaaattgattttgcttttaatattgacatctattattgctcagtgatggatatactgcgttggtgggtatattgtagcagatactgttacttcttctttttatatgtttaaagtatttcataattttaataaaatagaaaattaactttgctttgatttaagttggtgaataataacaaatatttgggttataatttccctttagtattaagttagctgtagaaatggtgttgtatctgacctagtaacccatttgactttttaaagatgaattactaaatttttttaatgatatgaaaaaatgtaatttgctccctttacctcttatcaatatatttatgataccataggtacctgcaaggtgtggagttacagtccgagacagtctaaagaaagcactgatgatgagaggtctaatcccagagtgctgtgctgtttacagaattcaggatgggtatggtttgtatgtgacgtgaaattttgtttaaaaagaaaatcacacattaaactttgaagttttcttaggatctttaccaaaacctagggaattgaaagtgtactttaggaaaaagtattaaaataatactaagttagcctgaagaaatactgtaggccatatgaggagttaaataattgtatatgactgtagggtttgttactttgatcaaatgattttatttggaatttgagattcttacaatttttgaaccattcagagtgtgatttatttggataatagactcttacccccctcccatttttaatacaaactcatagtttcacaaaaggtatatcaaaattaacattttatattgacctacttttctttcagaaagtgtctaacattgttccaagaccctcacattttgaatcctctttaaaaaaaaaaaaa

SEQ ID NO: 7005 - DNA, 3919 bp, Homo sapiens
cacttttagtacagcatttccaggaactatgtatcagcatataaaaatgcacagaaggattctcggacatctatctgctgtttactgtgtagcatttgataggacaggacatagaatctttacagtgagtaaaaattttaaacttgatttgatgtcatctagagtactttagtgtgcttcagaatcatctaggaaatcttagtttctgtttcccatcctcagagattttgactcagtaggtatggtgtgggtctcacgaatttgtatttttaataagtgcttcagctgaagataggactctgtgctgttttgaaagacagtgatttagagtagtcgttcttaaatgtgatatttaaggatgcttaaaaatagacatacctggccgggcgcggtggctcacgcctgtaatcccagcactttgggcggccgagacaggcggatcacgaggtcaggagatcgagaccatcctggctaacacggtgaaaccccatctctactaaaaatacagaaaaattagccgggtgtggtggtgggcgcctgtagtcccagctactcgggaggctgaggtaggagaatggcgtgaacctgggaggtggagcttgcagtgtgcagaaatcgccccactgctctccagcctgggcgacagagcgagattccgtctcaaaaaaaaaaaaaaaaaaaaaaaaaaaaacatagacatacctaacactttccctctagcacattctagacttactgaattagattacattgtaattaaatatatgtattaactgtaaaccccccaaaataaaaagctcctcagacctctacaagtgattcatgttcacattaatcactggttcaggaaaatgggttgattataaaataacccattagtgttcaagtaagtattaaaaacctatctgaaaaaatttggaatttatcattttaatgttttaagcgtaagttaggagaggtgagaagtttaactttcattttgtgggtgtaaaattcaagagtagataatcaaatgtttcttgaatgggtgctggctagtactgtaaacttgagactgtgttcgtgaggaggctattcccaccacttttgtttgtttttgggattgccacttagtcctgtttctcacactatgaagtatagatctgttccaacattcatcacattcatcacattatatagcttgatgtgaatagactttttttttttttttttgagacggagtctcactctgtcacctaggctggagtgcagtggcgcaatctccgctcactgcaagctctgtctcctgggttcacacaattctcctgcctcagcctcttcagtagttgggactacaggtgccagccaccacgcccggctaattttttgtattttttagtagaaaggtttcactgccttagccaggatggtctcgatctcctgaccttgtgatccgcccacctgggcctcccaaagtgttgggattacaggcgtgagccactgtgcctggcctagactaacatttaaccattgttagttgatataagagagccgtgaactttgagttggacttactactttgcagagaacttgggggaaaatagtattggtaatggagtctgacccgtagaaatgataactcggcagtatctttatgtagactgtctttgccttaaagaaaaatactattattccataggtgttctgaccatagtcataatttattacataaataagagagtattctatagttggaaagagttaaagttaatttggatggcatataaaaggtattcttttaatatttaaaagatttgctgtactaacattaatttttggatatattttttcttagggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacaggtaaacttgtagcttagtgggcacattcctatatgtattttcacctttttctttaaaacagtttctttggaattgagaaatagtaagatgtgtattagttatgttttaagtaagagaagtgataatcattcatacaaatcatacaaatcatggaaggctgatgaaatgaagatctaatgcatatttacatgaaggcttattgatattttggggtttatggttgaactggatgagtgtcaattagaaactggtgatagattaattatttttcaactttaaaacttgtggattttgctaagttgatttttttttttttttgagactgagtcttgttctgttgcccaggctggagtgcagtggtgtgatctcagctcgctgcaacctctgcctcctgggttcaagcgattcttgtgcctcagcctcccgagtagctagaattacaggtgtccaccaccacacccggctaatttttgtatttttagtagagacagggtttcaccatgttgggcaggctggtctcgaactcctgaccaagtaacctgcccggctcagcctcccaaagtgctgggattacaggcgtgagccaccgtgccgcttagttgatttaatttaccaaaatatttaaagtttttttcacaataagcagaggataattttgaacctatacagagtagacagaattgtataaacccctatgtatctgtcaacccatggccaattctttcctaactgcttcatcttgtacctaaagcgaatcctaggttttatataatttcttctgcaaatatttcattctgtatttctaaaagataaggattcccctccccactttttttcatagtgacggttatgatggaaggaaaagattcctttttaaaaaaactgcaacaccattatcacactatttattgatgttcaagtttccagttgtctcataatggtattttatttaggttgtttgaatcaggagcaaaacgaagcctgcatgttacaattggttgctgtagaataaaagaaacttaaaatataaatttcacctatctatgcagtttaaaaaaaattcgcttgcagtttcttcgttgaaggacctaggttatctatagtttccccacagtttggatgttgcccattgtatcctgttggagtagtttaatatgttcctctgtatttctgttaagttggttattggatgtagagcagtggttctctttaatgtgcatgagaatcacctggagggcttgattaaaacattgttaggcactactcccaaagtttctgatttcaaaacgtctggggcgagggtatgagtatttcatcactgatagagaattgatcatcttgggatgtaagttcttccatcagaaggcacaaaatgtctagtgttttttgtattactcactgatgatcattgccttacatccgttagttattagggacagaaaatgttactcttactagtgcacggttcttggctgtcagtgtaacagaaattaataggaggctaggcagacttcccagacaagatttattaagacttatgctgagatttattaagacttgtgcctagcgatggctcatgcctataatcccagcactttagggaggctgaggtgggaggatcacttgagctcacaggtttgagacccggcctgggcaacttagtgagacccccccccccacccccacccaccccccacaaaaaatagtttggcaaggtagcacacgcctgtagtctcggtactcctgaggttgagggaggattgcttgagccaggaggttgaggctgcagtgagccgttatcgcaccagtgcattccagcctgggtgacaaagtgagactgcctcaaaaaataaaaataaaaaa

SEQ ID NO: 7006 - DNA, 3919 bp, Homo sapiens
cacttttagtacagcatttccaggaactatgtatcagcatataaaaatgcacagaaggattctcggacatctatctgctgtttactgtgtagcatttgataggacaggacatagaatctttacagtgagtaaaaattttaaacttgatttgatgtcatctagagtactttagtgtgcttcagaatcatctaggaaatcttagtttctgtttcccatcctcagagattttgactcagtaggtatggtgtgggtctcacgaatttgtatttttaataagtgcttcagctgaagataggactctgtgctgttttgaaagacagtgatttagagtagtcgttcttaaatgtgatatttaaggatgcttaaaaatagacatacctggccgggcgcggtggctcacgcctgtaatcccagcactttgggcggccgagacaggcggatcacgaggtcaggagatcgagaccatcctggctaacacggtgaaaccccatctctactaaaaatacagaaaaattagccgggtgtggtggtgggcgcctgtagtcccagctactcgggaggctgaggtaggagaatggcgtgaacctgggaggtggagcttgcagtgtgcagaaatcgccccactgctctccagcctgggcgacagagcgagattccgtctccaaaaaaaaaaaaaaaaaaaaaaaaaaaacatagacatacctaacactttccctctagcacattctagacttactgaattagattacattgtaattaaatatatgtattaactgtaaaccccccaaaataaaaagctcctcagacctctacaagtgattcatgttcacattaatcactggttcaggaaaatgggttgattataaaataacccattagtgttcaagtaagtattaaaaacctatctgaaaaaatttggaatttatcattttaatgttttaagcgtaagttaggagaggtgagaagtttaactttcattttgtgggtgtaaaattcaagagtagataatcaaatgtttcttgaatgggtgctggctagtactgtaaacttgagactgtgttcgtgaggaggctattcccaccacttttgtttgtttttgggattgccacttagtcctgtttctcacactatgaagtatagatctgttccaacattcatcacattcatcacattatatagcttgatgtgaatagactttttttttttttttttgagacggagtctcactctgtcacctaggctggagtgcagtggcgcaatctccgctcactgcaagctctgtctcctgggttcacacaattctcctgcctcagcctcttcagtagttgggactacaggtgccagccaccacgcccggctaattttttgtattttttagtagaaaggtttcactgccttagccaggatggtctcgatctcctgaccttgtgatccgcccacctgggcctcccaaagtgttgggattacaggcgtgagccactgtgcctggcctagactaacatttaaccattgttagttgatataagagagccgtgaactttgagttggacttactactttgcagagaacttgggggaaaatagtattggtaatggagtctgacccgtagaaatgataactcggcagtatctttatgtagactgtctttgccttaaagaaaaatactattattccataggtgttctgaccatagtcataatttattacataaataagagagtattctatagttggaaagagttaaagttaatttggatggcatataaaaggtattcttttaatatttaaaagatttgctgtactaacattaatttttggatatattttttcttagggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacaggtaaacttgtagcttagtgggcacattcctatatgtattttcacctttttctttaaaacagtttctttggaattgagaaatagtaagatgtgtattagttatgttttaagtaagagaagtgataatcattcatacaaatcatacaaatcatggaaggctgatgaaatgaagatctaatgcatatttacatgaaggcttattgatattttggggtttatggttgaactggatgagtgtcaattagaaactggtgatagattaattatttttcaactttaaaacttgtggattttgctaagttgatttttttttttttttgagactgagtcttgttctgttgcccaggctggagtgcagtggtgtgatctcagctcgctgcaacctctgcctcctgggttcaagcgattcttgtgcctcagcctcccgagtagctagaattacaggtgtccaccaccacacccggctaatttttgtatttttagtagagacagggtttcaccatgttgggcaggctggtctcgaactcctgaccaagtaacctgcccggctcagcctcccaaagtgctgggattacaggcgtgagccaccgtgccgcttagttgatttaatttaccaaaatatttaaagtttttttcacaataagcagaggataattttgaacctatacagagtagacagaattgtataaacccctatgtatctgtcaacccatggccaattctttcctaactgcttcatcttgtacctaaagcgaatcctaggttttatataatttcttctgcaaatatttcattctgtatttctaaaagataaggattcccctccccactttttttcatagtgacggttatgatggaaggaaaagattcctttttaaaaaaactgcaacaccattatcacactatttattgatgttcaagtttccagttgtctcataatggtattttatttaggttgtttgaatcaggagcaaaacgaagcctgcatgttacaattggttgctgtagaataaaagaaacttaaaatataaatttcacctatctatgcagtttaaaaaaaattcgcttgcagtttcttcgttgaaggacctaggttatctatagtttccccacagtttggatgttgcccattgtatcctgttggagtagtttaatatgttcctctgtatttctgttaagttggttattggatgtagagcagtggttctctttaatgtgcatgagaatcacctggagggcttgattaaaacattgttaggcactactcccaaagtttctgatttcaaaacgtctggggcgagggtatgagtatttcatcactgatagagaattgatcatcttgggatgtaagttcttccatcagaaggcacaaaatgtctagtgttttttgtattactcactgatgatcattgccttacatccgttagttattagggacagaaaatgttactcttactagtgcacggttcttggctgtcagtgtaacagaaattaataggaggctaggcagacttcccagacaagatttattaagacttatgctgagatttattaagacttgtgcctagcgatggctcatgcctataatcccagcactttagggaggctgaggtgggaggatcacttgagctcacaggtttgagacccggcctgggcaacttagtgagacccccccccccacccccacccaccccccacaaaaaatagtttggcaaggtagcacacgcctgtagtctcggtactcctgaggttgagggaggattgcttgagccaggaggttgaggctgcagtgagccgttatcgcaccagtgcattccagcctgggtgacaaagtgagactgcctcaaaaaataaaaataaaaaa

SEQ ID NO: 7007 - DNA, 237 bp, Homo sapiens
ctggtcacttaaatagatttggtgtgaaattttatgataaaaggtgacttttgttctagtcagtattctcaaagaaaagagagtgagtagctattttgggatgaagatagttataactgagatagcggtttttgtttttgttttttgtttttggcccaggcggagtgctgtggtgcagtcatggctcactgtaacctcagcctggggtcaaggtctgcccatctcaacctctcgagt

SEQ ID NO: 7008 - DNA, 302 bp, Homo sapiens
ttaaagactgcaggcacacagtttggaagggctctgcctttgctgctcttcatagaggaagacctcctgaaatgccagtgaattatggttccccaccaaatcttggtaagtaaggttggcctttgagatgcctgaaataattgtttttaaatttctcaacaacctttataaatgctgtattaaaatttaaaaggaaatactggttgaaatgttgttttaatagtaataagtatcaaatgtcaaattattgttaaaataattactaaaaataaaattaataaaaaatctttttatagtaagaa

SEQ ID NO: 7009 - DNA, 237 bp, Homo sapiens; identical to SEQ ID NO: 7007

SEQ ID NO: 7010 - DNA, 302 bp, Homo sapiens; identical to SEQ ID NO: 7008

SEQ ID NO: 7011 - DNA, 1798 bp, Homo sapiens
cctgctgaggacatgaggacccgtctttttgcagtgccaggcagggtggccaaagaggactggactctggacctggagccccgtggtccagttcacattcaccccacaagagtttcaggaggcctcccacggtgcctgtgctgggtggcggtggtggtgccaagaggaatggaatgtcctgggctccttcaggagctctctacccaggggcaaggagagcccagagagaagcgccctggtctcttgagcttcctgatctgctcctgtcccccgctctcctccactcccttgcctttccctaggttgtcccctccctgggcttttgtgtgttttgggagatgtcacctaaccaggacattgatattcaatcccatcccccttcctcccaccctgccccactttgatttaatcctttggctgtgggctgaggcctcccagggaagctgggtggggtgggtgttgagaccccctcagaccagcacagagacctgtccttgtgcagtctgcaccctgcactccctcccttgcctgtagatgttctggatgacagtagaggaaatggacaaggtcagtttgaatatcccagaacacagtgctctgtctcctcccaccagtccagttagcttcccttctggaccaatagacgaggggagaccccatggatcctctggctgggaagccactgaccaggtggccagggggcagggtgggaagaggggttaaggtgcagtgatgatggcctgttttggagtgtgtctgagactgggattgcatttggggtttcccgtgtgcttgggatgctagagggtcacctgcaggaggcctggggccggcgagaaatctcctgtgatgccctgtgaaatggcttgtctcctcccccatcagggcccaccgaaagctcaggggagcacagaagcccatggaagcccagggagatgtccctggggcagacactaaggcaggtgttgaagacaagctgcttgtcaagaagcatttcccggcaagagaggggcaagtctggggctccaactgggtacagcctgggtgcagttataagcccctttggcttacttggtagaagatggctacttggatgtacctcacttaaagatgttttgtaccacactaggtctctgggcccttgtgcttcctgtgggtggggtgagggccaaaggctatggtttcctgcctccaggagaatggagagaaagggcttccaggcccctccaagcctggggaaggacgtggcatccaagctgagccagagggaactgctgctgtcctcccttcatttctgtggaccttggaggctttggctttgtggcagggcctccccaggcagctctgggacctaggagtttgcttctgatagggtcagctttcccatttcccttcaatgcttgggaaccttctcccttagcttcacacttgccgtttcaagccctgctgggaccttgtggcttggctggaatccaggactgtattttcatggagaagaacctgcagattcttccatcctcagctggccatggcccacagctctgcatctgcatctgagcttctcaagactcctggagcatgaggggaatggggcggggccactgctctgtgctgacgggctccgtctcggagattcttgtcctgttttttttctgttgtttttttttggctggtgctggggacaagcctgtgcctgccaaagctcccaggccaagtttgggggctggtgtttggggttgggtttggggttcaggatgctgcagtctgtgcaataataaacccgcatctgctcacgggc

SEQ ID NO: 7012 - DNA, 1186 bp, Homo sapiens
gacgtgggtccttcccatctgtgtccttgttctcacgatccttgaggggcagctgaagggcttcagtttgagtgggggctgaaagaccatagagcttctacagtggagtttctaaagcaaacttccagaaacttctatgagtagatgacaatagaatcaagagcctgccctttgaggtggagtccccccagcctccaatgctagcccagccactttcttcgcttctctgagcctcagttttctcatctataaaatggggataattacagagcctacctcctggtagtgaggattacattagatgttgaggctgtagaaagcagtggagaaatggagacgagtgttgttatcacgctatggtgctgttagctctgctacaagccctcttgcgttttggtagaggatcccagggaccccaaagggatggaggtgattcagataccagttgtttagtcagaatatctcaatcagtgggggagcctgaggggatcgccacattccacagaggcttagagcagagggacttgcccaaggtcacgcacacagcaagttggtggcaggaaagcagttctcttgactttttaggaataagtactgcccatgaagttactctcacagccggtggttcccagcgagggggttggagaagaaggtccctcaaccaacagtaggctcgagttcaggcacaccctgtcctcaggagcctggctcccctacccaacccagccctatcactgatgggccatgtgctccctcactccctctttctgtgcctcagtttcctcttctgctgaggagactctaatccctgccccatggtcttcctcataggcaatgcagttgtgaggctcaaatgagatagattatggtgataaagaggttttaagctgggcatggtggctcacacctataattccagcacgttagaggaggctgaggcaggtggatcacttgaggtcaggagtttgagaccagcctggccaacatggcaaaaccccatctctactaaaaaagaaaatacaaaaattagccaagtgtggtggcgcgtacctgtaaacccagctagttgggagactgaggcaggagaagcacttgaaccctggaggcggaggttgcagtgagccaagatcaagccactgcactccagcctgggtgacagagcaagactccatctggaaaaaaaaaa

SEQ ID NO: 7013 - DNA, 950 bp, Homo sapiens
tggtgagcaggaaggcgaagtagatatggaaacagaaatgatactaatatcggtgattccttccttttttcctgtgataagtgctgtgcagacaacatatgagcagtgctgataaatgtaaatgtattgttcatagctcattaagaatcagtttcagaaagagatgtctgcttatttggctgcttgaagaatccctgtcaaacagtccttttcaggaagtacaagaggctgtctctatttgtgacctcaggaatggctgtgacagtgtcgtgaccagtccttttcctgtggcacagatctgaactttgtgtgcagaaaaatcttggcttcaagtgagccaagatgccccctgagcatcagcatcacaacttcatcctcctatcttgaagttcatgttatagtgactttaatgaaatcatagagcactgtttcttcgtgtaacaatgacgagggagagcaaaaaactttattgaaaaataaaaaggcaggtaatttagatgaaaatatgttacccatgaggttttgtttttgctttttgtttttgtttttgagaaacagaatctcgctctgtcgtccaggctggagtgcagcggcatgatcttggctcactgcaacctccgcctcccgggttcaagcgattctcctcagcttcccaagtagctggtactacaggcatgcgccaccacaaccagctaatttttgtatttttagtagagatggggtttcactatacgttggccaggctggtctcaaactcctgacctaaggtgatccttctgccttgggctcccaaagtgctgggattacaggcatgagccaccttgcctggccctacccatgagccttgactaaaacattcttctatctgtagaaaagcccaaaagaacttttccagattcaaaaaacttggcactttgtaatggtaatgtttacattaagtaaaaaaaaaa

SEQ ID NO: 7014 - DNA, 112 bp, Homo sapiens
aggctgagacaagagaatcgcttgcacctgggaggcggaggtttcagtgagctgagatcgcaccattgcactccagcctgggcaacaagagcgaaactccatctaaaaaaaa

SEQ ID NO: 7015 - DNA, 4469 bp, Homo sapiens
ggatattcagcatcctctcccagagcaaaaagcgactccacatagaagactactctgtttctcagacaacacttgaccaagtaagctttgagtgtcaaaacagatttacttctcagggtgtggattcctgccccgacactcccgcccataggtccaagagcagtttgtatcttgaattggtgcttgaattcctgatctactattcctagctatgctttttactaaacctctctgaacctgaaaagggagatgatgcctatgtactctataggattattgtgagaatttactgtaataataaccataaaaactaccatttagtgagcacctaccatgggccaggcattttacttggtgcctaatcctatttaaattagataaaaaagtaccaaataggtcctgacacttaagaagtactcagtaaatattttcttccctcttccctttaatcaagaccgtatgtgccaaagtaaatggatgactgagcagttggtgatgtaggggtggggggcgatatagaaagtcagtttttggccgggcgtggtggctcatgcctgtaatcccagcactttgggaggctgaggagcaggcagatcatgaggtcaggagatccagataatcctggccaacagggtgaaaccccgtctctactaaaaatacaaaaattagctgggcatggtggtgcgcacttgtagtcccagctacttgcgaggctgaggcaggagaattgctcgaacccaggaggtggaggttacagtgagccaaggtctcgccactgcactccagcctggggacagagcaagaccccatttcaaggggggaaaaaaagtctatttttaagttgttattgcttttttcaagtattcttccctccttcacacacagttttctagttaatccatttatgtaattctgtatgctcctacttgacctaatttcaacatctggaaaaatagaactagaataaagaatgagcaagttgagtggtatttataaaggtccatcttaatcttttaacaggtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactattttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttgtgtgctctttgttcatcattggccctcattccaagcactttacgctgtctgtaatgcgatctatttttgcactggaatatctgagaaattgaacaactagacaaaagtttcacacagatttctagttaaatcatttcataaaagaaaaaagaaaaaaaattttgtatgtcaataactttatatgaagtattaaaatgcatatttctatgttgtaatataatgagtcacaaaataaagctgtgacagttctgttggtctacagaaa

SEQ ID NO: 7016 - DNA, 209 bp, Homo sapiens
atctcggctcactgcaagctccgcctcccgggttcacgccattctcctgcctcagcctcctcagtagctgggactacaggcgcccgccaccacgcctggctaatttttttgtattttttagtagagacggggtttcaccgtgttagccgggatggtctcgatctcctgacctggtgatccgcctgcctcggcctcccaaagtgctgggt

SEQ ID NO: 7017 - DNA, 159 bp, Homo sapiens
atctcggctcactgcaagctctgcctcccgggttcacgccattctcctgcctcagcctcccgagtagctgggactacaggcacccgccaccacgcctggctaatttttgtatttttagtagacatggggtttcactgtgttagccaggatggtcttgat

SEQ ID NO: 7018 - DNA, 184 bp, Homo sapiens
aagctctgcctcctgggttcacgccattctcctgcctcagcctcccgagtagctgggactacaggcgcccgccaccacgcctggctaattttttgtatttttagtagagacagagtttcaccatgttagccaggatggtctcaatctcctgaccttgtgatccgcccaccttggcctcccaaag

SEQ ID NO: 7019 - DNA, 232 bp, Homo sapiens
cagtggcgcgatctcggctcactgcaagctccgcctcccgggttcacgccattctcctgcctcagcctcctgagtagctgggactacaggcacccgccaccacgcctggctaattttttgtatttttagtagagacggggtttcgccgtgttagccaggatggtctcaatctcctgacctcgtgatccgcccgcctcggcctcctaaagtgttgggattgcaggcatgagcc

SEQ ID NO: 7020 - DNA, 104 bp, Homo sapiens
cggctcactgcaagctctgcctcccgggttcacgccattctcctgcctcagcctcccgagtagctgggactacaggcgcccgccaccatgcctggctaattttt

SEQ ID NO: 7021 - DNA, 117 bp, Homo sapiens
tcagctcactgcaagctccgcctcctaggttcacgccattctcctgcctcagcctcctgagtagctgggactacaggtgcctgccaccacgcctggctaattttttgtattttttag

SEQ ID NO: 7022 - DNA, 161 bp, Homo sapiens
ctcactgcaagctccgcctcccgggttcacgccattctcctgcctcagcctcccgagtagctgggactacaggcgcccgccaccacgcctttctaaattttgtatttttagtagagacgggatttcaccatgttagccaggatggtctcgatctcctgacc

SEQ ID NO: 7023 - DNA, 6833 bp, Homo sapiens
tgagactgcagttcctgcgacgcccctgcagcagcagcagcgtggtcagagcgagcttctgagcggtggtgggttccatgtgatggtggagtaggagacaggtctccgcggtcagtggcgggggcgtggaccccaccgggaaccctccctgctccttccctgcctctccctgttttcgtgcccgcacttcttcgtgggcatctgggcccgagtcctccgcttgggggcggttgtgcggtcctggctactgcagcgtccgcaccccggccgggaaggctatgccaatgtccgacccgcgtccagcgtataggagcgccctggcccacagctggcggtaaaacgcgggacctgggtccctcggagccccaggggcctctgagctggagtctaggattatttttgatgcctcagcacctttaaaaagagacctcgctagagcagggggcatctgtattttcagttctttgaggagtctccagctatttagctgttttccatggtgtgtatcctaattttcatttccacctacagtgtatgagtttccctttctccaaaaccacacccgcattcctactatttttggtttggggtttgttttgtttttgtttttgttttgagacggagtcttgctctgtcttacaggctggagtgcagtggcgccatctcggccgactgcaaccgctgcctggttttaagcaagtctcctgtctcagcctccagagtagctgggactacaggcgccgccaccatgcccagctcatttttgtatttttagtagagatggggtttcacgatattggtcaggctggtctcaaactcctgacctcaggtgacccacctgcctcagcctcgcaaagtgcagagattacaggcatgagacaccgttcccagcccctcctatttttttaaaaaaatcaaggaatattcgataagtgtgagattatctgtgtgtggttttgaattacagttttctaatgaatagttgattttgaggaccttatctcttatttgttgttcgattttatggctgtgcagaattgtctgttcaggttctttgcaaaatattagattggatgcttttgctactttgtagtgttttttgtgtacatattagatgacaactcctcgtgaattacaagattgcctgaaatttttgcctaatctataggatgcttttttaattggaaagtagttttctttgatgtgcagaaacttttcatgttgatgtagtcaacatgatatttatttttgcgtttcatgcatgtaattttcgtcacccatataagaaaataatatgtcagtgacaaagcatttaattgtcaatgaggtttttcttccagggtgtttattttcctctttgcaaaggtgagcagagattcaagtgacccaaaatatatgctcatcctgtgttttagttaaaaacattttgtagtttatggtcttttgttttgccttcaatttgggggagtgggtgttcattttcatacatcgtgtaaaataaggtcctatttctcgcttctgcatctggatatcatttttgtcaaaggtattcattctctgccttccacattgcagtgttctttatcaaagtcagttgattgtgtccatatttgtgttgatcatgtttttgtcctccctgtttttgtccatagtttatgcaagtatcatatatcagctgtataactacaacttggcagtgtaatttgatattaaggattgtgggtcttcactttgtatttctcaggattcctttagatattcattgcttttgtggttccctgtgatttttagcaatacgtatttatttctgttaactttttttcacaacataaaggtccataattaggggtacattttcatacatacagattgggtaatgatcaaatcagggtacttaggatctctatttgctcatccaggttttttttttttttgtggggagaacattcaaaattctcccttcttactctagaaaaatatgatattgttaactccagtcaccaggctgaggaggagaacctcagatttgttcctttaatgttaagataactttgtttccataatcaatccttccccattccccctctatctcccaaactctggtaaccaatattgtgctttttacttcattaagataaacatcttaagatttcacatgagtggtatcatgcagtgtttttctaggcctagctccttacatttaacataatgttttccaggttcatctgcgttgctctaaatgggactgtttcattattttgatggctgaagaatatttcctagtgtatgtatatgagagtttcttgatctctttatctgtggatgaacaggtaggttgaatttacacccagtaatgggactgctagatggaatggtatttctttttttcctattctttgcaagacctctaactgttttttatagtgttaatactaatttatgtttgcacaaacagttcccctttctggcaattcataccaggaattgtctttttaaatattttgatctttttgtaatgttcattctattggagtgagataagatctgagtgtggttttgatctgcatttttctcatgagtagtaatgttaaccacgtttttgtagacattcggtcagtttcctgtcttctttggaaaaatatctaatccggttatttgcccagtttttgtctggcaattgttctgttgttttgttatttttttgccagctggtagtatgactggcttgtaccttttcaaaaataatcccttatcccaaacttgtaatttttagtgtgcctttttattttgtttattgtttcctttgttggtcacaaatgcttcagcttgacgtggtcccacatgtgcataatttcttggtggctgtgctgttggttactaatcaagaaaaaacaaaatcactaccaaagcagtcccttgtcaataatttttttcccttgtatttttgtttactttttgtgaaccctgagcatacatccaagttgctctaaatatacgcacacccgaggttgtctttataggagctttatggttgcaagttttgtgtataatctttaatcattttgagttgattattgtgtatctagtaccataagggtcctgtattacccttttgcatatggatatctagtttcggaagtcttccctgttgtgtcattttggtggtgttttgaaaaatgtgttcattccatataaatttttgtttattattgagcacattcattttgctcactggtctgtgtttctctgtctatgccagtaacatatgggtttgttaactacggattttcatttaattagaactcagggaatgtgatgcatcccgtatggtttgtatttctcagaatagctttggaaattcagggtgtttcacatttccacataaattttggcattgtttctttatacttcctaaaacactatttgtcatatactaaatgtatacaattagaaggtacaaggaaggttttcatacatgtatatgttgaataatgataaaatcaggttatttagcatctcttcatctcatatagttattatttttggtaacaacattcagaatctttccttccagctactttgaaatatatgatacatttgtgttaaggctagtcacgctgctgtggaatagaaggccagaattgatcactatcatctgagagtaactttgtacccatcactgattccttccgagactgcctccacttccccagcagcctctggtaagccctattgaactttctacttctagaagataaagcttttttcagtctacatgtgtgagatcacgtggcatgggactttctctaccaggcttattctttggaccttgttcttcagatttcttcatgtggctgcagatggcaggatttcccaaaggtttatggctgcaacatattccgtggtgtatctgtacagcagtttcctcattcctgcagctgtgtttgaacaggtaggttggttctctaccttggccacagttaagagtgctttagtacccatgggaaggcagatagctctcttcaacctagggacttcaactgctttaaatgtggaaccagtggtggggctgttagctgacatggtagttgtactgtgaatttttttcagaaacctctagctgtttttcatagtgtgtatactaatttacatccccaccaatagcgtttaagaggttacctttctgtaagtctacactggatgtcaccttcaaaaattcgtgttttgtttttggtagtactcattctgagtggaatgagacagaatcttagtgtggttttcatggacatttttttgtgaggtttagtgatgttgagaaagttatttgagaaatccccacattgctttccatggtgtccgaactagtttgcatttccaccaacagcagaccagcatccctcctcctctgccttgctggtgttcattcttgtggactgtgtcataattgtcattcatcagaatgtgtgaaatactatctcatgggccttttgctttgcatttctctgatgattcctgaggtaaagaaatgtcttgtctgttggttgctgtaaaccttcttttgagatgcatgttttcatgccccttaccctttcttcattgagtttttgtttttctgatttatttgcttaatgtatttgaagtagattctggatattagacttcatcagatgcagatgtgggaacattttctcccattgtgtaggctgtctgtttactgtgttggtaatttcttctgctgtgcagcagctcttttgtatattaggccccacttgtcaataattgttttagttgcaattgcttttggggacttaggcacagccatgctctgccaaatcctctgtcaagaagggtatttccaagttctcttgcaggcttttcatagtttgaggtcttgcgtttacatcttcattcatcttgagttaatttctgtacagggtgagacacaggggcccactgtttttcttctgcaactggctagcagtttatcctggcaccatctattgagaggagggagtcctttctccaaagcttattttcgtggatttttttgaagatcagatggtgttaggggtgtgggtttacatctgggtcctctaatttgttccactgctctgtgtgaaatggggtccctagcttttcaatgaaattaaaaatcaggaagtgtgacacaaccaatgtagtttggacttctcaggattgctttagaaattcagggtgttttgtggtctgcatgaattttagcattgtgtatttacgtattttttaaaaggttggccatatagtaaaggtatacaatggggggagttagagtggggcattttggttaatgcagacatagaggaatgttaaaatcaggatatttagagtctctgttatcacaaagttgttaatttctttatggtgaaaacatttggaatcttcttttccagattttgtgaaaaagatgtgatgttttgttaacctctggtcactgtgctgtggaacagagaggaacaattcattcctctcatctaagtgtaattttggacctatttctgatccctgcccatacccctgcttccctccaatctctggaaaccactgttatgctctctagatctattgcaataaagccttttattttgggttctacatgagtgagatgtggcaatgtttttctttctctacctggtttaggtcatttaccatgcggtcctccaggttcaacagtatggctccaaatgatgaaatttcattctgattttctggctgaagactattctgtttgtgtatgtccaccacagttactttatcccttcatctgtggatgggcaggtaagtttattccttatcttggcgattgtgaatagtgctgcagtccacataggatggctgacatctcttgcataaactgatttctttggcactgaaagtatacttagtagtagaattgttagatgaagtggtagttgtaggtttaatttttggaggaacctcccactggtttctgtagtatgtatactaattaacattctcttttttttttttttttggatggagtctcgctctgttgcccaggctggagtgcagtggcatgatctcagctcactgcaagctctgcttcctgggttcatgccattctcctgcctcagcctcctgagtagctgggattacaggcacccgccaccacgcctggctaattttttgtatttttagtagagacggggtttcaccatgttagccaggatggtctcaatctcctgacctcgtgatctgccggcctcggcctcccaaagtgctgggattacaggcgtgagccaccgtgcccggctgtatactaattaacattcttaccaaacgagttcttctctggaaatttccaccagcatttgtgtcttttttaatatattttatcactttgataacatccatttgaattatagtgagatgatatatgtgttgttttgatttatatcttatggtttgtgatgttattcaagtttttaaaactcgttttcaatgttatgtcttttttgtagaaatgtctatttaggttttgtttggttattagtttctcttttgtgtttttgctagtaagtagtgttagttgcttagacattttgaagacagccttttatcagatatatgtttgttgaaacatttcttgtagaatgaaacatatatggaaatgttctgtgcaataaaaacagcagtggtaacacagatgtaggctctgagtgtctcactggagactgaagtccacagatatgcaacaaagcctttgtctccctgatgtttttgcctcctgctggtcatgtgctttcacacatcaagagaggacatttaacatttga

SEQ ID NO: 7024 - DNA, 489 bp, Homo sapiens
ctcgcctggccttaagcagcttttattcgtccatgtcatagaatcaatggaataaatatgtcattatcagttaccaagaagacaaaagatctagatttagttctagctctatctactcagctttgcaacctttaggaaattagtcacaaattgagacatcagtgattttaccggtaaaatgagaaagaaaaactgtatgattctctaatgcccattccagtttgcaaattaaatgattctatagctaaatttctaccacaaatctagaaagtatacatatttttacaaggtccagcagcacatataggcaaagataaaaattatcctagtgagataaagtatacaactatgttcattttaggacatgaaaaatctaaaaaaatatgagcttatattattttatttggctttaaccaataaaaactttagagttaataaattctaaagttggtatatgcaacaagccatttacttatcaatatataattt

SEQ ID NO: 7025 - DNA, 284 bp, Homo sapiens
ttttttgaaaagatcaacaaaattgatagaccgctagcaagactcataaagaagaaaagagagaagaatcaaatagacgcaataaaaaatgataaaggggatatcaccactgatcccacagaaatacaagctaccatcagagaatactacaaacacctctacacaagtacactagaaaatctagaaggaaatggataaattcctggacacatacaccctcccaagactaaaccaggaagaagctgaatctctgaatagaccaataacaggctctgaaattgagg

SEQ ID NO: 7026 - DNA, 186 bp, Homo sapiens
ttctgttcctgtgttagcttgctgaggatgatggcttccagcttcatccctgtccctgcagaggacttgatctcatacctttttatggctgtgtaatattccatgatgtacatgtagtacattttctttttccagtctatcattgatgggcatatgggttggttccaagtctttaccattgtgaat

SEQ ID NO: 7027 - DNA, 8125 bp, Homo sapiens
tgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagcgtaagttctgtccaaatccccagcccctccaactcctgatctccttgcacttggacccctgggacaggcaagacctggaatattagacacctgggtgtccaacctgagcccagggaaactgcttctagaacgttctaggcttgaccacacccctcctcctcatggttggttatgcctacccctggttgtccctcccactccctgattagtcagctcctttatgtccctgtcctagctatctgggtttcctcaggaggagctggcttctcccagacctgggaagccccacctaggcgccgcctgtccctgccttccacaccctccttgtcctcagccctgcccattaccacctacccatgcctggccctttcctttccagtttttcatcgtcctgttggtcatcctcctagcagagctgatcttactcatcctcttctttgtctacatggacaaggtaagccttaccagatgggagggggcatatggaatgtcactgcccttagagttgggccaagcaggccagggtcccttccctggccagaggaagagtgctggcaagcagcacctgtgcagaaaggaacatggaaccaagggttgggaaagctaccaaggaaagagcagatggaaggttttgatgggggcagcacggggcaggcaaatttggaggatgggagagttgactttgtatagttccaggaagtggaatcctctgcatgaccagagatggcagtgggctgcctctggcgctagtgagctccctctcactggaaggaattaagctacttggagaagggattcagacctcatcaggtggttgggctgggtgatttgagagcaaaccatgaaaaacaaggaggaactctctgggcgacgctggctgagcaggactgaggcacagggaagctctgtttcctgcactagagcccttgaggacgggcgctgctcctgggttcaggaggatggtgggtgaccccctgtaacctcgccaggctgggcagttcgcagtcaagagcgaggttggccgggatttcagtctcttggggcgtggcaggccctttggtaccatgcactccagaactgtgtaaggagcagttcttgaaatagctgcctgagccacactgaaagttagagacatcgttaggatgagaaagaataatcttttagttttgcactcgtgaaaaggaagaaagaacaattttgagagatttctctgtgccagccctgttcttggcccttttatgagaattgtttcccttaattctaacaacagcgccatgagtagatgctgctgttcaacatcgggtagaacagcggtgagggaggtgaaggtcacatgacctgtcttcctccctctagttcccagggtgtgttttgagaggggcagtctgtggggaagctgtgtagtggggggcgggggtggcagagtggcctgtgtgtgtggctggtcctgggatgggggagtggaggcacgtggtgtgtttttttgcctctgggtgttacagccctggccctgagtttagctctgctgggaggcggtgggtgcaccagggcctgctgtattctgaaactgggagtgtgtgcctaaccccgcacctctgttgggccagcagaggcccccaccccagtgggcagggccttccagaccagctgccttccctgccttcctcactcctcatctgtcacccaccatcctgggtgacctgaggtgggctggagagacgagctgcgtcctggttccaaccgtctcactgtgtccctccgcctggcaggtgaacgagaacgccaagaaggacctgaaggaaggcctgctgctgtaccacaccgagaacaacgtggggctgaagaacgcctggaacatcatccaggctgaggtgcgggctgggccgccctggtggggccaggcagggaggaggggtggcggccggtacttctagctgccttccccggtgacctggccgggcacctgtgctttctggattttagccgggagtggagtggtacccacgggggcatttgcctgaactgctgagtcagatgtgatacagcaaggtacagccagggagggatgaggatacaggaggggcaggcctgagagagctgtggctgagctttgggatgaatgactgaatttattttagcaacagatttgcctccatgatggggcttggcttaggtgaggaggccctggctctaggaggagaacaagtccatagtcccagatgctcccattttaagccctggggaggggccggcagggggttgggtggcagtcagcttgggacggtttacagaaagagcagaggtgctggtgggcaagcacagggctgagccaaggggcccagcccgaggggtgggctgcattgccctctcccgctctggtctccaggaaggagtgctcactcacttctccagtgggcccggctgaagcccaaagaagggacaagaagcaagccctttgtctcctcccttaactgcagggtggccacttttgcggggactggggttggcctgggcaggggaaggccctggggaggaaggggcgggccatggcatgtctgactgccccttccattcctgctggccagatgcgatgctgtggtgtcactgactacacagactggtacccagtgctgggggagaacacggttcccgaccgctgctgcatggagaactcccagggctgcgggcgcaacgccaccacgcctttgtggagaacggtgaggctggggatggaccgcttgggtccaagagcccgtgtgtggatgccccggcacggggagccctataggggaggctgggcccgggacactaagaggttggctgaatgtggcggtggggggctcacaaaaataaagccaaaagacaggtggaaaatggggggtggggctggacccacagttgggagagtcagagggcgaggggttgaatggggtctgaggctctgcagctggccttgcgggtggggcggaggctgcgccaagggatggggacagggctgaggccagggagggctgggaggtaagagtgaggacgaggtggaaggagagagtgagctgggggctgggctgcagggagcgcatgcttgggctgggaccctaacctcgtgggcctcgctccccagggctgctatgaaaaggtgaagatgtggttcgatgacaataagcacgtgctgggcacggtggggatgtgcatcctcatcatgcaggtaagaggggcgtccccagcagcctcacccaccctgctggcctcagccgcagagggaaggaagcacagagaagtgaaagcagtgttggtacacggcggagggtctggaattcatcacagctattcaagcttagcagctgtgcctgccaccgtttccgcagagctctgatatgagagcacgtgtctactcagcactgagagtggtgctcagggctgcctgtggccaggcccaggctgggatattgaagctggagtcaacccccgtgggttcccccagttctgcccaaaccttgagctcagagagccatgcaagacacacacggtgtcccccggtcaccatctttacagcctgtgcacatggcacactctctgtggtgaccgtgagaccacaccgggcttccttctgcctcctgcactcctctgggtccccggctcctttgaggattcaggagggaaggggcacaaacgagtagtgacgtggtcctgagcacacatcactggaaagacagccctgctgctgccaagacatcgcaccatgtgttccacaagcagacaagagaggcttgacaggagtcctttatttttctttttttaagagacagggtctcactttgttgctcaggctggagtgcggtggcgccgtcatagctcgctgcagccacaaactcctgggctcaagccatcgtcccacttcagcctctcaagtagctgggactacaggcatatacaccaccatacctgaatgatttacaacttttttccaaaaacagatggagtctccctctattgcccaggccgatctcaagccatcctcccaccttggcctcctaaagtgccaccgtgcccggctggcctgagtcctgaatgatccctgccacctcccactccccaccttggctcctgtgagcccccacgtagagccaggtcctccgtgcattccgtgcctgcagcgcccctctgagtaggcacacgtatgcatcctgcagaggttcgatggcttctggtctaacagccccacgaggctgagccagagttcacctgtgtgtgtctccagggtgacctctgttcacggttttcttcatgtcttcattccataagcattttcctggcacaccagtggccatccccgcttgctctaggtgccctgtgacatcccaagcctctcggggctgaggtcaggtccaggctgctgcagctcctgcctcaggcccctccccgtgtctttcagatcctgggcatggccttctccatgaccctcttccagcacatccaccggactggtaagaagtacgacgcatgagcgggctggccgggagtgcccaccccgccctgctgccctgtggagggaagaggattgagctttgtgtcgcctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctctggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggaaggagggggcgtggacaggacacgggaccttgccaggcctggtgtctgaggacaggagcctgggagaggcgggtggagcgtgaagcaggctggaggtgcccctgcacgggaggtggcgtttgctaaccaatcgagctggaaatgccagggcaggggggccccacggtgctgtggcagagctagaggggtccttagacttttcactgatgagcagttgttggttttttctttctcccttcctcccgctctctgctggcacgcgaggcttccccttccaccccatgtgggtattcccacaacaggttctgcacaccccagttatttcacagacattcctgctagaaactgtcagacaaatacctctctagttcggatgctgctcactttcccccttgcttctggaaggggaagcagtccttaggttttgctgtgctgggacagtggcaggggacccacaggggtgaggacccacggtcctccccgccagccttgctcagctgtgggttgccctgctgggaaggagggaatcacgtccacctgggtcccaagatcttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaaccgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgccccggaccctcttgcaggtgtcctggtttgacttggaactagatggccatctttccaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagcacagca

SEQ ID NO: 7028 - DNA, 1111 bp, Homo sapiens
gtcagcaaaggttcatgctattcgatagatgctttcactaaatgatgagtgggaaatgtaactttgtcatcttgcagagcctacaatgcaaacattttttccgccccatgtacagtttcatttacatagtgttgtcaaggaataagtgatttgtttcacttaagtgatttttccaggtaattgaagcttacctctttgtgcacacattattctttgcttaaactttctttgatgaaaacatggcacatggttctttcctttttttttgcttggtacatataaatgtggctacatcttttcttgacttggggttatcatgataaagattgctttttgttctgtgccgtaatcctgttattgacagctgaattgtgtgggattgagagcctgtatgtgaatagtcacagatccatattcttttagagttaccattattactaataatatagctcctctgagtcattagcaaatcccaggcaggatgctaagaattcatatacattataatcttggctaaaccatccaccccactccaagaaatgatcattattattcctcctactttacaggtaaaaattgaagtttaagggataagtagtaagtggtagagttgagatttgcatccatgtctctctaactgcaagatgcctgttgccagttatacttcttctatttctcctctctgcccctctttgggtatttctgtctgtccggttgctttaaaagcctttgcccaggtaagggcccgagattaggtctgtgcctattttgtggaaattattggtatgtttttcgttaagtggagttctgaaggcatttttgctgatttctgggttcccagacatctgcacggttgccgtttctagaagtctaacctgtgaattcatcactgtgtatgctaaggctttgggagggattataggattttctgcattatgattaagcagcataatcaagaaacttgcagtcagaggaaagcgtggcaattctgtaatgcagaagttggcagaccttttctgtggagggccagatactaaacgtcttagttcattttgtgttgctataaaggtatacctgaggctgggtaatttattaaaaaaaaaaaaagagg

SEQ ID NO: 7029 - DNA, 315 bp, Homo sapiens
gccaaccctacatctttgccctggccatggtcgtgcataccagcttcacttcccgctgccagcacctgcattggtttgtctgaggactttctctgactgtggaagtggtgggctggaaatgcaggggaattagcatccactccctccagtgatgaacagggtttggcctatggatactccagctcccttgctcatccagtgaaactaaggggtgtatattgtacaccttttcccagagtttccaccatggtgagtatcaccatggtgataggtgacttaataggctagtacttttttttttttttggtggcctta

SEQ ID NO: 7030 - DNA, 2582 bp, Homo sapiens
gtctttgccctctcaagttgctcttgaatgttgattcaactcattaggacatacttggatgatgaattagaaggagcatctttgccctctacttacagatcctaggaacaatttgtggaattatcagtaagcaatatctgtaacagataaaatgtctgctttccctttgcccctcttagcctatgacatgccacatccaatttgtcttcgttccaactgtgagaggtcttaatttcatcattctggccttttgcagttaaatgttctccaaggatatgatctatggggagaggactgatagtggaactaatctttcaaagttctgcttaagcaattgtagataacataggagaagaaactctggaaacaattatgattatcctagttctgcccctgtggaaattcaatccgaaacccttcatgtttttgcttctctcttctctacatggatggaatatgttatacttttttgagctgaaaaatctaaataattagaaaaagacaaagttgtaatgagttttctgtttaaacttataggaccctttctaataaaagtgttattgtaatcattgaatcgttagttaactgctttgtatggttatgtcttgtctctctttaatccagggactgcaagcaactaggcaaaaaactaacaaaaaaaccaatgttttataagagtggttctcaaactttaaagtgctgattaaagcacagattgcccaggcctcaccctcagtagatgggtatggggcccaagaactttcaacaggagatgctgctgctgcagcttgtctaagaactacacttggaaaattactaatttgtgtaataaatacctgaccatttggaatccttagaggatggaaatattttgtaatgctgtgtgcaagatttgatatagaaaaacttgggttcaagtggcaattcagcagattacaagaggtgaaacaactgagtttctgagactcagttttattatctgaaagtcaggaatgaaaataatgcctatgtggcagaactgctataaagatcagacaaggtcgtgtatgggaaaggccttggtaaatggaaaagcacaatctaagtgtaacttattctagatgtgttttcaataggcaagttttatatacctaagactaaaagcttgcattttaatccctgggattgaaatctttcaccatcatcaccatgatggtaataacaacaataacaatactagtgcactatttattgtattttctgcaatgggcacttaatatgttttgattatatatttcaaaaacctcataaaatctattttatcatgtatattatttgcttacctaagagtgtactggacagaatttaaatttttcttgagggcttagggcagtgcagttcttagggtgtgtgatgtctctgtctatatagatgatttgatttaaaaatgtgttatatgtgatacatttataacggaatattttttgctaaaaagaaatgagctaccaagctataaaaagatatagaggaaccttggatgcatttttctaagttaaagaagccaatctgaaaaggctataaaactgtatgatttccaccatatgacactctggaaaaggcaaaactatggagatattaaaaagatcagtggttgtcaggggttaaaggggaggaagggataaataggcagagcacagatgtttagggcagtgaattattctgtatgattcatattggtggatccatggtcattatacatttgtcaaaactcatagagtgtgcaacatcaagagtgaactctaatgtaaactatggactatgggtgataatgatgtgtcaacataggtacattaattataacaaatataccactctggtgcccagtgttaatactgggggaactgatgtgtgtagaggacaatggtatatgggaactttctgtaattttgggaactgaaaactgctcttaaaagaataaagtgtattaaaaaggatcacaccaaaaaatgaattgcaaaattcatgacctcatgtgaaagatagtgactgtggtagatagaataatggcccctaaagatgaccacatcctagtccttggaacctgtgaatctgctactttacttggtaaaaggggctctacagatatgattaagttaaggattttgagatgggaaggtcatcctggattatctgagtgggtgcagtgtaatcacaagggtcctttaaagatggaggcagactgtcagaggaattggcacaaaagcagaggtcacacacacacacggggggatagagagagagagagagagagaggaagatgttacactgctggctttaaagatggaggaagtggctattaagtcaagcaaggcatgcaacctcaaaagctccaaaaaacaaggaaatgaccttcagaaggaattcaaccttatattccttgctgacccattttagacttttgactatctgaactttaagttaataaagtgctgttgttttaagccaataaattggtggttatttgttacatcagcaataggaaactggtataatgatttttcaatgaaaatttagacaagattagaaaaaaaaaagaataaaaa

SEQ ID NO: 7031 - DNA, 3345 bp, Homo sapiens
gtgtaaatagaccaaacctatgactaattggagtacctgaaagagatagggagaatggatcaaagttggaaaacacactgtaggatatccttcaggagaacttccccaacctagcaagacagacaattttcaaatttgggaaatccagagaaccccaataagatactccttgaaaagatctaccccaagacacataatcatcagattctccaaggctgagatggaggaaaaattgttaaggtcagccagagagaaaggccaggtcacctacaaagggaaacacatcagactaacagcggacctctcagcagaaaccctgcaagccagacgagattggggggcaatattcaacagtcttaaagaaaagaaattccaacccagaatttcatatccagccacattaagcttcataaacaaaggagaaataaaatcttttttcagacaagcaaatgctggggtattttgtcaccaccagagacctgtcttgcaagagctcctgaaagaagcattaaacatggataggaaaaaccattaccagccactacaaaaatacattgaagtacacagaccaatgacactatgaagcagctacattaacaagtctgcagaattaaccagccagcattatgatgacaggatcaaattcacacataacaatattaaccttaaatgtaaatgggctaaataccccaattaaaggattcagaatggcaagctggatacaaagacaagacccatcactgtgctgtattcaagagacacatctcatgtgcaaagatgcacatagactcaaaataaaggaatggagaaaaatttaccaagcaaatggaaagcataaaaaagcaggggttgcaatcctagtttctaacaaaattttttttgactttaaaccaaaatttttttgactttaaaccaacaaaggtcaaaaaagacaaagaagggcgttacataatgttaaagggttcaattcaacaagaagaggtaactatcctaaatatatatgcacccaatacagaagcacccagatttataaaacaagttcttagagacctacgaagagacttagacccccacataataatagtgggagactttaataccccactgtcaatattagatgggtcaatgaggcagaaaattaatagtttagactgatcaatgagacagaaaattaacaaagatattcagggcttgaactcagctctagaacaagtggacctgataggtatctacagaactctccacctaaaggcaacagaatatacattttttttgacgtcacatggcacttactctaaaattaatcacataattggaagtaaagcactcctcagcaaatgcaaaagaactgaaataataacagtctctcagaccacagcacaatcaaattagaactcaagattaaaaagcccactcaaaaccacacaactacatggaaattgagcaatctgctcctgaatgaatgactcctgggtaaataatgacattaaggcagaaatcaagaagttctttgaaatcaatgagaacaaagaaacaatgtatcagaacctctgggatgcaggtaaagcagtgttaagaaggaaatttatagcactaaatacccacataaaaaatctagaaagatctcgaattgacaccctaacatcacaactaaaagaactagagaatgaagagcaaacaaatcccagagctagcagaagacaagaagtaactaagctcagagtggaactgaaggagataagagtcatgaaaaacccttccaaaaaaatcaatgcatcccgtagctgtttttttttttaaatcaatgaaatagaccaccagcgagactaataaagaagaaaagagagaagatttcaaataaacaccatcagaaacgataaaggggataccactactgacgccacagaaatacaaccaaccatcagataataccataagcacctctatgcaaataaactggaaaatctagaagaatggataaattcctgcactcataaacaccctacaaagactgaaccaggaagaagttgaatccctgaatagaccaataacaagtcctgaaattgaggcagtaataaatggcctaccaatcaaaaaaagcccagctcccgatggatttacagctgaattccaccagaggcacaaagaggacctggtaccattctgaaacaattccaaacaattaaaaaggagagatatctccctaacccattttatgaggccagcatcttcctgataccaaaacctgatggagatacaacaaaaaaagaaaactgcaggccaatatccctgatgaacatcagtgcaaaaatcctcagtaaaatactggcaaattgaatccagcagcacatcaaaaaacatccaccatgatcaagttggcttcatccccgggatgcaaggctggttcaacatacacaaatcaatacatgtcattcatcacataaacagaactaaagataaaaaccacatgattatctcaataggtgcacaaaaggtcttcaataaaattcaacatcccttcatgttaaaaactctcaataaactacgtattgaaagaacatacctcaaaataataagagccatttatgataaacccacagccagcatcatactgaatgggcaaaagctggaagcattccccttgaaaactggcacaaggcaaggataccctctctcactagtcttattcaatgtagtattggaagttctggccagggcaattaggcaagagaaagaaataaagcgtattcaaataggaagagaggaagtcaaattttctttgtttgcagatgacatgatcctatatctcgaaaaccccatcatttcagcccaaaagcttcttaagctgataagcaacgtcagcaaagtctcaagatacaaagtcaatgtgcagaagtcacaagcattcctatacaccaacaacagacaagaagaaatgcaaatcatgaatgaactcccattcacaattgccacaaagagaataaaatacttaggaatacagctaacaaaggaagtgaaagacctcttcaaggagaactacaaaccactgcttatagaaatcaaagaggacacaagcagatggaaaaacatccaatgctcatggataggaagaatcaatatcatgaaaatggccatactgcccaaaggaatttatagattcaatgctattcccattaaactaccatcgacattcttcacagaattagaaaagactaatttaaaattcatatggaaccaaaaaacagttcacattgccaagacaatcctaagcaaaaagaagaaagctggaggtatcacactatccaacttcaaactatactacaagtccacagtaaaaaaaaaaaa

SEQ ID NO: 7032 - DNA, 262 bp, Homo sapiens
gaattatcttctggtaacttcattgaaaaggcctctttaggcatgaaatcacctgccagctgtgctgaggacaggcttcacagagctcctggaggctaattaaggtgcagagttcagagcagaaagatgcttcactatacctgtggcaggatggccaccagggcctgttccctggccagagtaagcactctttccctagggatttggaacagccccattctcacctggtgtttaccccaggttttgaagagattccaaacta

SEQ ID NO: 7033 - DNA, 4150 bp, Homo sapiens
tggtaattgtgacactgtggagctgtccttctttgatgtctcagtcactcagtaagccatgtaatttaaattgaccctctgagtgaccaagttgctctgaaaattttccaagtacatgttacaatgagaatgagagaaggaggagggaaaggcggggacatcatgaaggtagaagaggaggaggtttagaatcaagcacaaagagggctcaaaattacgtggaaattggggctggtcagtcagttagccaggggactaatgactttatgcctgctactctgcagtctaccatcattagggacatcttaaacatagaaaggaaggaacacccaatttcacttcaggcacccagccacaggaactttcctaaggttgagcctttgcgttgaaagtgagaccgttatctaaggattcctctccacaccctgattcctgaggagtgttcaaagactcagaaacaatgacaggcctgctgctgagctttgctgtctgcagtaaatgaacgttcagcccttgccctcctgacctgcttgtctttgtttctacagaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccagcaatgcgatgcccagccaggggccagcgggtctggggtctatgtgaggatgtggaagagacagcagcagaagtgggagcgaaaaattattggcattttttcaggcaccagtgggtggacatgaatggttccccacaggatttcaacgtggctgtcagaatcactcctctcaaatatgcccagatttgctattggattaaaggaaactacctggattgtagggaggggtgacacagtgttccctcctggcagcaattaagggtcttcatgttcttattttaggagaggccaaattgttttttgtcattggcgtgcacacgtgtgtgtgtgtgtgtgtgtgtgtgtaaggtgtcttataatcttatacctatttcttacaagtgcaagatgactggctttactatttgaaaagtggtgtgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaagagatatgaattcttatatgtgtgcatgtgtgttttcttctgagattcatcttggtggtgggtttttttgtttttttaattcagtgcctgatctttaatgcttccataaggcagtgttcccatttaggaactttgacagcatttgttaggcagaatattttggatttggaggcatttgcatggtagtctttgaacagtaaaatgatgtgttgactatactgatacacatattaaactataccttatagtaaaccagtatcccaagctgcttttagttccaaaaatagtttcttttccaaaggttgttgctctactttgtaggaagtctttgcatatggccctcccaactttaaagtcataccagagtggccaagagtgtttatcccaacccttccatttaacaggatttcactcacatttctggaactagctatttttcagaagacaataatcagggcttaattagaacaggctgtatttcctcccagcaaacagttgtggccacactaaaaacaatcatagcattttacccctggattatagcacatctcatgttttatcatttggatggagtaatttaaaatgaattaaattccagagaacaatggaagcattgcctggcagatgtcacaacagaataaccacttgtttggagcctggcacagtcctccagcctgatcaaaaattattctgcatagttttcagtgtgctttctgggagctatgtacttcttcaatttggaaacttttctctctcatttatagtgaaaatacttggaagttactttaagaaaaccagtgtggcctttttccctctagctttaaaagggccgcttttgctggaatgctctaggttatagataaacaattaggtataatagcaaaaatgaaaattggaagaatgcaaaatggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcaccccaggtaaacctgcattgtagcaatttgtaaggatattcagatggagcactgtcacttagacattctctgggggattttctgcttgtctttcttgagctttttggaaggataattctgataaggcactcaagaaacgtacaaccacagtgctttcttcaaatcatatgagaaatactatgcatagcaaggagatgcagagccgccaggaaaattctgagttccagcacaattttctttggaatctaacaggaatctagcctgaggaagaagggaggtctccatttctatgtctggtatttgggggttttgtttgtttttgctttagcttggtgaaaaaaagttcactgaacaccaagaccagaatggatttttttaaaaaaatagatgttccttttgtgaagcaccttgattccttgattttgattttttgcaaagttagacaatggcacaaagtcaaaatgaaatcaatgtttagttcacaagtagatgtaatttactaaagaatgatacacccatatgctatatacagcttaactcacagaactgtaaaagaaaattataaaataattcaacatgtccatctttttagtgataataaaagaaagcatggtattaaactatcatagaagtagacagaaaaagaaaaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttgaggttgtaaaatctgcatttaaataaacatctttgatcacaaaa

SEQ ID NO: 7034 - DNA, 4710 bp, Homo sapiens
taaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccaggtaaggcactgaactgtggttgtaaagtgcataccaaattgatcttgaagaacaataacatgcttttttagccatgtttgaaggtagtctaactcttctgatttattagcactaacgcactgcatttttttcctctagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttggtaagacggctttaacattacttatattaccttgcaaaagagaatgaagtgtatttgtttttaaaaggtggggaactgtataaatattcggtctgtggctcctatgcattaagcctctatttgagcctcactatcattcaatagcttgagtggaaataaaaagaggagaaaccactgcagcagttctggccttttggaactatgttgtaggtgctttctctcctggcatatgcatgaatcatcacacctgtccctcttgccagtgggattacagtactttacgatcagaccacctggttcaaatcccatcacagaaattgtcttgctgtgaaatctaaatcaaatgtctggactttttgttcctgtagtatggtgatggtaataatcaggattattgtgaggattgtataagtactagcacatagtaagcactcatgttgtttgctattattgttactcccacttctcccctctggtggcatgtaacctgcacggaccttggaggactgaacaaagggggcaaacgtgggaataaaagacaaagacaagagagtatatttggaagaaggggtcagggggcaccttgcctctagtggacaagggccctgagctttacacagccctctgtatttattaggcaaaagagatagtgagaagcaggggtgattgtcgggtaattgtcagtccatttggcagtttggttcacagcaggcttgcgagactgcatcatttgaacagtaggcgctagatttcccagtagataagttcaaggagccctgcaccagggagtgatggcccccagcaaaccctttggtggcaggctcagtgtgagtttactcacatcctgcattcatgataaacagtttgctgtttggtcatatagcctccagtggaatgctgagttggtcacgatccctttggcctttcttgctcccaacagtggcagtctgcacatagtgccctagcattcttctttgtatatcagagtatatgtagaactacatggaagaaagactagtcagaaaggataatggagaaggcatctgtgtcccctgttacctgtagtaacagcgtatagtctgtctctctccctatctcatctcctagtagaaaaagaaaactgtttcatttgcagtcatctgaattagtttagcatcaaagcctacgtcttttgtgatctaaataaaattatttttattactctgtttctctaaatctgcattataaaaagctaattttcctttttattttagggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattt

SEQ ID NO: 7035 - DNA, 8321 bp, Homo sapiens
gtggactacgtggaaccttctccccaaggtaggcagcaccctatgggagccgggtgtcctggggaaggaggtgggaggtgggcccagttcctgtacagagggcagctgacaccaaagtccttcagccctgctgtccatggtttctggacagtgtcctgtttcactcatcattactttaaagttcttgaccattatcgaaaacaactctggccaggtgcagttgctcacgcctgtactcacagcactttgggaagccaaggcaggccttgatcacttgagcccaggagttcgaggctatagtgagctatgattgcactactgcactccagcctgggtaacaagagcaaaactccatctcaaataaataaattaataaatattaaaaagtaaaaacaactgtttttattttcgagtacagttatagagagcagattcgtgtggcatgtcagctggtctgtgttagagttacaaagcaactttaaggaattccaaacactctagaagaacagggaagcctccagcagtcacctgaacataaattcaaatgtgctcttcccacgtcccaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggtaaggatctggcgccgtggcattccagtgcttttcttctactcttgggtggaagaggaagaggaggcttatcctcgatgagccctcatggggagtgggccgtaggatgggtttctcagccaggggcgactctgcgctgtctgcctcagacatttgggaatgtctggagacagttttggttgtcactggggaagggtttgctcccctttgcggggagcccagggatgctacagccatgcacagcacagccccaccaagaacagtgcatctccaaggccaggagtgcgggtgggaggccgcttcagctgagctcttctgggaaggggaccacgtggcccagccacacccacattggctcagataggcctctgcctgcagtgggtagcctttggggcacagagcagctgcatctggagagccgtgggtcagagcccctgttttctgtgagtccaaaggtctgcagccctgagcctgggacaggcggttgcacgtagggatggatgtcacgttttgccacctttaaaagcactcttgttttttgatatttctatgaatgtaccatttgaatctaatagtccatcgtgaggccctgcagctaacacctgtgttgtggattttacattttgtttcgtatcttcacaggaggaagatggcagaagctgttcaaaatcacgtgaaatccttgaactggggccaccgtgtccagcttcaggacaggtactgaagctctctccgggaatgggccgccctctgggccttctcttgggcgttctgtgcctggacacacacttacttactgtgcagagcatgctctggcaggctctgggggttcatgtcctgctcatgggtggggatgaggacaaggagcagatgggagtgactgtaggggaaggggagactgccctttgctgctgagcagagcctggaggtgctgccaaggaatgagtgaggccacattggcagaatggccagagcccagggctgcacagggaggaggcgcttggggctggaaggcctcaggccagagagcgtggacatagctaggcctggggctaatatgtggtgagggtcatcccagtggcaagcccccaccccgtgaacccccttcttactgcacacctccagctccttgggtgtgggtgcaggagcttggtgctttccgctggagcaaatgtccctacttggtcaccgttcctgtcagcccctggggatctccagcacagaggcctatgctcccctggcctacaaccttctcctggggctcagctgccagcacagcagatgcctgaaactggtaccgcctctggcccagcctttctcccggggctgtggaggggacagtggtcccgcagaggtctggtggctctcctcatgcaccatttgcttggccccagggcgggtcttcctggggcttcacagcaggcagcagttttgtgctcactaaatccaggaaagtggagccaggaagccaactgcttgccctccacctggacctcacaagctctcccctatccagggagctaagccacattgtgctgtggcatttctgtgtttctctgtggggctctgtatcccctggtacagtttcctggggacagcaggctctgccctccctcctccctgccctgggcagctcctggacgggcaccaaacaggcccagcccactgcctgctccggagccacctgcagaaggaggctggggcgcacctgggctgtttctgctttttcactcttctgaaaagtgctgccatgagcattgcccggctgtgtcccgtggcagcttcctggctgtcgaggtgattgaagggctcttgctgtaggaacttcacgcagctcagacagcccatagaggcacaggcttgccagtggggagaaggcaggctcaagcaggaggcagagccttcccagaacccttgctgcagcacggtccttttgtcattagaaagtgttggtcgggtgcagtggctcatgcctgtaatcctagcactttgggaggctgaggtgggaggatcacttgagcccaggagttggagaccagcctgagcaacatagttttattgctacatccctacaaaaaataaaatgaactagccaggtatggttgcccatgcctatagttccagttacttgaaacaaggcttccgtgagctatgatcatgccactgcactccagcctgggtgacagagtgagaagatgtctttaaaaaaaaaaaaaagggtggggcgcggtggctcatgcctgtaatcctagcactttgggaggctgaggtgggtggatcacttgaggtcaggagttcaagaccagcctggccaacatggcgaaaccccgtctctactaaaaatacaaaaattagccaggcgtggtggcgcaagcctgtaatcccagcttctcaggaggctgaggcaagagctgaggcaagagaatggcttgaacctgggaggtggagattgcagtgagccaagatcgtgccactgaactccagcctgggcgacagagtgagactttgactcagaaaaaaaaaaaagaaaagaaagcgtgggtcatttgtttctgtgcactatgctcccagccactgttttgccagccttgtcatgcccgttctcttggtgttaccacacccctgaaatcagaaggtgacaccatctggtgggcaccacagctccctgctggaacatgtccgggtgatgaggactgtccccaagagaggtccagccacctcttgctgcacaccagggctgtacgtggcctcttaggaccgtgctgagctggcttccgtccctgctttgacacctgtggttaacatgtccctgggatccctgggggacaggcgaggtgcccccacatcccctccatgcttctcagcatggttgccgcttacctcttggtccatctgagccacagcaccaggccctgctgggggctggagctcccttttaccagtgttccctattgatccagttggtgaggtttaatttgcagaggaagtgtttgaaaatcttatctttatctttcagaaaagtcaagtactttaacatcaaagccagctttgttgacgagcacacggtttgcggcgttgccaaaggtgggaaagaggtgagcatctgacttactcgcgtggctccttgtggacccttctgcagaccttgggcaccaactgcagctgtgtttggcctgggtgctgttcttagtaacacgtgctgctggaatcaaaaaggtggcttcttttgaggctgggcacttgtctttaacgtgatcaaataatttgctgccctgctgctcggagtggcatggcaacagggttggtgaccacaccctttttgcaggattttttggggatttgagggtgccttgaagtgcttggagttagaacatctccctgtgctttctgcctgtccccctcctgccaggctgatggttgatgggattccagctccatagggcctctgaactgctggccaagggtccacgctacagggcaggggccgtgggaactgctggccaaggtctgtggtgctcaggccctccggtggggtgatcaccatgcacctgtctgacccacggctttctctttttctcctcagattctgctgtcagccgatcacatcatcattgctactggagggcggccgagataccccacgcacgtgagtgtccccagagcatagcgtccctgctgccgtggcccattcccggcctctttgagggatacgtttttacacacgtgcttcccacagcagcagcttgcacaccctttccccctatactcactatcatcactttctgctttccaattctcttgaatccacactgctgaaatgtggggtccccagtggcctccacgctgccagatcctcaggacagctctcgttctgctctccccctgccccgctggatctgtccccttccacaccaggatcctgcttcctaagtctccattgctgattcccccttttcccttcagcctcagaatgttggaacattcaggatataagcctcattcttcatcttcctccttcacgtcccccagtttaaaaaaagtttgaaataaaattcacacgctataaaatttagccttttttagggtacaattcagtggtttttagtacattcacagagctgtgcggccatcagtcaccaccatccattgccagaactccttccatcatccctgaactgaaactattcccattaaaccctactccccagcgcctcctcccccagcccctagaaaccaccacctactttctgtctctatgaatgtgacaacactaggcacctcgtgtaagtgaaatcgtacatgtaagtccttctcatgtaactggtacgtgtgtgtcccttagtgactcgtatgtgtgtgtcccttagtgactggcttacttcactgagcataacatcctccaggttcacctacattgtagtgtgtgtcagtatcattcctttttatggctagatactattccattgtatggatagaccacactttgtttatctacttgcttggataaacacatgtgttatttccactttttagctattatgaatagtgccgctgtgaacatctgcaaagaagttttttggtggacttcagttttcacttctcttgggttacacttaggagcagaactgctgggtcatgtggtaactttatgttgaatctttcaaggaacgtttcaaggaacctcagactgttttccacaatgactgtgttttacattccttccagtggggtgtaagggtcatggtttcttgtttcttcacgtatcttgtaatttttttattgaaagctgaacatttcaaataatttaatgcgataactttggaaaccagattctccctctgccccaggattctgttgttacagctgcttatttggtgacttttcggaactgactttgtagactcttattctttgatgtatgtggccactgaagtctttacttggttagcttagtggtcagctaagaactgcatggagatttccctaaactaagaactctcccggtctttgctgagggctctgtgtgcgtttggaggggatgccttccacactcaacaggcagcagacagctctgccctagccttcacttcctgcttctgcagagatcaaggtcagctggaggtgagggttcagggcctcgttggtccttcctgatgtgtgcacagtgctgtgcatgcgcctggcctaggttcccaggaatatgctggaacctttcaaagctccagcagacatctcatactttggcttttcctttgaagctttttgggcagtctgttgttggctctaactgttacctatcccctcaggcagctgtgagaagaaaacctcagacaaatgcccccagagaaaggcttttagccctggctgagctccggtgaagttggatgaagatgaccctatagttgctgactctgactcttctttgtgggggggctttgaaagaccccagctgagttctgctctctctgacacatcactgttcagggctgccgctgaggtgggagtgggaccagagtgagttaaaacaccctggagttcccattctcactcagcttcagctgtttttcctgactttaaatgttccctgtgttgctgcaagcctgtggttaatttccataattctgaatctcccagttcttgccagttttatcgctgtttttaacagagaggtgaataactcctggcccagtcttgtgggttgtgggggcagagttgaggaaggggccccggggtgaggggttggggggcagctgcagcagggaaagcaaatgggctgggggtgagcagagaggtttggctgagaccagtccccacgggtctcccagggaaccgtgtgccgcctgctccaagcctctaagtaggctgcagccaagctcttgaagaccacggctctctcggcctggaggccacaccacctctgacttagacccaggggcagtccggtggaggcagagcaaggggaggttctgccacttcttggatgtgaccccagcctccacttcgtcctgtgcttactgtggaaacagggaaaggagcggccccgaggagcacaagcacccccagtccttagaggccgtgggacttgtctggccgccaggcagccacagcagcctctagagggggcaggttgcttatgcacagaggtggggctcagggctgcgtgactttgtaggatgacactgtgcagttgttcaaggcagctgctgcagacagggtcccagtgatcccctctcctggcagctgggctcatggtggttctgcttaaagaaggccacagccagcttccagcagcccagcggtcattgggtttctctgaggccccaggcagagctgcacgtgcatccgcaccagggagcactgcacaggggccctggcctggcccggccctgctctgcacctcacgggcagctgctgacggctctttgggctcacaggggatccagcaggcgctcctggtccttaggaggcaggcagctcagggctgcttcgctctccctgccacgccctcccagggtgtctgccaaggcttgcttgcgttttagtccctttgattgccagacctttcggttttccttgagtaaacctgagaaattcctgactttatttttttttgccagttggaagcataaactgtttgagatccgcttcctccaccagcacatcttgttctcatggccgctaaggggacgttcaccctgggcctcccacctgcttggccgcccctcttcaggtgacctgtatgatttctgggctcagagcccacccgggccagccctcgagagtgtgaagtccgtcctggcttcagccaggtgccctcagagctgcccctcagtccctgcccacctcagcctgtggcacttaccccctgtgcctcctctcctctggctggccttgtaggccacccctgccgcgcagacacacctgagctctgctggccctgatttgctgacctgttctctccccacttcctctctctgagtttggatcccccagaacccaggtgttgctccctggggctgcatgcccctgtctgtttgatgtgtctgtccagaacccgggcagacttgaggggtcccagctgtctgcctgtatggcccctgcagttgctgtacccacctcaggccctgtatcctgctctgaaccagggtcaaggggagggtcctggggaacagaggggaaaggtaccctgcgagggcaccgggacctggagtgcagcagcttagatgcagacaggccacctgcagccccaaagaggccacagcctgcagacaaggactggcagcagggaagccctgtgcatgtgtgccctgggaaagctctgcttgattctgcaaagctggcatcctctttaaggaagccctaggacaggccaaatggagctcttgtccaaggggtcatttctgtcttgacagatcgaaggtgccttggaatatggaatcacaagtgatgacatcttctggctgaaggaatcccctggaaaaacgtaaggcctgcgcgtgcttggtggggtcctctttttgttcaccagagtgagcactggacccttagagcctgtgctggtgctgggctcctggggctttctttccggtttacccaaaagaaggaaaaaa

SEQ ID NO: 7036 - DNA, 5204 bp, Homo sapiens
  misc_feature (151)..(151): n equals a,t,g, or c
ttttttatggctgcatagtattccatggtgtatatgtgccacattttctttatccagtctatcatttatgagcatttgggttgtttccaagtctttgctattgtaaatagtgctgcaataaacatacatgtgcatgcatctttatagtagnaatgatttataatcttttgggtatatacccagtaatgggattgctgggtcaaatggtatttctggttctagatccttgaggagtcaccacactgtcttccacaatggttgaactaatttagactcccaccaccagtgtaaaagtgttcctatttttccacatcctcaccagcatctgttgtttccagactttttaatgattgtcattctaactgatgtaaaatggtatctgattgtgatctcagtggtatctcattttgatttacatttctctaatgaccagtgatgatgagctttttttcatttgcttgttggccacataaatgtcatcttctgagaagtgtctgttcatatccttcacccactttttgatggggttgtttttttttcttctatatttgtttaagttccttgtagattctggatattagacctttgtcagatggatagattgcgaaaattttctcccattctgtagggtgcctgtttactctgatgacagtttcttttgctgcgcagaagctcttagtttaattagatgccatttgtcaattttggcttttgttgccgttgcttttggtgttttagtcatgaagtctttgctcatgcctgtgtcctgaaatgtattgtctagattttcttctagggtttttatggttttaggttttagatttaagtctttaatccaccttgagttaatttttatataaggtgtaaataaggggcccagtttcagttttctgtgtatggctatccagttttcccaacaccatttattaaatagggattcctttctgcattgctagtttttgtcagatttgttgaagatcagatggttgcagaagtattatttctgaggcttctgttccattggtctacacatctgttttggtaccagtaccatgctgttttgggtacggtagtcttgtagtacagtttgaagtcaggtagcatgatgcctccagctttgttctttttgcttaggattgccttggctatacaggctcttttttggttccatatgaaatttaaagtagtttttccaattctgtgaagaaagtcaatggtagcttgatgggaatagcattcaatctataaattactttgggcagtatggccatttttatgatactgatttttcccatccttgaacttggaatctttttccatttgtttgtgtcctctcttatttccttgagtagtggtttgtagttctccttgaagaactcctacatgtcccttgtaagttgtattcctaggtattgtattttctttgtagcagttgtgaatgggagttcactcttgagttggctctctgtttatctattattggtgtataggaatgcttatgatttttgcacattggttttgtatcctgagactttgctgaagtcgtttatcagcttaaggagttttggggctgagacattggggttttctaaatatacaattatgccatctgcaaacagagacaatttgacttgctgtcttcctatttgaataccctttattttttttctcttacctgattgctctggccagaacttccaatactgtgttgaataggagtggtgagagagaatatctttgtcttctgccagttttcaaaaggaatgcttccagttttgcttattcaatataatgttggctgtgggtttgtcataaatagctcttattattttgagatatgttccatcaatacctagtttattgagtttttagcctaaagggtgttgaattttattgaaggccttttccgcatgtattgagataatcatgtggtttttgtcattggtcctcttatgtgatggattatatttattgatttgcctgtgttgaccagccttgcatcccaaggatgaagctgacttgatcatggtgtataagctttttgatgtgctactggaatcggtttgcctgtattttattgagcatttttgcaccaatgttcatcagcgatattggcctgaaattttctttatttcttttttttttttttgtacctctgccaggttttggtatcaggatgatgctggtgtcataaaatgagttaaggaggagtccctctttttccattgtttggaatagtttcaaaaggaatggaaccagctcctctttgtacctctggtagaatttggctgtgaatccgtctggtcctgggctttttttggttggtaggctattaagtattgcctcaatttcagaacttgttattggtctattcagggattcgaattcttcctggtgctgtcttgggagggtgtacatgtccaggaacttatccatttcttctagattttctagtttatttgtgtaggggtgtttatagtattctctgatggtagtttttatttctgtgggatcagtggtgatatctcctttatcattttttattgtgtctatttcattcttctctcatttcttctttattagtctggctagtggtctatctattttgttaatatttttgaaaaaccagctgctggatgtgttgatttttggaagggttttccatgtctctatttctttcagttcatctctgatcttagttatttcttgtattcttgtaccttttgaatttgtttgctcttgcttctctagttctttcaattgtgatgtaagggtgttgattttagatctttcccactttctcctgtgggcatttagtgctataaatttctctattaacactgctttagctgtgtcccagagattctggaacattgtctttttgtcctcgttggtttcaaagaacttctttatttctgccttaatttcgttatttactaagtagtcattcaggggcaggttgttcagtttccatgtagttgtgcggttttgagtgaatttcttaatcttgagttctaatttgattgcactgtggtctgagagagtgtttgttataatttctgttcttttgcatttgctgaggagtgttttacttccaattatgtggtctattttagaataagtgctatgtatattctgagaagaatatatattctgttgatgtggggtggagagttctgtaggtgtctattaggtccacttggtccagtgctgagcacaagtcctgaatgtccttgttaattttctgtctccattgacccatctaatgttgacagtggagtgcaaaagtctccaactattattgtgtgggagtctaaatctctttgtaggtgtctaagaacttgttttataaatgtgggtgctcctgtattagattcatatatatttacgatacttagctcttcatgttgcactgatccctttaccactacgtaatgccctactttgtcttttttttatctttgtttgtttaaagtctgttttatcagaggataggattgcaacccctgctttttttcactttccatttgcttgttaaatcttcctccacctctttattttgagcctatatgtttctttccatgtgagatgggtcttctgaatacagcacactgatgggtcttgactctttatccaatttgtcagtctgtgtcttttaactggggcatttaacccatttacatttaaagttaatattgttatctgtgaatttgatcctgtcatcatggtgctagctggttattttgcacattagttgatacagtttcttggtagtgtctttggtctttatattttggtgtgtctttgcagtggcttgtactggttcttcctttccacatttagtgcttccttcaggagctcttgtaaggcaggcctggtggtgacaaaatcccccagcatttgcttgtgtgtaaaggattttacttcttcttcacttatgaagcttagtttagctggatatgaaattctgggttgaaaactcttttctttaagaatgttgaatattggcccccatcctcttctggcttgtagggttcctgcagagagatctgctgttagtctgttgggcttccctttgtgggtaacctgacctttttctctggctgcccttaatattttttccttcatttcaatgttggagaatttgacagttatgtgtcttggggttgctcttctcaaggagtatgttagtagttctctgtatttcctgagtttgaatattggcctgtcttgctaggttggggaagttctcctggataatatcctaaaatgtgttttccaacttgattccattctccccatcactttcagggaccccagtcagtcataggtttggtctttttctatagtcccatatttcttggaggctttgttccttttcattcttttttctctaaccttgtcttcacaccttatttcagtaagttgaccttcagtctctgatatcctttcttccacttgattgatttggctattgatacttgcttatatttcatgaagttctcgtgctgtgtttttcagctctattaggtcatttatgttcttctctaaactggttattctagttattagttcatgtggccttttttttttttaaaggtttttagcttccttgcattgggttagaacaagcttttttagctcaagagtttgttattaccccccttctgaagcttacttccatcaattcctcaaactcattctgtgtccatttttgtgcccttactagagaggatctgggataatttggaggagaagaggcattctggttttttaaattttcagcatttttgcacggttttttcctcatcttagtggatttatctacctttgtactttgaggctgatgacctgtggatgagattctgtgtgggggtcctttttgtcgatgttgatgttattgctttctgtttgttaggtattctaacaggcaggcccctctgctgcaggtctgctgcagtttgctggaggtccactgcagaccctatttgcctgggtatcaccagcagaggctgcagaacagcaaagattgctgcctgctccttcctctggaagtttcgtcccagaggggcatggacctgatgccagctggagctctcctgtataggtgtctgtcaactcctgttgggaggtctctcccaatcaggaggcatggaggtcagggacccacttgaggagcagtctgtctcttagcagagctcgag

SEQ ID NO: 7037 - DNA, 1160 bp, Homo sapiens
attttttcctttatttttgtcaaatgagtttatttgaagaaccagcctttgagctctgagattatgtcctcagtttggtctgttctgctgttaatgctaccaactgaattatgaagttcttatagtgaactttccaattccagaagttcagtttgattttttcttaaaatggctatttcttatgtcagctcttggatcattttactggattacttgggttccaaggattgggtttcaactttttcctgaatcttgatgaacttctttgtcattcagactctgaattccatttctgtcgttttaatcatttcagtctagttaagaattattgctggggagctactgggctcatttggaggtaagggggtactctggcttttagaattgccagaattcttgagctgattctttctcatctgtgtggattgatattccattaacttttgaaattgatattcttcagatggagcttttagctgttatgtttttttaatgctgttaagagtttgactgtggtataccttgggcttagttgattgtctttgtttctgacactgatgctttcagaggaacaaagctcagttcagcctccctaggcagaattctttaactctggggtactgggactgggaacacagctttattctctgtccccttaagatcaagcatttgctgcactgggggtgtgggaggatatggtgctcccagcctgctggcaacagtgctctgttggaggtttccagcagaagcactgttggggctgttgagtggccttgaacaaaacctctctgatgggtgtctgccagcaaaagcactccagtgggatggcaggggtggccaatgagagagctatggtggtggctctggtaaaagcactacagcaggttgggtttgggttgctgcaagcaagtgtgcttcagtcaggcagcgggcagccacaggcaaaagtgctctggcatggtggctgaggattcatggacgaaaggactccagcaggttggcagggtggccatgggtgaaagatctccattgcagcagcagggacactgcagatactctggtgtgagtaagcactctggcagggcagtggataggttccaggcaaaagcactctgatatgggtcccctatttctttgcagtaaacatttaaaaaaaaact

SEQ ID NO: 7038 - DNA, 3049 bp, Homo sapiens
gtaaataccctatgaatattgaatgaatgagtttgtggattttaaatatttaaccaaagatgtaatattttttgttgtgtatggtttttcatgagcctgtttgtaaaattaattctttgttttccagttgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatccattttgtatagtttatttcaatctaaataaaatgtgaattttgtttaaagcttaggcacattattttttgtggggtccaaacattcttgtgtaaaattctcttaaacatttgataaacagcttcacaattca

SEQ ID NO: 7039 - DNA, 1153 bp, Homo sapiens
ctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatgcctaagagacttttaaaaacaggctttcttatatttgatatttggaagtaaaagccgtaaggtgtatgtaggccacttaatcactaaatatctttgcctataggactccattgaatacattagccattgataatctacctgtttaaatggcccctgtttgaactctcaagctttgaagacctacctgttcttccagaagagaacgttgaaagttccatgtttccttttgcgtgatctctgttgacggcactctggaattgtttcagttaagtcattttagacatagcatttattatcactgtggatctctacttgttgggtgttatgaattctttgaaaaaatatattttgaagaggtgtgggaggaaggaatacattttataaaatgttatagttaagcccacaattgacctttgactaataggagttttaagtatgttaaaaatctatactggacagttgcaagaaattaccagagaaaagcttgtgagctcaccaaacaaggatttcagtgtagattttgtctttctcaaacttaaagaaacaaatgacaaagtttgaatggaaaagcctgctgttgttccacatctcattgctgtttacattcctttgtggagcctacatcttcctaagctttttagcaggtatatgttgaacacttctgtttcatggttgagacagaatcagaggccatggatactgacaactgatttgtctggtttttttttctgtcttttttccatgactcttatctactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaaagtgagttttgtttaaagctaaaaaaaaaaaaaaaga

SEQ ID NO: 7040 - DNA, 3048 bp, Homo sapiens
gtaaataccctatgaatattgaatgaatgagtttgtggattttaaatatttaaccaaagatgtaatattttttgttgtgtatggtttttcatgagcctgtttgtaaaattaattctttgttttccagttgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaagcttaggcacattattttttgtggggtcaaaacattcttgtgtaaattctcttaaacatttgataaacagcttcacaattca

SEQ ID NO: 7041 - DNA, 3043 bp, Homo sapiens
gtaaataccctatgaatattgaatgaatgagtttgtggattttaaatatttaaccaaagatgtaatattttttgttgtgtatggtttttcatgagcctgtttgtaaaattaattctttgttttccagttgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaatgtgaattttgtttaaagcttaggcacattattttttgtggggtcaaaaccattcttgtgtaaattctcttaaacatttgataaacagcttcaca

SEQ ID NO: 7042 - DNA, 38771 bp, Homo sapiens; identical to SEQ ID NO: 6652
  misc_feature (7892)..(9416): n equals a,t,g, or c

SEQ ID NO: 7043 - DNA, 779 bp, Homo sapiens
agccttcatccaggtgagaatgtgctgcagctggtttctttgggaggcctgtgggttaaagtaagcgatagtctatatgccgtgtggccatctacgaataagggctgggattgctggtggctctggtgcagcacagtcactgctttttccatacttggagagcctatgggagtgcgattttgatagggcttgaattgcaggaagagcccatggctcccaaggtggggcttgcatttctatcaagtagctgttaataatggggcagttgctgggcaactgtgtgctcagcagctgggcttttccctcagcccctctactaacctgctgtgaggcaagacaagggcaggacactaacgttcctgtctcctgattctttttctttaccattccttaagagaaggaaagcagagacggtccagtcctgtgatttctcagtgcttgttctaatcatatgtgctgattccctgttgaatgaagatgaaggccgggtgcggtggctcaggcctgtaagcccagcactttgggaggccaaggtgggtggatcacctgaggtttggagtttgagaccagcctggccaacatggtgaaaccccatctctactaaaaatacaaaaattagctgggcatggtaagtgggcgcctgtaatcccagctacttgagaggctgaggcaggagaattgcttgaacccaggaggcagaggctgcagtgagccgagatcgcgccatcgcactccagcctgggcgacaacactgtctcaaaaaaaaaaaaaaaaaaaaa

SEQ ID NO: 7044 - DNA, 5775 bp, Homo sapiens; identical to SEQ ID NO: 6656

SEQ ID NO: 7045 - DNA, 738 bp, Homo sapiens; identical to SEQ ID NO: 6657

SEQ ID NO: 7046 - DNA, 587 bp, Homo sapiens
attggatcctacagctaagattatttggaagcatgtcctgtgccctttctctgagagttaccccgttatctttgtgtgtctcactgtctctcatcaggcttaaaaaaaataccaaagcttttctcaccccaaaagactgtctcctgacctgccacctcacacagttgtctcttcccttcattgccaaactttcaggatgagcatactctagccttctcgaagtgtggcttctgtcccccttcccccaggtgccaaagccaggagtcagccttccctaggttcacctacttccctgcagcatctaacagactatccctccttcctgccgaaactactcctccaccgctaagaatttaggcagtagggccaggcatggtggctcacgcctgtaatcccagcactttgggaggccaaggtgggtggatgacctgaagtcaggagttcgagaccagcctgaccaacatggcaaaaccctgtctctactaaaaatacaaaaattagccaggtgtggtggcaggcgccaataatctcagctactccagaggctgaggcatgagaatcacttgaacctaggaggttgaagtaag

SEQ ID NO: 7047 - DNA, 753 bp, Homo sapiens
gtcccagctactcaggaggctgaagcgggagagtcacgtgaacccgggaagcagagtgagctgagcacacactactatactccaggctgggtaacaaagcgagactcccatctcccaaaaagcagttctggaatagaactcacgctagatggatagaccagtggacactttggaaccttggggctggggaggaaactgcccatccagtaaacccccaaaaagccatttgttctgcactacgtatattgcttattctttctggtcttaagtacttgcctctcaacctccctttttagtaaaagacaaggccacgtgagaggcgggactatcaacattgtgatgaatttacttgaaacccagtgcccaaaatcaatgtaggtagccaagtccaaaaacctgttctagtccaactagtgaaatcaaactgtgatacttggataagcttagaaggaaacgtgaagaatacgtagctgctttgggtttactctggttcagttgggctgttgaaatcttaacatccttgggcttatcacctactgcttgtcagccctgttccatgtccaggggatgggggtggtgacaatccagttccaagaccctcatgctctagagaggaaggtggccagccagggttgtaactacgatgaaaaagcagtgggagggtctcctatgaggcaagcctaaggacaaaaaggaaggccttgcagcctgtattctggataaggaattaaaagctcagttaattgaagccca

SEQ ID NO: 7048 - DNA, 38771 bp, Homo sapiens; identical to SEQ ID NO: 6652
  misc_feature (7892)..(9416): n equals a,t,g, or c

SEQ ID NO: 7049 - DNA, 945 bp, Homo sapiens
cagatttcctgagaagcctcttatcacagccagcacagacatctgtgcctttcctcgcctgagatgtcaccagctcagggccactccctgccccagccagatcaatgggcctttcacggcttctgagggtggatcctaggagtgcccctgtgacgaatgctcagatgactgcctctctaggatttctgtttgtttctgcttcgcagtcttccctccacccagaagctcccgaatgtccaggaagaattgactaattctctccatgagtttcttgcccacaggacgaatggagccattgctgtaacaaccttattttccactaagtcagaataagagacctggacagaaagagagtaatggctgaggcacaaggagcgagtattttaaatcaggcttatgaatgtgctctgtggatacggtttgcccatagggaggtggttttgggggttgcgaatcatactcaagctgtccctgaccgactcaccagtattctacaaacttactacaaacctctcaaaggaccatcttggaagacactagcaagggcgtgaacaatcccctctgacgttgctggctggtggtggaggccacggagcctccctgtgtgagactgtactatgtggtcactagaacgttttgaaagacagttctctgcaggcccggcaccgtggctcacgtctgtaatcccagcattttgggaggctgaggcgggtggatcacgaggtcaagagatcgagatcaccctggccaacatggtgaaaccctgtctctactaaaaatacaaaaattagccgggcgtggtggcgggcacctgtagtcctagctactcaggaggctgaggcaggagaatggcgtgaacccgggaggcggagcttgcagtgagctgagattgcgcaactacacttcagcctggcgatagagcgagactccatctcaaaaaaaaaa

SEQ ID NO: 7050 - DNA, 5775 bp, Homo sapiens; identical to SEQ ID NO: 6656

SEQ ID NO: 7051 - DNA, 738 bp, Homo sapiens; identical to SEQ ID NO: 6657

SEQ ID NO: 7052 - DNA, 352 bp, Homo sapiens
ctagaaaggggcctcaaccatgattatgagttgtctgtaaacctggaccagagttcaggtctccggatcctccatcaggaaatcacagggtggggtgagtaacatgaagccggcttccactctgggatgtcagattcctggcatggggtgatgcagggggcttggaacattccagaggaaacaaaagcgagatgagcagagacaaagagctgtgaacaccaggttcaaaatgcatgagtgagggtgttggaaaacttcccaggggtggtggctgcccaagtcaaaggacaccaacaggaaatgcaaagtcccagggtcccagggctagcaggaagctttgcctccaggctgt

SEQ ID NO: 7053 - DNA, 177 bp, Homo sapiens
aaaatacaaaaaaattagctgggcatggtggcgggcgcctgtagtcccagctacacgggaggctgaggcaggagaatggcgtgaacccaggaggcggagcttgcagtgagccaagattgtgccactgcactccagcctggatgacagagtgagactccgtctcaaaaaaaaataaaa

SEQ ID NO: 7054 - DNA, 20113 bp, Homo sapiens
gcccagcatgccccccatcgggctggataacgtggccacctatgcggggcagttcaaccaggactatctctcgggaatggtgagtccagctctcctgctgaggcagccctggggccacacctgcgtggccagaggaatcaaagctgctggcctctggggctccagagttgtctgtgtgtgtgttgctgtggtttgtagtgtgttgagctgtaccttagaacagggttttcatcaggcttctgccacctgctctctgcccctctctgggtctcacttttcccatctgtaaaatgaggggaaggggaccagatgatctcacaggtccctttcagccctgaggggttagggttgggaaggtggcgagggtatctgcatgagtgtgcatgcacgtgctatgtatgagtatccacattcatatacctgcatgtgcatgtgtgtacatatggagggctcttctggttaggccttggtgggtgtgtggcaggtatcttgggcagacatgctactttttaaatttgttgtttcacttttaaaataatacattttatgatttgaaaacaaacatatgcttagtttatgatttgaaaacaaacgtatgcttagaggaaattatgcaaccaatacacaccctaatttgtgccaggcccagttctaggcactggggatatgtgaataaaacaaacaaaaatctcagccgtgctgcacttatcatctatggggaaaagacaggcagtaccttaagtcaacgatgtgatgttattgaaagtgtaggtgccataggaacaagttgaccagggtaaaggggtcaggagtgggggtggggtgatgtaaggataatgattttaagttagcagtaaggtgggtctggctgaaaagaggatgtgtgagcaaagacctgcatcaggggaaggaagtgctgtatggatgtctagggaatgccggtgccctgaggtgccaaggggtgtgaggtgctcagggacagggaggagaggccagtgtggctaaagtggaaaggcgagggggtgagatgggaaatgaagtctgggggtctagctcttgcagggtgtaggaggctatccatcctaaggatttaggtttttattcctggtgagtgcagattcacctgaacatgcctgccagaggtgtctgtgggtagcaggctgatgtgatggggatgcccccaaccctgcatatgggacccacgcaccttcttgggcagtgagctcttaaccttcacccaggtggtctgggatgggaggagcaaccatgtggagagggaaggcatctcccctgcagaaggggatgaggatctctggtttggatcgagtcgcactgttcactggctgtgtaactttgagcaagtaaactcattctgtggtctgtgaaatgggtataacggtacttcatattccacaagcggagatgctgtgaggactgacttggcttaggtatgaaaaagggtggagggacggagtgcagcagggcccattggcctcaggctctgctttgtgtccttgcaggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccaggtgagtgtcagcccactgcctcccttggtccaggcctgggccccaaaggctggagacacatggctcagtagatggggagacagggaaaggcgcaggcctccagctgcacttcttgttttaacaaatagtgtcggccgggtgcagtgactcatgcctgtaatcccagcactttgggaagctgaggtgggcagatcgcttgagcccaggagttcaagaccaacctgggcgaaatggtgaaaccctatctctactaaaaatagaaaaaaaattagctgggcatggtggtgcatacctgtaggcccagctactcgggaggctgaggtgggaggatcacctcagcccaggagacagaggttgcagtgagccgggatcatgccgctgcactcactccagcctaggtgacagagtaagacccagtttttaaaacaaaaacaaaaacaaaaaaagacaaacaaagagcgtcaccttcttgcagactccccacctctgggttgtgttgcttaaggcccaagggagctgtcctgtttctcctggtgtgatgagacgctccacatccgagttgggtcagaacacccctggcgagtactccttattcctctgtgtcatttactgcctgggctgtgtgttttgtaagaactgcccaggccacctgtctcaagactttgtgctcaacagctgtcttcggtcccttgatatgcaccacccccgccccccccggcacagacaggttttggaggattattaaaattccctttgggtagggagaatgttggcagttcctccagggttgatcttggctcattttggagaacagttcgtgtttgcagagcctagaattcgttgtcatggttctgtggcccaaccagccagcacaggggtagtggtatgtgctcaatgactatttttagacagagggtctcctttcctccttcccttccatacccacacgttcccccaccctgtgccatcctccagcctccctcccttatcttttccctgagctgccctcttaattgtgttataaccagtttgtaccagcccctaggaagacaatccactgggagacagtttagcctggaaagttccagtttgcgggtttgtgcagctatcagggtctggaggaagtccggcagatgctagtctagagaacagtgcgagggaaccagtgctagatcaagaggtcatcaggctgccatgcacagttgtggaggctcaatacctgcatccactggaggggacacatgggctagccagccctgttaggagtacccatgtgtgctcacatgtgctgtggaggccaggcatcgatgagagaggccacagcccctgctcccgagacctgcccttcatcaggagcctgagccccagccctggaggacctgggcactgggcagattttcagcatcaggactcagctataggtgagctcccagccactggagccaggaaaaagcttcagtactagaacacaaggccagataacagtcaagttaggtagacgcggcgtaaagtcctctgcattgttgactgtggactcctttagatactccaactcttagagaaagggctgttcccagagtctaggggtggagcagccttgaatgtggggaaggcggcatgcacgacatcttacctgagactgtttgtccgagtagtttggaagccgaggcaccatcactgatgctcccggctttgaccccctgcgagatgccgaggtcctgcggaaggccatgaaaggcttcggtaagagaccctgggtggctcaaatcctactccctgccccctatttcccaggcagtttcactgtggctctgtgggctggggtagctgggggacgctgacctggccccagtggtgatagaaggtggatgtgggggtatggctagcatgcccagaacagttgaggggcccaggccagggaagtctcagctgcagagcatctcatgacccctacccgacccacccctgctgcctcttcctccagggacggatgagcaggccatcattgactgcctggggagtcgctccaacaagcagcggcagcagatcctactttccttcaagacggcttacggcaaggcgagctgcggggtgggggcgcgggacagtgaggcgtgtcctgggctcagcacagccctgctctcccctgcttttccttgggtgggcccggatctcccggatggacagtaaggagcaggagggcatttccttctgcccatccagctggtggcatcgttgggaggtgaaggatgccaccgggtgctgaggtttgctgagaggctccagacatctatccctgggttctagcccttgctctgccacatctcactgaggttgtggccacatcattttccttcccctgccctcttcatgaccaccctggggggtttagctgatgtaagagctttgcagggaaaggctgtgagtgctgcccaagtacgaggggcgtgtatgagcatattttgaacttctggggttttgaatcttagaaagataaaaattcggtaaatattgattagattcgtgttctagcccagtgcttctcaaacttcattgtgtcaccgatcccctgggcatcttggtaaaatgtggtctctgatttgggaggtttggggcagggctgagagcaggcttttctctcaggcccctgggggatgtccatgctgctgttcctcaaatctgggatatggctcttattagtcacttcctgtggattttttaaatagacttgtttttttttttgttggttgtttgtttgaatatccaatcaggatttgatcaaagatctgaaatctgaactgtcaggaaactttgagaagacaatcttggctctgatgaagaccccagtcctctttgacatttatgagataaaggaagccatcaaggtgtgtacgtgtgtgtgtgtgtgtgtgtgtgtgtgtgtgtgcgcgcgtgtgtgcgcacgcgcgcatgcgtgtggacacacagcccagaaggaggcctggatggcgtgctgtgttctagcccactcattagctgctgttgtcagtatggctcccaggccttcctgggttggagtccacatgctatagaaaagggaactccctgtgatttccccaagaggcaaatgacgcaccagtcatcatcagggaggcttaagtctctctccatcttaaagaaaagggggagctcgggtttgaaggttgcgattctgtggtaagaagaggggtaggaggccatggttggtatcgttctcattctttaggactctgttactagcaaatgacagaaacacacttcggtttaagaacaacaaaagtggagaatcagtcatgtgggtaaagagggcccaggccagacgtctctctggtctctgtctctcctgagcgcccgcttttctgtcagtttctgtgcttctcctaccatggctgcttcatgtggggtgggagagggggcctgtcgaccactctccgcataactatgagacccagctccagaagagaccagcagggtctccaaacgggcaggttctgacgggcccggcttggactcactgttccctccagtcctgcgggttttgactgagggttgggtcctgtccattctgtgcagtcccacagctctgtgtgcaccctgcaggcaggggcaggcagctcccttggaaagggaatcccatgagtcaggctggagcccagaaggagcctgtcactcagaggcctgataagcacagtgaatgttccctccttcaggagaagcagagacttcagtgtggtggcctggaaaggagaggggtctccgctgaaacacatctacatgtgttattctagggagggggtcaggaggccatcaggcagggcgatggcccggggccccagggagtggacccagacatctccctggcccccgtcttcagccggagtcatgagctggtggttgtggagtgttagaaaccacacaggtttggggcagctgtcactcaccagctgtgtgtccttgagcacctgtgaaatggggacagtggatgctgtctcaggacatgctgggaatactgggtgaggggctaacgtgtagtaacccaatagtagctgtagcaggaaacagctgacacaatgtcgcacgtcctgcctgacaggccctaagtgctctacgtacattaactcacttaatcctcatgactttcctgtgaggtaggtcctagtatcactcccatcttacagacaaggaactggaagcacagagaggttaagtaatgtgcccgaggtcacacagctggtaagctgcagagccaggattcaaaccaacatacaagccaggctgcccagcctgtcctctatggtcttactgtccctggcgtggttgtccgattcatccttgttgttcctaccttttcctagttgttttcagacattccaccatcccctctaggaccagggtttcgtatgtccacttggatctctcttgctttttacccatttttttcagttgttgtcatctcgcttccggctgaactctgaataaagcaggcctcggtccacattttaacccaaccatttactgtgtggcctcggaccagccagtacccctctctgatgctcagttttctgatccatggggatgcccctttgtgtgagccctactcatcaccactgccactgtcattgtgcttgcccgggctgtggagaagagctgatgccctcgagcctgggagtggctggagggtgtgtctctgtgtcaggggcctctgttgctgggattaaggcagcagcgtagcccccacccttcttcccgagtgctggtgaggctgctggaacaagcacatggttggttgtattctctgcccctgcagggggttggcactgatgaagcctgcctgattgagatcctcgcttcccgcagcaatgagcacatccgagaattaaacagagcctacaaagcaggtgaggccgctccctctgccctctgccctctgccctctgcagatccctgtgctcttggggctgtggcctcattctctcctagggccttttactccttcctggccttcttatcaacccatcttctgccacccccaatactttgggctttgacccaagacccagcccttccttctgtttatacatggtgcaaatgactaatgtaagggagaggcagggaaaacctggatgtggtttgggccaaggctgactagaggccaggtcagcctggaggtcacaggcttgtatatccctggagggccatatgggctatttgttctcttgagcccgagccaagacctccagcctttttctccccagtacccacttttgatagtgttttgcaatgggcagctccataaagagagctacaggatggaccttccttgcttctccctttcagaattcaaaaagaccctggaagaggccattcgaagcgacacatcagggcacttccagcggctcctcatctctctctctcaggtacttttcccacgacagggctcggggcccccaagccatggaagtcaaagagatgggatccccgcaatgaggaaagggaaaataaatggggaaggagtgggcatgaccatacacctgcttcctttcagggaaaccgtgatgaaagcacaaacgtggacatgtcactcgcccagagagatgcccaggtgagtgtgatggccaagcccctggacttcctaaagcagggatgcaccccgctttcttgcttcctgagagaggtaccctagggtggaaagaacaatagataagcagtgggttgcagatgctgtgagtttcagacgcgctgaactgttcaactgtatgacctagaacaggtaatctgacctccagggcttcagcttccccacctataggagggaacatgtgagataattagtatttcgatagttgatagatcatggttttggacgtgggattttgtgtgacagcgtactttccccatgtttagttgcacatagcattatgtttgcaaaggggcaaaatttgcacttgcttattaagtttttgaggatttgagcctagaaaccagctgccacattagttgagcacccttagaattctgtcgttgtccctcttgtgagttgcagacaaaaggggaaaagtccaagcaaagtccaggcatctgagctactctctcgaaaagtttgggtttcccactaatgaatttcaaccgtagtattatggcagggcagagccattacttcctggtggggtggagttggccatacctctctgtctcccttcactgctcttgtcatccacggcagggcattcaccaggagctgccagtggtctaaattatctctaccatctgcgggattggaatgagacctcaaggaatgcccccttgttagggctggaggagagctactcctctggtctggtccttttgctggtcctccttttccggaggaggaaactgaggctcaaaaaggttgagcactgttcccaactgaaagctagaagcagagcccggacaagggcctatactcctggctcggtcttctgtgcccagtcagcacttgcctctgccctggtctcagacctgctgctcctgcagggtctgccttattcagtgtctctctggctggtaacatccattcccattctgggagtcagggctggacacgcctggggctcagggctctggcttttgctccagcgagagttttgcatgccacttttagcggggcaaaaattgtctcatgctctgccttctcagtccagagctgctttggcctcatcttgacctgtgggatctcagcccctgattgctgctttctgctctttttcagggctgctacctgaggcctagcaggcactttagaggccatctagttcagaggttgcaaattggcaaatactttaggctcaaaccttcagaagtttaccaggctctcctgggtgacctgggcctggggtctgggtgtggcctgtgccacatgtgcgtcttcctctctctccaggagctgtatgcggccggggagaaccgcctgggaacagacgagtccaagttcaatgcggttctgtgctcccggagccgggcccacctggtagcaggtaaggcaggctggggtccctcagaggccagttagatgagggcagtcaggggattgtggggaaacaaagctatgggaacacttggtcgttcctccctgcgtggggctttcgcctcctcaaaagagccccctggtgggaatttaaaagacactgtcagagggtttcctgagttctggcaaacatccagttctggaggttctaccggtgtagaaacctggtgtctttgtacgtgggaatgtggaacgtcagagttgggagggtccttcgggagcacccaatccagtgttttccaaagcctggcataagaaacagtcataacaataaaactgggtgccattcatttactcattcattcaacagatgtaaatcgcgctcccgcatgggtcagtctgtcaggtggtggagcaggtgtggggccacggtggggggcagggcactgcagagtgtgttccatgggctgcactttctcatttggggagacagacagtaaacaacaatgaaataaaatctgtatcagatgggaaatcctgtagaggaaaatcaagctggaaacaggtagggagtgatggtagggtccaccgggaggtgcttgggccagtccccactgaggtcgtgacatttgatttaaaaacctaaagggagatgcaggggcagaggcctgcctggggctcccagcacgactgagaacagtgaagggggaccatgtggagcaggtggagtgagcaagaggagtgggaggtgagggcagagaggggagagggccctgctgatgacttcccggagctgggtatttatcctgagcaaaagaggaagccagtggagggccctgagcagaggaggctgtgcagaatccctggctgtggtgccgagaatggagtgaagggtgcaaggccaagcagcgaagcctgtcgggaggctgctgcagggacccggggaggaatggtggtaataggggcttgtggtgaggaggtgtcaggttccggccatgtttgctgatgaattggacacgtgacgtgtgggagagagagggttcgaggattatacagggtttctttaggccaagcagtgggagaatggccctcaactgagacagggggactgtaggtggagctggctttaggtgcctgtagggtggagctgcagggaggctgctgggttgctgagtgtggaggtcaggagaggtctggcctggttgtggaaggtaagggagctatgggtagttgaagttatctgaggctctgggactgcaggaggtcccctcaggagggagactgtggggagcccaccggtgtgaggagactaagaaggagcagctagggagggaggaggacgcagaggaagggggtcctggaggccagtgtgaggtggcaggcaaggactgaggatggtgaccacacggagcaactggtgggctgtggccagggctgctccagtgggcagtgagggtgaaaacccagcgaccgctctgtgctgcacacagagacaggcgctgtggctctccccattcgcagctgtgaaagcaggcacagggtggtagaggaagtaggggtgcacagctagtaacagctgagctgggatttgaacccagaccacccgaccccagagcacactttttaacctctgcactatcctgtaatggagcctgagtgaaagcattttcatcttaatcattatttcttttaatgagtacagaacatgtaagtagtgcatcaagcccatggcttcacaaacattattacttaggagaaaagagtagctgattggaagaagatattaattgagacagatacacacagagcagaaatcacaactttaaaatgcaaatggtagctgagactcaggctggggaaggagagttttatgtcctgggtcagaactggagtcaggaccaaggtctccatcatgccacctgtctctctaggagccagccatccactcctgtgggtgcttagcgtgtcctaggtcgaggtgagcagcaagaagccaggctggctggggcaggctgggcctcagctcacaggcaggctgaggaagacagatggatgcatgaataaagccaaggaatggcagagactggaggtgtggaggatttgacaagagggaaaaaatgtcttggagtacataaaagtggccctggaggggtattaaggtgcgatttggttaagcagattggcagtcctgagaaagggaccacacagggagggacatcaggtggtgcatgtaacttgtgacgaagactctgacttccttgagcgctagcaggcctggggacgtgcagggtgtgggagcagagtggcaggtgggagattttggggcagaggccacctcatgtgagtcctctgttagtctgctcatgctgccatgacaaaataccacagactgggtggcttaagcagcagatactcattttgttacagttttgaaggccagatatccaagagtggggtgccggtttctcccgtggcctcttcgtgacaatcactgtgctcacatggtctttcctctgcatgtgcacatccctgggatctctgtgtgtgtcctaatcttctcttcttctaaggagaccaggcgaattggattagggtacaccctagcagcatgttttaacttaattacctctttaaagatcttatctccaaacacggttatattctgaagtcctgggagttgggacttccacatatgaactttggggagacacatttcagttcataatataagcctctgtcatccccatagttttcaatgagtaccagagaatgacaggccgggacattgagaagagcatctgccgggagatgtccggggacctggaggagggcatgctggccgtgggtaagtgtctcaggtttgccgcccacctgccaggggctaacgtgtatcgtgagtgttcaggctgctcgcctgtcctccagctgatgggtgacaccgtgaagggaccacaggatccaagatcgctcagcccagagtgtccagatgctgggaagtcatgctgcttcccggttccctgtgcagttgaacccctagctgtcctggaggtgtcttgtgtgtgtttgcggtgcagctctggagtagggaactgcagtgtgggtattagtgggagggcatccaactgcgctcccggaggagtatgactcatatcctgccacgtttcctctaaaaatacatccctgcaggcagttgtcagatgtttgtgatggaaacacgtggaaagatttttacttgcagcagcgaaacaggcccatgctgaggaaagctggcttggctccaggatggtggtgtgcctcttacattgcccatgtcctctagcagggccctcccactgtgcagagttgggtccctgccctgaggccctcacaacccctctttctactcacttgggaaaatcagtctgccccttttttcattatgctttttttggagctttctggatgggagagatggaaaatcctcatttccctgcctgtcccccatagtaggtctcatggcctgggaagcctagggagatgcacattccactcagccacggtttctccatgacggtcatggcctctccagtctgcccctcctgcctgagcagcagcacagttcctcatcaccatccacattgcttccctgtgtagctcctagccccactaagacccccgcccctctgactcttggtcctttcaccgcagtggttgccaggaaagagggtgggttggtttccaggctttgcgtgtttctgttccaaatagctggagccaagatcatgggatagttgagcctggaacagaaggaggaggagaaaagatggatgcagtgatgggtttgacatctgggcctctaagaggacacttgtagactccatgccctgcttgggctgagaattttctgcagatctggttatgccgagtttctctcttctagtgaaatgtctcaagaataccccagccttctttgcggagaggctcaacaaggccatgagggtatgtaacttccatgtgcaggttgcgatggaaccttagcctcgcctgtgcctgggaccaagggctgagggcagaaggcctggggagagctaaatctcagctgagagttccgaggacctgggtagggaggggactggagggcccagggcaggtgggaaggtgaggaggcctggtgctcatgctcttgggtggactctctttagggggcaggaacaaaggaccggaccctgattcgcatcatggtgtctcgcagcgagaccgacctcctggacatcagatcagagtataagcggatgtacggcaagtcgctgtaccacgacatctcggtacgggcctgctgcaggccaactgggctcccttttggcatctcagtcacctgtggaacctccctccttggagtggccatatgcttggcctctgtgctgtgtgtgggcatcttgattatggacctcggacttgttcatccccttgcccttaaacagattataaatttctgagggcaggtggatcatgaccttgctgtcgcccccaccttgcatcccccagcagcatcagagaacactcgggacctccccaaccttgaccgtgaccttcagcgttccgatcaccgtgtgattccttgatctgtcagtgagaactcatgtcccaaaggctctgtggagctctgctgtcactccctgacaaagcacttcctgcactcagctttatggcgtaggccacatagtaaggccgttcagagcgagggccctgggggtcacgccacttggagtccagcttttctacttgctaactgtgtgaccttgaatggctcccttaaatctccctgaaccccagctccattgtctttaagatgagaaaataatcgttccttcctgggaatgttgtgagtattgagtgaggcagtgcaggtcaagtgtctattaaacactagccacagttgtatcgctgtgtggcagagccagtctgacaaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaagaagccacatgccttgccctcaagttgcttagggtggaaggaaatgattagaaatgagccaagccgagcctgcactcttagagtaagtgtagtggcctcagacagaggagagatccctgggacctgggcagtctgagccttccactggacagtcatgtgtgaggagattgcatttcctgagcaggacactgtgttgcgttacattggtaaccccaatttaaggcagcataaatgcactgggaaaacagcaatattggttagccctgggaagtggtttttaggatgattataatttttttttgtgggtattcatttgatgtggatagctggggtgagtgctgctttccgtcttctgatgggggcctggagaaggctgaactgcattttttaaggtctgtgacgcctgctgcaggacctgcagtgggagaaaattccccagggtggggctttctccctataagggtgctcagggctgaatatcaggacccagaaggctgaaagtgactgtccctcccttaacggatgtcttccttgtttctgtggccagggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctaggccaggccccttgcccttgggtgccaggtgggacctgcctgatgggatggggtgcttggcatatacaacttgccatgaactcccgccgcaaaatgggggcctcctgaaatagtgaggggacactagaaccaatgtgctctgatgtgaccatattctgtgacattaccatgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaagagagctttgttgtgttttagcttaccctggccccatcccccactccccagcatggcagcagcatcaaaaacaatatccctcattccctgtataggttcctgtcactggaggtagcagatta

SEQ ID NO: 7055 - DNA, 20110 bp, Homo sapiens
gcccagcatgccccccatcgggctggataacgtggccacctatgcggggcagttcaaccaggactatctctcgggaatggtgagtccagctctcctgctgaggcagccctggggccacacctgcgtggccagaggaatcaaagctgctggcctctggggctccagagttgtctgtgtgtgtgttgctgtggtttgtagtgtgttgagctgtaccttagaacagggttttcatcaggcttctgccacctgctctctgcccctctctgggtctcacttttcccatctgtaaaatgaggggaaggggaccagatgatctcacaggtccctttcagccctgaggggttagggttgggaaggtggcgagggtatctgcatgagtgtgcatgcacgtgctatgtatgagtatccacattcatatacctgcatgtgcatgtgtgtacatatggagggctcttctggttaggccttggtgggtgtgtggcaggtatcttgggcagacatgctactttttaaatttgttgtttcacttttaaaataatacattttatgatttgaaaacaaacatatgcttagtttatgatttgaaaacaaacgtatgcttagaggaaattatgcaaccaatacacaccctaatttgtgccaggcccagttctaggcactggggatatgtgaataaaacaaacaaaaatctcagccgtgctgcacttatcatctatggggaaaagacaggcagtaccttaagtcaacgatgtgatgttattgaaagtgtaggtgccataggaacaagttgaccagggtaaaggggtcaggagtgggggtggggtgatgtaaggataatgattttaagttagcagtaaggtgggtctggctgaaaagaggatgtgtgagcaaagacctgcatcaggggaaggaagtgctgtatggatgtctagggaatgccggtgccctgaggtgccaaggggtgtgaggtgctcagggacagggaggagaggccagtgtggctaaagtggaaaggcgagggggtgagatgggaaatgaagtctgggggtctagctcttgcagggtgtaggaggctatccatcctaaggatttaggtttttattcctggtgagtgcagattcacctgaacatgcctgccagaggtgtctgtgggtagcaggctgatgtgatggggatgcccccaaccctgcatatgggacccacgcaccttcttgggcagtgagctcttaaccttcacccaggtggtctgggatgggaggagcaaccatgtggagagggaaggcatctcccctgcagaaggggatgaggatctctggtttggatcgagtcgcactgttcactggctgtgtaactttgagcaagtaaactcattctgtggtctgtgaaatgggtataacggtacttcatattccacaagcggagatgctgtgaggactgacttggcttaggtatgaaaaagggtggagggacggagtgcagcagggcccattggcctcaggctctgctttgtgtccttgcaggcggccaacatgtctgggacatttggaggagccaacatgcccaacctgtaccctggggcccctggggctggctacccaccagtgccccctggcggctttgggcagcccccctctgcccagcagcctgttcctccctatgggatgtatccacccccaggaggaaacccaccctccaggatgccctcatatccgccatacccaggggcccctgtgccgggccagcccatgccaccccccggacagcagcccccaggggcctaccctgggcagccaccagtgacctaccctggtcagcctccagtgccactccctgggcagcagcagccagtgccgagctacccaggatacccggggtctgggactgtcacccccgctgtgcccccaacccaggtgagtgtcagcccactgcctcccttggtccaggcctgggccccaaaggctggagacacatggctcagtagatggggagacagggaaaggcgcaggcctccagctgcacttcttgttttaacaaatagtgtcggccgggtgcagtgactcatgcctgtaatcccagcactttgggaagctgaggtgggcagatcgcttgagcccaggagttcaagaccaacctgggcgaaatggtgaaaccctatctctactaaaaatagaaaaaaaattagctgggcatggtggtgcatacctgtaggcccagctactcgggaggctgaggtgggaggatcacctcagcccaggagacagaggttgcagtgagccgggatcatgccgctgcactcactccagcctaggtgacagagtaagacccagtttttaaaacaaaaacaaaaacaaaaaaagacaaacaaagagcgtcaccttcttgcagactccccacctctgggttgtgttgcttaaggcccaagggagctgtcctgtttctcctggtgtgatgagacgctccacatccgagttgggtcagaacacccctggcgagtactccttattcctctgtgtcatttactgcctgggctgtgtgttttgtaagaactgcccaggccacctgtctcaagactttgtgctcaacagctgtcttcggtcccttgatatgcaccacccccgccccccccggcacagacaggttttggaggattattaaaattccctttgggtagggagaatgttggcagttcctccagggttgatcttggctcattttggagaacagttcgtgtttgcagagcctagaattcgttgtcatggttctgtggcccaaccagccagcacaggggtagtggtatgtgctcaatgactatttttagacagagggtctcctttcctccttcccttccatacccacacgttcccccaccctgtgccatcctccagcctccctcccttatcttttccctgagctgccctcttaattgtgttataaccagtttgtaccagcccctaggaagacaatccactgggagacagtttagcctggaaagttccagtttgcgggtttgtgcagctatcagggtctggaggaagtccggcagatgctagtctagagaacagtgcgagggaaccagtgctagatcaagaggtcatcaggctgccatgcacagttgtggaggctcaatacctgcatccactggaggggacacatgggctagccagccctgttaggagtacccatgtgtgctcacatgtgctgtggaggccaggcatcgatgagagaggccacagcccctgctcccgagacctgcccttcatcaggagcctgagccccagccctggaggacctgggcactgggcagattttcagcatcaggactcagctataggtgagctcccagccactggagccaggaaaaagcttcagtactagaacacaaggccagataacagtcaagttaggtagacgcggcgtaaagtcctctgcattgttgactgtggactcctttagatactccaactcttagagaaagggctgttcccagagtctaggggtggagcagccttgaatgtggggaaggcggcatgcacgacatcttacctgagactgtttgtccgagtagtttggaagccgaggcaccatcactgatgctcccggctttgaccccctgcgagatgccgaggtcctgcggaaggccatgaaaggcttcggtaagagaccctgggtggctcaaatcctactccctgccccctatttcccaggcagtttcactgtggctctgtgggctggggtagctgggggacgctgacctggccccagtggtgatagaaggtggatgtgggggtatggctagcatgcccagaacagttgaggggcccaggccagggaagtctcagctgcagagcatctcatgacccctacccgacccacccctgctgcctcttcctccagggacggatgagcaggccatcattgactgcctggggagtcgctccaacaagcagcggcagcagatcctactttccttcaagacggcttacggcaaggcgagctgcggggtgggggcgcgggacagtgaggcgtgtcctgggctcagcacagccctgctctcccctgcttttccttgggtgggcccggatctcccggatggacagtaaggagcaggagggcatttccttctgcccatccagctggtggcatcgttgggaggtgaaggatgccaccgggtgctgaggtttgctgagaggctccagacatctatccctgggttctagcccttgctctgccacatctcactgaggttgtggccacatcattttccttcccctgccctcttcatgaccaccctggggggtttagctgatgtaagagctttgcagggaaaggctgtgagtgctgcccaagtacgaggggcgtgtatgagcatattttgaacttctggggttttgaatcttagaaagataaaaattcggtaaatattgattagattcgtgttctagcccagtgcttctcaaacttcattgtgtcaccgatcccctgggcatcttggtaaaatgtggtctctgatttgggaggtttggggcagggctgagagcaggcttttctctcaggcccctgggggatgtccatgctgctgttcctcaaatctgggatatggctcttattagtcacttcctgtggattttttaaatagacttgtttttttttttgttggttgtttgtttgaatatccaatcaggatttgatcaaagatctgaaatctgaactgtcaggaaactttgagaagacaatcttggctctgatgaagaccccagtcctctttgacatttatgagataaaggaagccatcaaggtgtgtacgtgtgtgtgtgtgtgtgtgtgtgtgtgtgtgtgcgcgcgtgtgtgcgcacgcgcgcatgcgtgtggacacacagcccagaaggaggcctggatggcgtgctgtgttctagcccactcattagctgctgttgtcagtatggctcccaggccttcctgggttggagtccacatgctatagaaaagggaactccctgtgatttccccaagaggcaaatgacgcaccagtcatcatcagggaggcttaagtctctctccatcttaaagaaaagggggagctcgggtttgaaggttgcgattctgtggtaagaagaggggtaggaggccatggttggtatcgttctcattctttaggactctgttactagcaaatgacagaaacacacttcggtttaagaacaacaaaagtggagaatcagtcatgtgggtaaagagggcccaggccagacgtctctctggtctctgtctctcctgagcgcccgcttttctgtcagtttctgtgcttctcctaccatggctgcttcatgtggggtgggagagggggcctgtcgaccactctccgcataactatgagacccagctccagaagagaccagcagggtctccaaacgggcaggttctgacgggcccggcttggactcactgttccctccagtcctgcgggttttgactgagggttgggtcctgtccattctgtgcagtcccacagctctgtgtgcaccctgcaggcaggggcaggcagctcccttggaaagggaatcccatgagtcaggctggagcccagaaggagcctgtcactcagaggcctgataagcacagtgaatgttccctccttcaggagaagcagagacttcagtgtggtggcctggaaaggagaggggtctccgctgaaacacatctacatgtgttattctagggagggggtcaggaggccatcaggcagggcgatggcccggggccccagggagtggacccagacatctccctggcccccgtcttcagccggagtcatgagctggtggttgtggagtgttagaaaccacacaggtttggggcagctgtcactcaccagctgtgtgtccttgagcacctgtgaaatggggacagtggatgctgtctcaggacatgctgggaatactgggtgaggggctaacgtgtagtaacccaatagtagctgtagcaggaaacagctgacacaatgtcgcacgtcctgcctgacaggccctaagtgctctacgtacattaactcacttaatcctcatgactttcctgtgaggtaggtcctagtatcactcccatcttacagacaaggaactggaagcacagagaggttaagtaatgtgcccgaggtcacacagctggtaagctgcagagccaggattcaaaccaacatacaagccaggctgcccagcctgtcctctatggtcttactgtccctggcgtggttgtccgattcatccttgttgttcctaccttttcctagttgttttcagacattccaccatcccctctaggaccagggtttcgtatgtccacttggatctctcttgctttttacccatttttttcagttgttgtcatctcgcttccggctgaactctgaataaagcaggcctcggtccacattttaacccaaccatttactgtgtggcctcggaccagccagtacccctctctgatgctcagttttctgatccatggggatgcccctttgtgtgagccctactcatcaccactgccactgtcattgtgcttgcccgggctgtggagaagagctgatgccctcgagcctgggagtggctggagggtgtgtctctgtgtcaggggcctctgttgctgggattaaggcagcagcgtagcccccacccttcttcccgagtgctggtgaggctgctggaacaagcacatggttggttgtattctctgcccctgcagggggttggcactgatgaagcctgcctgattgagatcctcgcttcccgcagcaatgagcacatccgagaattaaacagagcctacaaagcaggtgaggccgctccctctgccctctgccctctgccctctgcagatccctgtgctcttggggctgtggcctcattctctcctagggccttttactccttcctggccttcttatcaacccatcttctgccacccccaatactttgggctttgacccaagacccagcccttccttctgtttatacatggtgcaaatgactaatgtaagggagaggcagggaaaacctggatgtggtttgggccaaggctgactagaggccaggtcagcctggaggtcacaggcttgtatatccctggagggccatatgggctatttgttctcttgagcccgagccaagacctccagcctttttctccccagtacccacttttgatagtgttttgcaatgggcagctccataaagagagctacaggatggaccttccttgcttctccctttcagaattcaaaaagaccctggaagaggccattcgaagcgacacatcagggcacttccagcggctcctcatctctctctctcaggtacttttcccaccacagggctcggggcccccaagccatggaagtcaaagagatgggatccccgcaatgaggaaagggaaaataaatggggaaggagtgggcatgaccatacacctgcttcctttcagggaaaccgtgatgaaagcacaaacgtggacatgtcactcgcccagagagatgcccaggtgagtgtgatggccaagcccctggacttcctaaagcagggatgcaccccgctttcttgcttcctgagagaggtaccctagggtggaaagaacaatagataagcagtgggttgcagatgctgtgagtttcagacgcgctgaactgttcaactgtatgacctagaacaggtaatctgacctccagggcttcagcttccccacctataggagggaacatgtgagataattagtatttcgatagttgatagatcatggttttggacgtgggattttgtgtgacagcgtactttccccatgtttagttgcacatagcattatgtttgcaaaggggcaaaatttgcacttgcttattaagtttttgaggatttgagcctagaaaccagctgccacattagttgagcacccttagaattctgtcgttgtccctcttgtgagttgcagacaaaaggggaaaagtccaagcaaagtccaggcatctgagctactctctcgaaaagtttgggtttcccactaatgaatttcaaccgtagtattatggcagggcagagccattacttcctggtggggtggagttggccatacctctctgtctcccttcactgctcttgtcatccacggcagggcattcaccaggagctgccagtggtctaaattatctctaccatctgcgggattggaatgagacctcaaggaatgcccccttgttagggctggaggagagctactcctctggtctggtccttttgctggtcctccttttccggaggaggaaactgaggctcaaaaaggttgagcactgttcccaactgaaagctagaagcagagcccggacaagggcctatactcctggctcggtcttctgtgcccagtcagcacttgcctctgccctggtctcagacctgctgctcctgcagggtctgccttattcagtgtctctctggctggtaacatccattcccattctgggagtcagggctggacacgcctggggctcagggctctggcttttgctccagcgagagttttgcatgccacttttagcggggcaaaaattgtctcatgctctgccttctcagtccagagctgctttggcctcatcttgacctgtgggatctcagcccctgattgctgctttctgctctttttcagggctgctacctgaggcctagcaggcactttagaggccatctagttcagaggttgcaaattggcaaatactttaggctcaaaccttcagaagtttaccaggctctcctgggtgacctgggcctggggtctgggtgtggcctgtgccacatgtgcgtcttcctctctctccaggagctgtatgcggccggggagaaccgcctgggaacagacgagtccaagttcaatgcggttctgtgctcccggagccgggcccacctggtagcaggtaaggcaggctggggtccctcagaggccagttagatgagggcagtcaggggattgtggggaaacaaagctatgggaacacttggtcgttcctccctgcgtggggctttcgcctcctcaaaagagccccctggtgggaatttaaaagacactgtcagagggtttcctgagttctggcaaacatccagttctggaggttctaccggtgtagaaacctggtgtctttgtacgtgggaatgtggaacgtcagagttgggagggtccttcgggagcacccaatccagtgttttccaaagcctggcataagaaacagtcataacaataaaactgggtgccattcatttactcattcattcaacagatgtaaatcgcgctcccgcatgggtcagtctgtcaggtggtggagcaggtgtggggccacggtggggggcagggcactgcagagtgtgttccatgggctgcactttctcatttggggagacagacagtaaacaacaatgaaataaaatctgtatcagatgggaaatcctgtagaggaaaatcaagctggaaacaggtagggagtgatggtagggtccaccgggaggtgcttgggccagtccccactgaggtcgtgacatttgatttaaaaacctaaagggagatgcaggggcagaggcctgcctggggctcccagcacgactgagaacagtgaagggggaccatgtggagcaggtggagtgagcaagaggagtgggaggtgagggcagagaggggagagggccctgctgatgacttcccggagctgggtatttatcctgagcaaaagaggaagccagtggagggccctgagcagaggaggctgtgcagaatccctggctgtggtgccgagaatggagtgaagggtgcaaggccaagcagcgaagcctgtcgggaggctgctgcagggacccggggaggaatggtggtaataggggcttgtggtgaggaggtgtcaggttccggccatgtttgctgatgaattggacacgtgacgtgtgggagagagagggttcgaggattatacagggtttctttaggccaagcagtgggagaatggccctcaactgagacagggggactgtaggtggagctggctttaggtgcctgtagggtggagctgcagggaggctgctgggttgctgagtgtggaggtcaggagaggtctggcctggttgtggaaggtaagggagctatgggtagttgaagttatctgaggctctgggactgcaggaggtcccctcaggagggagactgtggggagcccaccggtgtgaggagactaagaaggagcagctagggagggaggaggacgcagaggaagggggtcctggaggccagtgtgaggtggcaggcaaggactgaggatggtgaccacacggagcaactggtgggctgtggccagggctgctccagtgggcagtgagggtgaaaacccagcgaccgctctgtgctgcacacagagacaggcgctgtggctctccccattcgcagctgtgaaagcaggcacagggtggtagaggaagtaggggtgcacagctagtaacagctgagctgggatttgaacccagaccacccgaccccagagcacactttttaacctctgcactatcctgtaatggagcctgagtgaaagcattttcatcttaatcattatttcttttaatgagtacagaacatgtaagtagtgcatcaagcccatggcttcacaaacattattacttaggagaaaagagtagctgattggaagaagatattaattgagacagatacacacagagcagaaatcacaactttaaaatgcaaatggtagctgagactcaggctggggaaggagagttttatgtcctgggtcagaactggagtcaggaccaaggtctccatcatgccacctgtctctctaggagccagccatccactcctgtgggtgcttagcgtgtcctaggtcgaggtgagcagcaagaagccaggctggctggggcaggctgggcctcagctcacaggcaggctgaggaagacagatggatgcatgaataaagccaaggaatggcagagactggaggtgtggaggatttgagaagaggggacactgtcttggagtacatgggagtgggccctggaggggtattaaggtgcgatttggttaagcagattggcagtcctgagaaagggaccacacagggagggacatcaggtggtgcatgtaacttgtgacgaagactctgacttccttgagcgctagcaggcctggggacgtgcagggtgtgggagcagagtggcaggtgggagattttggggcagaggccacctcatgtgagtcctctgttagtctgctcatgctgccatgacaaaataccacagactgggtggcttaagcagcagatactcattttgttacagttttgaaggccagatatccaagagtggggtgccggtttctcccgtggcctcttcgtgacaatcactgtgctcacatggtctttcctctgcatgtgcacatccctgggatctctgtgtgtgtcctaatcttctcttcttctaaggagaccaggcgaattggattagggtacaccctagcagcatgttttaacttaattacctctttaaagatcttatctccaaacacggttatattctgaagtcctgggagttgggacttccacatatgaactttggggagacacatttcagttcataatataagcctctgtcatccccatagttttcaatgagtaccagagaatgacaggccgggacattgagaagagcatctgccgggagatgtccggggacctggaggagggcatgctggccgtgggtaagtgtctcaggtttgccgcccacctgccaggggctaacgtgtatcgtgagtgttcaggctgctcgcctgtcctccagctgatgggtgacaccgtgaagggaccacaggatccaagatcgctcagcccagagtgtccagatgctgggaagtcatgctgcttcccggttccctgtgcagttgaacccctagctgtcctggaggtgtcttgtgtgtgtttgcggtgcagctctggagtagggaactgcagtgtgggtattagtgggagggcatccaactgcgctcccggaggagtatgactcatatcctgccacgtttcctctaaaaatacatccctgcaggcagttgtcagatgtttgtgatggaaacacgtggaaagatttttacttgcagcagcgaaacaggcccatgctgaggaaagctggcttggctccaggatggtggtgtgcctcttacattgcccatgtcctctagcagggccctcccactgtgcagagttgggtccctgccctgaggccctcacaacccctctttctactcacttgggaaaatcagtctgccccttttttcattatgctttttttggagctttctggatgggagagatggaaaatcctcatttccctgcctgtcccccatagtaggtctcatggcctgggaagcctagggagatgcacattccactcagccacggtttctccatgacggtcatggcctctccagtctgcccctcctgcctgagcagcagcacagttcctcatcaccatccacattgcttccctgtgtagctcctagccccactaagacccccgcccctctgactcttggtcctttcaccgcagtggttgccaggaaagagggtgggttggtttccaggctttgcgtgtttctgttccaaatagctggagccaagatcatgggatagttgagcctggaacagaaggaggaggagaaaagatggatgcagtgatgggtttgacatctgggcctctaagaggacacttgtagactccatgccctgcttgggctgagaattttctgcagatctggttatgccgagtttctctcttctagtgaaatgtctcaagaataccccagccttctttgcggagaggctcaacaaggccatgagggtatgtaacttccatgtgcaggttgcgatggaaccttagcctcgcctgtgcctgggaccaagggctgagggcagaaggcctggggagagctaaatctcagctgagagttccgaggacctgggtagggaggggactggagggcccagggcaggtgggaaggtgaggaggcctggtgctcatgctcttgggtggactctctttagggggcaggaacaaaggaccggaccctgattcgcatcatggtgtctcgcagcgagaccgacctcctggacatcagatcagagtataagcggatgtacggcaagtcgctgtaccacgacatctcggtacgggcctgctgcaggccaactgggctcccttttggcatctcagtcacctgtggaacctccctccttggagtggccatatgcttggcctctgtgctgtgtgtgggcatcttgattatggacctcggacttgttcatccccttgcccttaaacagattataaatttctgagggcaggtggatcatgaccttgctgtcgcccccaccttgcatcccccagcagcatcagagaacactcgggacctccccaaccttgaccgtgaccttcagcgttccgatcaccgtgtgattccttgatctgtcagtgagaactcatgtcccaaaggctctgtggagctctgctgtcactccctgacaaagcacttcctgcactcagctttatggcgtaggccacatagtaaggccgttcagagcgagggccctgggggtcacgccacttggagtccagcttttctacttgctaactgtgtgaccttgaatggctcccttaaatctccctgaaccccagctccattgtctttaagatgagaaaataatcgttccttcctgggaatgttgtgagtattgagtgaggcagtgcaggtcaagtgtctattaaacactagccacagttgtatcgctgtgtggcagagccagtctgacaaaatacattctcagctgtgtggtctaacgctcaaattctgaactcacatgagccttgcaattgcaccatggggaccacgtcctcccaccttagactcagtagcatttgatgatggtgggcatgtcatcacaggaaactcactgtgtttccttggctgtatgaatgaagctgttgttagagaattagtgattctaggctgggcacagtggctcacgcctgtaatcccagcactttgggaggctgaggcaggtggatcatttgaggtcaggagttcgagaccagcctggccaacaaggtaaaaccctgtctctactaaaaatacaaaattagctgggcttgcctgtaatcccagctaattaggtaggctgcggcaggagaattgcttgaacccgggagacagaggttgcagtgagctgggatcacgccattccacttcagtcttggtgacagagtgagacttcgtctcaaaaaaaaaaagagagttaataattcattacagagtatctcctgcatgccagcaagctatggacatctggaagaagccacatgccttgccctcaagttgcttagggtggaaggaaatgattagaaatgagccaagccgagcctgcactcttagagtaagtgtagtggcctcagacagaggagagatccctgggacctgggcagtctgagccttccactggacagtcatgtgtgaggagattgcatttcctgagcaggacactgtgttgcgttacattggtaaccccaatttaaggcagcataaatgcactgggaaaacagcaatattggttagccctgggaagtggtttttaggatgattataatttttttttgtgggtattcatttgatgtggatagctggggtgagtgctgctttccgtcttctgatgggggcctggagaaggctgaactgcattttttaaggtctgtgacgcctgctgcaggacctgcagtgggagaaaattccccagggtggggctttctccctataagggtgctcagggctgaatatcaggacccagaaggctgaaagtgactgtccctcccttaacggatgtcttccttgtttctgtggccagggagatacttcaggggattaccggaagattctgctgaagatctgtggtggcaatgactgaacagtgactggtggctcacttctgcccacctgccggcaacaccagtgccaggaaaaggccaaaagaatgtctgtttctaacaaatccacaaatagccccgagattcaccgtcctagagcttaggcctgtcttccacccctcctgacccgtatagtgtgccacaggacctgggtcggtctagaactctctcaggatgccttttctaccccatccctcacagcctcttgctgctaaaatagatgtttcatttttctgactcatgcaatcattcccctttgcctgtggctaagacttggcttcatttcgtcatgtaattgtatatttttatttggaggcatattttcttttcttacagtcattgccagacagaggcatacaagtctgtttgctgcatacacatttctggtgagggcgactgggtgggtgaagcaccgtgtcctcgctgaggagagaaagggaggcgtgcctgagaaggtagcctgtgcatctggtgagtgtgtcacgagctttgttactgccaaactcactcctttttagaaaaaacaaaaaaaaagggccagaaagtcattccttccatcttccttgcagaaaccacgagaacaaagccagttccctgtcagtgacagggcttcttgtaatttgtggtatgtgccttaaacctgaatgtctgtagccaaaacttgtttccacattaagagtcagccagctctggaatggtctggaaatgtcttcctggtaccaacttgttttcttctgcttgattctgccctgtggctcagaggtctggccttatcagccagtgaaagttcatgtaaccttacgtagagatttgtgtgcaggaaaccctgagcatacactagtttgcagggactcgtaaggacatgggaagggaggttcccgaaatccaggcaggaggcccagacacctgaaaggcaaagggatcttggttggttgcaggtgcagtgaagtccactgaaggtgtggtgcgaagaatgcagtccttcacccaggtcccaggagggaagaagggtgtgtgctaattcctggtgcccctcggcgggggccagagagaaggatggggacaacccagagagtcacaagaccagtgcctcccctcagggtgcctccaggctgaaaggggctcctggctctggtctctggggaccctgtgcccgttggttggtggtgtgagggaagagaatccataagagagtttctgagaattatggtgtcatgtccagaagctagagcttaccttgcatcaggggtctccacccactccttttccaacctcctgcgttgaggtttagaaaagagagaatcgactaggcactatggctcacgcctgtaatccaaggactttgggaagctgaggtgagaggatcacttgagctcaggagttcaagactagcctagccaacagcgagacccctgtctctactaaaaaatttggccaggcgtggtggctcacggctgtaatcccagcactttgggaggtgaggcgggcagatcacctgaggtcaggagttcgagacccagcctggccaacatggtgaaaccccatctctactaaaaatacaaaaattagccaggcatggtggcacattcctgtaatcccagctacacaggatgctgaggcaggagaatcacttgaacccaggaggcagaggttgtagtgagctgagatcacaccattgcacttcaacctgggtggacagagtgagactctgtctcaaaaaaaaaaaaaaatttacctggcattgtagtgcattccctatagtcggctactctggaggctgaggcaggaagatccttagagcccaagaaattgaggccgtagtaagctgtgattacaccactgcactccagcctggacaacagagcgagaccttgtctcaaatgagaaaaaaacaaaaagaaatgggagaatccagagagactaggctagatcaagcctgctgggtcctggcaggagccccagggagtagctcatctgcagacatttgcttgaggactaccccctaaacataaaggaagaatgacatccgaagggtgtggagcagccatgagctgagaactagcctggtctacctgagattgatggcaggtcctggtcaacacgtcagctctgcgtcagagtccatgcctcaagcccaagctgaagccccatccctgctgctctcccaagaactcctctgctagggcaggccccttgcccttgggtgccaggtgggacctgcctgatgggatggggtgcttggcatatacaacttgccatgaactcaaggtgaccctgggggcctcctgaattgtgatggggcctagaaccaatgtgctctgatgtgaccatattctgtgacattaccttgccctgtttactccaaagttcccagcctggtgcccagcaggcaatattgcacctacagacacatttactttggtttccaaagtgtttttagacatttgaatttgttgccaacatttaaacattgagagatttcatatttttaaaaatctggaattctggcttctcttgaaaactcagaaattctggcactatggggcttgcattcctgcatggctggagctgagttgcagctgcccctttaggcctgtactccttatttgctataggctccgtcttgtattacactaagcccatgtcacccatttggctcctgcaggcctttgggtttgagaccctggtctacacacttggagaccacctgttgtaaagtacatggatgtgctttggtcaaggaatagaccaaggtggatatccaggccagagtgactcagcgagtttaggtcacaggcgtatactccacttgttatataacctgcttgtgtaagttcatacttggctcaaagccactattgtttggaaaaggtataactgccctgctgacgctgtacagatgttcttgggctcggatgggcatggctccacgtggtgtgcactagcacccagagagagtgaagctattgacccctgtaagggagagtgaccatctggcagatagatagaggggagccaggacatggctcagcttgtgcccagagggagagttaagccgctgaccctgtagccagggagtgcacctgcaagcatgggggtggcaggagccacagagctggctgctgagaggagctgcagatctggagaagacagcctaggtaaaggtggacagtgtgagagctgctgatgagatagctgctgaataaaactacattttacctgcctatggcccgccaggttttctttcagctatcgcccatccacccagtcccctcgaacctcagcatgggctggaacctgaccctgggcatgacatttggcatagttgtggacctgacacctgtgtttgtcctagtcctgtttctccctgccttcctgttcctctcgctgccctcatggtcactcccaagagatccaacccatgttaagtatgggctggaggactgcatgaatgcctcatgatcttcccagaggcaaaggcacctactgccttccaaggtcagtgggaggttgggatcaacactgtttattatgcttaggacaaaaaagatagggagaaagatgtgcaaccttacaggtcatctttctgggatagaacacaatgggtcttctcctgcctcctggatatgttagtcaaggccagtccatgctacacatctagtctgacttctaaaatagaagcaccagatgaattcagccctgagagaattttcagcagctgtgggggcgctggaggaaacactattaaatagttttgcacctgagacagatagcctcactcgcctcaccctagtcctggtggcatttgtctcaggtgcaaaatttaagaaagaaaccttggagtgctcaccctgtggctgggtagatggtcctaaagtggtggttttcaagcctgagtgtgtatcaggatcatcaggggagcttgctaaagagcagttcctgcggtcagaccctcatgcattttgagcaggtgtggggactgggaaactgcatctgtaacctgctgtaatctaacgcttatctaaatactactgtgctcacacagagaacaccgcaaaagtagaggtgttcctccagagggcaggtgagcagatggcacagtctgcttggaattcagtcaggtgatgagagatgagatgaggcactcctagctttgggaagagggagctgaaagatgaacctttgcaggtgcccacggtcaaagtggtggtttaatgccatgccatgcccattttctgttggccttggcagggagttacagccctaccttaggacctggctccttatttctgctgtaggctctttcctgccctggccgagatggagtggaatgagacctagaaacatcaagctaaatacatgtcctcagaaagataaaggtttacattttcacccccatcaaatctgaaagctctctgcctgtgtttttctaagggatagggacatcattactcagtccacaacctggactcatgtagggtcccctgtcagtaaaggagtcagtcaagcccaccaggtataccaaggactcttaccctcagcccctactccttggaaagctgccccttggcctaatattggtgtttagcttgagcctgactccttctcaacactaagagctgatgaagtcctgaagcagaaagagctctgacctgagagtcaaacatccttattctgatctcagctcagcccctgatttgttgtgtgaccctggatatgtcacttcctgtctttttgactttttaaaatgaagggtagactagaggagagcttctaaaactttaatgtggtcaacgaaatggaataggaaattccacaagtctgtccttccacaaaagcagcaaataaggtggcaaaaactcaaatttatgggaactctggaaacgaattgaaagtttacagcaatcaggtgaatacctaagaataaaagctggatttagtaagagagctttgttgtgttttagcttaccctggccccatcccccactccccagcatggcagcagcatcaaaaacaatatccctcattccctgtataggttcctgtcactggaggtagcagatta

SEQ ID NO: 7056 - DNA, 423 bp, Homo sapiens
gctgagcagcctctgagcagcaagagaggaggaggcaggaaatttagggaaggttcttcctggagggtctggagccctggagatgaagagccgatccgaagctgccatgtagaagaaagcatctaacaggccagaggccccatgatgatgtcgaatgcccatcgggcacccagctgagccctgcaggtgttaactcagtcttcgtcacagcagtctaggcatacactcaccattagcccatttgtaagctgaggaaacaagcctaaggagggtgaaagccttgccccagggcacataccggtcctgctggtttcagagcgggcttttcacctctgtttcttcctgtcctcttgtggactggtatctgtgtttaccatgacccagccccatgtccctccagcctcttatcctgcttctccctgc

SEQ ID NO: 7057 - DNA, 974 bp, Homo sapiens
taatttggagctctcctaaagtgaagatggcagcctggaaagacgtttcaaggtcagtgtattagtggctcatgcctaggggaaggaataacatttggagcaaacaggagacaaattgaaaagcttcaggaggaaaggctaggaaataagattctttgggtgagaataaggactttaaagagattccacatattcctgggaatctgaaagaccatacacatgcctagggctgggcatgtgcttaaaaagacttgagagggccctatgctgtcacctctgcctgaccttcaggctccgtgcaagcaggaagtgaaggctaaggcatagttataaactgcatgggtgaaggttgaaaggtgtgtcccaacacagaacacatctgcaaatgctacgaggcattttgttgttccaagtgttcaaagaaatcttttgaatcactagctgaccactaagctaaccaaagacttagtggccacacctgacaaagaatacaaactaaaaaactaaaaatgtagttcaagaaaataacaggctgggcacagtggctcacatcggtaatcccagcactttgggaggctgaggcaggtggatcacttgaacccaggactttgagaccagcctgggcaacatggcaaaaccccatctctgcaaaaaatactaaaaatttgcagggcctggtggcacacacttatagtcccagctgcccaggaggctgaggtgggaggatcacctgaccctgggaggtccaggctgtagtgagccataatcctgccattgcactccagcctaggtgacacagtggaggaataattttatttccaaacttgccacattataaataatattcagaatgttcagttttcaacaaaaactatgaggtatgcgaagaaacaaagtatggctcatacatagaaaaaaaatctgttaatagaaactgaggaaagctcagacattggacttaacagacaagactt

SEQ ID NO: 7058 - DNA, 974 bp, Homo sapiens; identical to SEQ ID NO: 7057

SEQ ID NO: 7059 - DNA, 423 bp, Homo sapiens; identical to SEQ ID NO: 7056

SEQ ID NO: 7060 - DNA, 2234 bp, Homo sapiens
caaccaatcacaaagtgtgggcattatttaaatcttgattcaaataaacaaactgaaatatataaatgacacttatgaaacaaaaatgtggccactgattgggtatttgactaaatcactgctcaattttattttgtgcgtgataatagcaatgtgcttatgtgttttatcttctagtgatacatactgaaatatttacagatgaaataatataatgccaattattttcttgaaattaatgtggatgtggaaagtagacagagatagagatttaacaagatggattatgagctgataattgttgaagttgagtgacaggcacataggggtttattataatatcccgtcttcttttgcatatgtttaattttccataataattttttaatgttctaaaaatttaaactttattttccaatcaaatggaagtctttagagattttattttgcaagtggcaatatgattaaaagggaaataggaaagataaattaagcaatgatttgcacattaattggcagttggggaagaccaaagaccaggagattagttaagagtctcttacagcatcccgatctacattggaaaaagtctgactgaggtaacattaatagaaatgaaaaggaaaaagtgacaggaatgattttgaggagcatcaaagttcgctgctacttgaatatgaaacactaagcagagaaagattaaaagaggacacaaaaatctcaaacctggcatattttaaaaatagtaatgtcatgaataaatataggccagtcaagatgacaaattgttgggtgatgaggtaacaaatttacttctagacatcaagtttgagaggatgaagtgaccacttgctattaaagtaaattattgtttacctacacatgcattaaaaaaaatcctttgtgctgtctcctgaaatgtgattatgtgtttaaaaatacagtgtcataaattaaacttagcataataaaataattgaataaaataaaactataagtcaaatttccttgttactgatattaaaatagcccaaacccttctttgataaaattctacttttttgtcatgttttaccatttgtttacattatttccctgcaaaaaatgttccttgatatcataagtagatctgtatatgtacttattttatatcactttccctgtctctatacatctaaacatataaagcaatgaacacatcataggtgcccaataaataccaagttttctggccaatatgctcacttattgcaagcagtactgagaagaataagattgtaacgctgccagataatttggaaagtcttctgaagcttccttaagtaagataacatcattattttattaagtagtatcattaattatcttaagtaacatcatcaatactgaaataatttcttctagtgacaaactatggaaatacatatagtagaaactgtgtctaagtcagacttttgaatttcatttatgacaaacttagttgtacactattaaaagtctataataaccacaatactgttcagtgcttagcatgtccatacccaaaagtttggaatttgtcatttttaatccctagcatcatacattcccatatcctttaccttagtaagtgattccttgtgaccaagtgaaccactctaattacctccataaaaagaaattgagaagatgtctcaaaaacaataaaaagcagaaatacattgttctcaaaaccctctgattcttgacagtttttgcttcctagatccaccagttcagcatgctacccaatactgacaactaatcccagactttctttgctacttgaagccaaggcaacatccaactacatcatctctcgctgtttgcttgaaaacaaatgtgaaactatttcattcgtttgcttgaacttaccaataaatacatggctagaggtcatttagtttggcagtattctgattcagcaaagcaataaaaccaacccaaactatttgaaatcccaatgtccaggaccctggagcaccatgtctcttgctgtcatagcacctgactgtgagtgtgtttcctcactcgcctctgaaagctggcggcaagacccttgaccatcaaacaggagaaaaatcctcatcatctatcaagggggccatagttggaatctttctctgttatgcacatagaatgttcctgcagaaacaaagatctttccatgaacagtaataagttccctcttgtttcaacaatgattggttggaatt

SEQ ID NO: 7061 - DNA, 318 bp, Homo sapiens
gaactattgatacatgcaataacctaggtggatctcaaagtcattctgctgagtgaatgattccagttacatagcattctggaaaaggcaaaactgtggtgaccaggaacaagcatgattgccaggggttggtggtggggaaagcgtgtgactaccatggggtagtatgaggtgatttttgaggagatgaaactgttctgtgtcctcattgtggtagtggttacatgagttagtacatgtgttaaaactcatagataatacgcttccccaaggaatccatttactatacattaatttgttaaaaaaataaatgtaaaa

SEQ ID NO: 7062 - DNA, 1212 bp, Homo sapiens
ttttttttttaagtatttattgatcattcttgggtgtttctcgcagagggggatttggcagggtcacaggacaatagtggagggaaggtcagcaaataaacaagtgaacagaggtctctggttttcctaggcagaggaccctgtggccttccgcagtgtttgtgtccctgggtacttgagattagggagtggtgatgactcttaatgagcatgctgccttcaagcatctgtttaacaaagcacatcttgcaccacccttaatccatttaaccctgagtggacacagtacatgtttcagagagcacggggttgggggtaaggttatagattaacagcatcccaaggcagaagaatttttcttagtacagaacaaagtggagtctcctgtgtctacttctttctacacagacacagcaacaatctgatttctctatcttttccccacatttcccccttttctattcgacaaaaccgccatcgtcatcatgacccgttctcagtgagctgttgggtacacctcccagacggggcggctgccgggcggaggggctcctcacttctcagactgggcagctgccgggcggaggggctcctcacttctcagacggggcggccgggcagagacgctcctcacctcccagacggggtcgcggccgggcagaggcgctcctcacatcccagatggggcggcggggcagaggcgctccccacatctcagacgatgggcggctgggcagagacgctcctcacttcctagacgggatggcggccgggaagaggcgctcctcacttcccagactgggcagctgggcagaggggctcctcacatcccagacgatgggcggccaggcagagacgctcctcacttcccagaaggggtggcggccgggcagaggctgcaatctcggcactttgggaggccaaggcaggcggctgggaggtggaggttgtagcgagccgagatcacgccactgcactccagcctgggcaacattgagcattgagtgaacgagactccctctgcaatcccggcacctcgggaggccgaggctggcagatcactcgcggttaggagctggagaccagcccggccaacacagcgaaaccccgtctccaccaaaaaaatagaaaaaccagtcaggcgtggcggcgcgcgcctgcaatcccaggcacttggcaggctgaggcaggagaatcaggcagggaggttgc

SEQ ID NO: 7063 - DNA, 4685 bp, Homo sapiens
aaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccggtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactctgtgcc

SEQ ID NO: 7064 - DNA, 8985 bp, Homo sapiens
cttctcttcctgcaattgctctatcacttcttccctctcaagtcccgccctttcagctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaagtaaggacatgctgtggcctccatcggctgctcacaaaggcggtggggtgggggtggggaagagggcgagagctaagatcctctttctctctcccccgcccctgccatcctgactccctaaggttttctatagtactatgctctcactcccaacttgaacacttctttaagctttccatccgtagtccttaattgggtttcagtccctccactcccattgttttttctccttacccctctttctcttttgccccctcccccaattctgtctccattcctagggttctaccaatcacatccgtgcactgtgatttagaggcatattctctgtagctgagaggggagccctgcgctcactgccatatgtttattagttatgaactgaataaaggaaggcttgacttcctgggtcatgggagtgaaggagtctgggtgacaggaagcaagcggcctgtcatgcctattgcctagctgccagattaaccttgccttgaaaataacgattgccccataggctattcagtgtaaggaagacaaaaattccttgggaacctactagtgggtttgccttccagatttggtagacgcaaaaagcaaagggggaacatgggcaaaggaaggtgggttttgtgcatgaaattttgagcaaaaacgaatagggatcttagaaatcattattatcatcacttaaaaaaaatctcagcagattacatagcctagcaggggccgattttctatgttatgcttgggttggtcttttgtatctcaagaattgagggttttgttttctgatctcaggttttattattggtgggagcctgtgtttcttcctgggtagaattgaataagattttccaggaaaggcatttgtgtagctaattacagattatggtgcaaagtatgtctcatattcctccccctaaccccagctaattgctgtatacttgacagtttatttcaatattgtattaagacattggttttgtgctggacagagtaaaagggagatggtatttttttttaaaagaacaatttatttcataattaagtatctaaatacttggttgggaataaatgactaattagaacagtacctttaggtattctgatacctctacttagaaatgccttttcttttcttgcaaaaattacttggcagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatggtaagtctttgtttttgtctgtgtaaagctcggtatagctgaatatttaatgattagattgcactcatactaaatggaattattttcagattaactattgatagattaataatggggtagacacagaataactctaaaactccaatatttgtattttcaaagattttctatgtccctgaaaaaatgtggctttgtgtattgattgttctagtaaagagttaaatgttttagttcagagttggatttaatttatttcagtttgttgtttagagaattgttttattgaattacctaacaatggaattaataaaatgtgaaataaaattggttgtagcaggtaatatttttctttttttctctactggacttgcatgataggaaaaacaatgtaaacaatattttttggccaggatttttactgactttttaagaaagtttatcactgtatatgcgtgttttatattgtgaatttttgaaagaaaatatctaacttggtactttgtgacatttgtcttacagccatgaacatatagaaatccttacagtaaatggagaattactcttttttagacaaagagaagggcctttttatccaaccctaagattacttcacaaatgtaaggtttttttatttttattttttgaaattttactcctattgcaatattcaaatgtaaagtcttgtaagaaatatgcatttaatcagataagacactgctgggggagaaaaacagaaatatgcatttgggaatactgaaagacacaaaaagagtttagagtgacttctgataattgactcattatttattagtactaggtaataatggatgtaaaactaaaatgaatgcccatcttgtggtaaatctgaaaaatgcagattctctcatgcattccagaaagcccaagaaagatcatttattaattcattcaacaaatatttattgccgggcacggaggctcacgcctgtaatcccagcactttgggaggccaaggcgggtggatcacctgagatcaggagttcgagaccagcctggccaacatggtgaaaccccgtctctactaaacatacaaaagttagccgggcgtggtcacaggtgcctgtaatcccagctactcgggaggctgaggcaggagaatcacttcaacccgcgaggcggaggttgcagtgagcagagatcacgccattgcactctagcctggggaacaagagcgagacttagtctcaaaaaaaaaaaaaaaaaaaaaaagacaaatatttattgaacttactatgtgctaggcattcagctaggtgctgagaatacaatgggaagcaaagacattgtctctgtccttaagaaactaatagtctagtttggagaataaacaacaattagataattacgcaaatatgtatttacaaactgtgataagcattgtgagcattttcatcttttatatttgtatctatttgcctaatagagaaaagtctatatatgggaaagcattgactaagtgtccttccgtccaggtatttcctgtgatgtgtgtaaatgcatttttttttaaaattgggctctctgttacatagtttttaaaaattgatacgtcatagctgtacattgtctgctgttgtggtgcctgtatcccccaccacctatatatatttataatagttgtacatattttaggggtacatgtgatatttgatacctttatacagcgtgtaatgatcaaatcagggtaattagggtatctgtcacctcaaacgtttatctttgtgttgagaagattacaattcttctagctattttgaaatatagagtaaatcattgttaaatataatttccttattgtactctcgaatactagaacttatcgacctgtatttttataccccttaaccaacttctcctcatccccttgtagtttttttttaaattaacaggcttttattttttagagcagttttaggtttccagaaaaagtaagcagaaagaatagagttccctctccccagttcagattcccctatgaataacatcttgttttggaatgatacatttgtaacaattgaaccagcattgatacattattattaacgcaagtccttagtttacattagggtttactctttgtattctacagttttatggtttttcccaaatacatgtcaagtatctactgttaaagtatcatacagaatggttttactggcctaacatcctttgtgctccacctattcatccttcctccccccacttccccaaccccaggtaaccactgatctttttaatcgtttttttactctgcgtttttcacttaacattatatcacaaaaatttcccagggcatattaagtagtctccaaaaaccatagttttgaaattacggtttttggagaatacttgggatgctgaggcgggaagattgcatgagtccaagagttcaaggttattgtgaggtattgattgctccactgtactccagcctgggtggcagagcaagaccctgtctcaaaaaaacaaacaaaaaagattaccaatttggtaaacaaatgatagtgtttcagagttttcttttgtatctgtcagattaatttggggaaatactgttcagatcctttgcctttttctgttgagtcattagtcttattattaatatattgtatatcttttcttacagatccttttatcctgccacaccagcaggttgataaaggagccatcaaatttgtactcagtggagcaaatatcatgtgtccaggcttaacttctcctggagctaagctttaccctgctgcagtagataccattgttgtatccttcccaggctaaaactgctgaaaaatgtattcattgtgctcttatcattactgcgaaaggtgtaccatccaagagaacattagatgtacttttttgaaggttactgttactcttatctcatgcctttctggttacatttgaagttgtacaaagtaattttatttgttgctactaaattatctcatcttaggtcgtttcttagaagttaaatgagaacaagttacagaagagtctcagctgcatttcagcccagtcagggcctactgttatcagacttaggacacaatagggaattcttgattactaggggaaaggatatagatgatataattggatcagctttttggatatcaacttgccactgtaatgttcattttgacttactgacatacgttggagtgaaagctctcaaaagggaaaagaatttaggcaccaggtataggtatctcttaccaagcaacaattttgtgttaggagtgaatagtgggaaatattggcaacctccaacttttattttgaaaattaattatttgaaaagttgagtttgggggcctcagagcacgttttctcaaagagaaatgtcagagtcccagatggtccttaaagatcgattcaactcatgacatagctgaataattctgcattatttccatttctaccatgctgtttcagctattttctggattaaatagatttttgtgactattctggacaggagaacatcttctcctttatcatagctaaagtagccatttgcctcgggtatagaaaaggaatggtacttggtgggaatagggaaactacttttagagtgtgtttatcttattttagtttttgagatggagtctcgctctgtcgtccaagctggagtgcagtggcacgatcttgtctcactgcaacatctgcctcctgggttcaagcaattctcctgcctcagcccctcgagtagctgaggttacaggcacccactaccacgcccggctcatttttgtatttttagtagagacagggtttcaccatgttggtcaggctagtctcaaactcctgacctcaggtgatccacccgctttggcctcccaaagtgctgggattacaggtgtgagccaccacacctggccaggggtgtgtttaagaagaataagaaaaaaaaatgatattctctgttggggcagttatagcgaagaggtagtataagtagtatgtttatattctaggaacagcttatgttgacatgctttttgcctaataggtgctcacatatttggaacactgagtgaattgaaaatcaagggagaaaagtgaggacgggttttttgttgttgttgtttgtttttaatatttattaagtgttggtaaatttatagttctggagttaaccttaaatggaaaatttccttagtacctagtctttacttttaaaaataatttttattttgaaacagttacagatttagagaaagttgttaaagaaaatggtacagagaggtcttgtgtaccctgaatcttgactttttaaaatatgtactgcagtgtttaacattccagaaacttcatatgttaaccaagaccactctggtttttctagaaaggttgaaactgttatatcaggctcttaaagatagactgggaatttacctattattttaaaacagcctttacataaaaccaccattcaggccgggtgtggtggctcatgcctgtaatcccagcactttaggaggctgaggcgggcagatcacctgaggtcaggagttcgagacaagcctggccaacatgacgaaaccctgtctgtactaaaaatacaaaaattagctgggtggggtggcatgcgcctgtaatcccatctactagggaggttgaggcaggagaattgcttgaactcaggaggcagaagttgcagtgagctgagatcatgccactgcactccagccgggtgacaaagcaagactccatctcaaaaaaacaaacggccggctatggtggctcacgcctataatgccaccactttgggaggctgaggcaggcggatcatgaggtcaggagttcaagaccagcctggccaacatggtgaaatcccatctctactaaaaatacaaaaattagctgggtgtggtggcacacgcctgtagcaccagctactcgggaggctgaggcaggagaattgcttgaacccgggaggcagaggttgcaatgagccaagactgcgccattgcactccagcctgggcaacagagtgagactctgtctcaagaacaaacaaaaatccccactagtcagtgatcagaataattaatcagaacaattaatatttattgatttcacagtttttagtatttatgtgcaagaaattttactccttttttgtgtgacttattctggttttgttagcatggggttatagtattaacatttgacttgaaagaaaaggggttattagatttattcatttagcatttactgagtatttacagtgtacccacagactctgctaggtctctgctctcaaggagttaatggtctaggagaagacacaagaggggttccaagtggcttaactagtaacatgatcattatttgacacccttcccttgatggggaggccccaaggcattttgataaatagttttcttagctgtgttctttcaggctatcatggcagaaggaaaacagcatgctctatgtgttggagtcatgaagatgtctgcagaagacatgtaagtcttactttaggcccccttaacttttgatatatgggtaaccaacccaggaagcatcagaattacaggtgaaatttgctatcatgcataccacattacacaaatatccaagcacagaagcttcatttctgatatttcctaacacttaggaagccaatgaaacctattttgtcttcaggattgtagtctttcttaagcactgaaaagaacccatgtgccaacacagctgttttatatgtgtgtacgtggtactttaggaatcttatttagtatcatttaaattgggggaggagggaagatgttttactgctagcttcattttatttatttttatttttatttttttaagtttttttgagatggagtctcactctgttgcccaggctggagtgcagtggcgcgatcccgcctcactgcaacctctgcctcccaggttcaagcgattcttgtgcctcagccttccaagtagttgggattacaggtgtgcgccataatgtccagctaatttttgtatttttagtagagatggggtttcaccatgttggccaggccagtctcgaactcctgacctcaagtgatccacccacctcggcctcccaaagtgttgggattacaggtgtgagccactgcacctggtcattactgctagttttaaaaacagtgatatatctcaccaccacacagtatcttatatcctgacctggtaatacaagaaatgtagaatatttagagaactagtaaagatatattatcaaaacataggcagtatatttaaaaattttagaacccatttgatgaccaaattagtggtattaattttgtttcagggttaatgtagcactttgatattcccctagtcttgtgacattgttactctggttctatagacccactagttagatcactaaaatcacttttagatatgagctgccacagagtaatgtagtttaatataaacaacaatgtaattgtgatgtcaataagttctttacttgtggcttaataattaaaaaataacaatatactttgaattatatttatcacgagtaagactataaaaatgcataaaagtatgtttatgtgttttttttccttctacagtgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaaggtatctggtaagtaagcaaactcatacaactaatgtcctttcttaggctaatgatataagagtgaagagcaggacttggtcaatggattgccattttatggtagacctctagagaaactgtctagttaaatggggctagaaactagactaggaattttattctattactccaggggacccagcagtgctcattctcgtgtgtgtgtgtgtgtgtgtgtgtgtatgtgtgtgtgtgtgtgtgtgtgtgttttgttgattgtttttttaaaaaaaacttcaatggaaaattctaaacatattaagaagtctggagaatagtataatggacctctccatatccatcacccagtttcagtttatggtcagtcttatttcatctatacctcaattatttctccccaccccccaattattttgaagcaaatcccagacatcctatcatttc

SEQ ID NO: 7065 - DNA, 478 bp, Homo sapiens
ctcgaggccaggagttcaagatcagtctgggcaacttagtgagaccctgcctgtctctacaaaaaattaaaattcgccaggtgtggtagtgcatgcctgtagtaccaactactccggaggctgaggcgggagggtcacttgagcctgggaagttgcaactccaatgaaccgtgatcatgccactgcactccagcctaggtgacagagtgagatgctgtctctaaaacaaaaaacaaagtgaaactcttgattggcataattttgtttctctatcagctttatttttaaaaaaattacataagtaaaacatgtctctttagctattatctcttaaatcagattaccttctgtaataattctatgggaattattctacgggagcacagtcattcacgcttgtaaccccagcactttgggatgccaaggtgggaggactgcttgagcccaggactttgcaaccagcctgagcaacatagac

SEQ ID NO: 7066 - DNA, 5820 bp, Homo sapiens
  misc_feature (123)..(124): n equals a,t,g, or c
  misc_feature (1476)..(1476): n equals a,t,g, or c
gattcaggaaaatggctcccttatcaccatcctggtcattgctggtgtcttctggatccaccggcttatcaagttcatctataacatttgctgctactgggagatccactccttctacctgcnnactctgcgcatccctatggtaagactgggaagttgggcagttagcccatagtctaagacgtattgggaggtgtgggtgtattcctgggcatcagttatccttatctgtcattgacaaatcaggaactgtctcttaagctcacaacccctgaatctcacttctaatatagggcaaaggggtcgaggcaacaaccccaccttccgtaccttgtctcttccccaccccaccccgcagtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagcgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtgggccaggccacaggcgggagcaagccggctagcattcctgggaaaggcatacatctcaccatgatcctgatcccactaggtcctttatcccggaccagcacatggtgttctgccctgagcatgctgccgcgtgatcctcgctcacatccactacatgcctgaccactggcagggtaatgcccaccgctcgcagactccgggacgagtttgcccagctcttccagtacaaggcagtgagtggagttggagttagggcctgctagagactggctggtagctcggtggtgagggctgggctccctcctgctcgcttgtgaccttgtcccgcccttttaggtgttcattttggaagagttgctgagccccnattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccaggtactgggagaggagggagccaggtggcctgggatgatgctggaacatacagtgtctttgggaaaaccgcaaaaagacacctctcctgagtcacacaaaggcagtcctataccaggggcacactgcttgggagcctgggctggatttcagccctaattcgcacccttggccaagctcccttaagaaaggcacaacacggccaggcgcggtggctcacgtctgtaatcccagcactttgggaggccaaggcgggtggatcacgaggtcaggagatcgagaccatcctggctaacacggtgaaaccccttctctactaaaaatacaaaaaaattagccaggcgtggtagcgggcgcctgtagtcccagctactcgggaggctgaggcaggagaatggcgtgaacctgggaggcggagcttgcagtgagccgagatcacgccactgcaatccagcctgggcgacagagcgagactccatctcaaaaaaaaaaaaaaaaaaggcacaacacaagtaactggctcagcatgcagtgcagcccctcctgggtctgggggggcacagtgccctgggaaagattgacagtatactgtggtctccgttctccaagggtaaggcctccccactaacaggaaaggtgcaggaaggctcctggaagagaacagccctgcttactctgctcttccttgtgcagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgaggtgtgttcctggtgactgggagatgatgggcagagtggacttcaggagctgggagttgagggaccgggcatggggtggaaggcttcctgctgtctcttcagtatgtgccactggggcctgagatacagaatactagggaccccagagacctttctcttgcctcaagaattctacctacccgtttcgttcatagcccctgagccttatcgcaaatgtggtagctggctcatctgccgggccctccactgcccagagacctgcagggctccaggcacagggctgaagtcgcctctgccctgcgctccttctccccgctgcaacccgggcaggcgccacaggccgggctcacagcaccatgacaggctctgggtgagtaaatcggggccaagatgggagggcacggcagccctcagcagcttgtgtgggtctcagagaagttcacagctgctgtctgtctctgttgggagagacagggtggatgccaggacagccagctccgggagcagcgtgtgggaaggacagctgcagagcctggtgctgtcagaatatgcatccacagagatgagcctgcatgccctctatatgcaccaggtgagtgcacagctaaaaaagagagtagagggtttagatgcggagaagcaagaccggggttccaaacccttctctgccatttacttgttctgccacctccactcccatatctaccttcttaatatcctttttagctaagcctgctctcatccagggccttcacacactcgcagtttcccctgcctagaatccagttccctgggatatccagatggcctcctccttcttcttgggtctctgcagctgccgtttccctgagactttctctgatcactctcagtaaaaggctcccttgcccaccctcctgaatcttcctgtcttagttttctccatagcatttagcaccatgtgacatatcatgttttttccttatttatttgcttattccatatctcctctaccagtatataagcctcacaagggctggcatttctgtctgttttgttcactgctatctccccacacctaaaagagtgcctggcacttagaccgtcagtcagtttgttcctgaatcaaatgaataggtaaaatgagggccattacaacacaggcttcttccggggatctgctgtgaatgtaacctgtaaagatcagaggtatattacacactattaacataataggtgctctgaggcaaggattctcagggaaggggtaaagcgggaactgactgataccaggttggagggcagctgtttcagatggacatccgtctgtcccccactaacgagccccccatttctccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacaggtatccagtgggggtataggaggaaacagaggctgcagggaagggtggttcttccagggcctctcaaggggaggaaagaggtctgagagaacaggcccaaagactcaccccccaagcagccccccagccctgttcctcattcttgtgttccttctatgagtatgcttactcttacttgtctctccagatcctgcacagtgcccaggttccctctcatttctctcggctgcctcttggagggtgggcagaagatgggcagtcggcatcaaggcaccctgagcccgtgcccgaagagggctcggaggatgagctaccccctcaggtgcacaaggtaagcgcccggggcctaggaaaaactgccagaaatagtaacttccagggtgaggtaacagcttttcaggggaaggaagatatgccccacccccacacagagatactgtaccctcccttccaaaacacactaccccttcttttctcaactgctctgcagggcttggtttttccttaccttacctccccaggaatcaacctttcctgtccctttacctctaggtttctatggggctagcaggtatcaaccagaagctgaagactatctccattaccaaccctttctccccacaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagaggctgcccacgatagaagctgccaagcagggagaacctgtgccaactgtggagtggggaggttgggcctggaccctcaacccctgcaaccttccctagccccctcaatagatgagcaggtcaggctgtggccattacctcacccgcagttctcgcccagtgctgcagccggctcacctctctccgcttcttgcacatcactggcctgtgtgtgctgcttgctcctgttctgttcgcttgctcacgttccgttcggcttttgctttgcgttagggtgaagacctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcgcgcatctcgctgtgccctgaagggggatggatgacgagtccggtccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 7067 - DNA, 5836 bp, Homo sapiens
gattcaggaaaatggctcccttatcaccatcctggtcattgctggtgtcttctggatccaccggcttatcaagttcatctataacatttgctgctactgggagatccactccttctacctgcacgctctgcgcatccctatggtaagactgggaagttgggcagttagcccatagtctaagacgtattgggaggtgtgggtgtattcctgggcatcagttatccttatctgtcattgacaaatcaggaactgtctcttaagctcacaacccctgaatctcacttctaatatagggcaaaggggtcgaggcaacaaccccaccttccgtaccttgtctcttccccaccccaccccgcagtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtgggccagggccacaggcgggagcaagccggctagcattcctgggaaaggcatacatctcaccatgatcctgatcccactaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgagtggagttggagttagggcctgctagagactggctggtagctcggtggtgagggctgggctccctcctgctcgcttgtgaccttggtcccgcccttttaggtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccaggtactgggagaggagggagccaggtggcctgggatgatgctggaacatacagtgtctttgggaaaaccgcaaaaagacacctctcctgagtcacacaaaggcagtcctataccaggggcacactgcttgggagcctgggctggatttcagccctaattcgcacccttggccaagctcccttaagaaaggcacaacacggccaggcgcggtggctcacgtctgtaatcccagcactttgggaggccaaggcgggtggatcacgaggtcaggagatcgagaccatcctggctaacacggtgaaaccccttctctactaaaaatacaaaaaaattagccaggcgtggtagcgggcgcctgtagtcccagctactcgggaggctgaggcaggagaatggcgtgaacctgggaggcggagcttgcagtgagccgagatcacgccactgcaatccagcctgggcgacagagcgagactccatctcaaaaaaaaaaaaaaaaaaggcacaacacaagtaactggctcagcatgcagtgcagcccctcctgggtctggggggggcaccagtgccctgggaaagattgacagtatactgtggtctccgttctccaagggtaaggcctccccactaacaggaaaggtgcaggaaggctcctggaaaagaacagccctgcttactctgctcttccttgtgcagtggctatctgctgggcagacagaggcctcagtgtaccagcaagcggagggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgaggtgtgttcctggtgactgggagatgatgggcagagtggacttcaggagctgggagttgagggaccgggcatggggtggaaggcttcctgctgtctcttcagtatgtgccactggggcctgagatacagaatactaggggaccccagagacctttctcttgcctcaagaattctacctacccgtttcgttcatagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctgggtgagtaaatcggggccaagatgggagggcacggcagccctcagcagcttgtgtgggtctcagagaagttcacagctgctgtctgtctctgttgggagagacacgcccgcacgccaggacagccagctccgggagcagcgtgtgggaaggacagctgcagagcctggtgctgtcagaatatgcatccacagagatgagcctgcatgccctctatatgcaccaggtgagtgcacagctaaaaaagagagtagagggtttagatgcggagaagcaagaccggggttccaaacccttctctgccatttacttgttctgccacctccactcccatatctaccttcttaatatcctttttagctaagcctgctctcatccagggccttcacacactcgcagtttcccctgcctagaatccagttccctgggatatccagatggcctcctccttcttcttgggtctctgcagctgccgtttccctgagactttctctgatcactctcagtaaaaggctcccttgcccaccctcctgaatcttcctgtcttagttttctccatagcatttagcaccatgtgacatatcatgttttttccttatttatttgcttattccatatctcctctaccagtatataagcctcacaagggctggcatttctgtctgttttgttcactgctatctccccacacctaaaagagtgcctggcacttagaccgtcagtcagtttgttcctgaatcaaatgaataggtaaaatgagggccattacaacacaggcttcttccggggatctgctgtgaatgtaacctgtaaagatcagaggtatattacacactattaacataataggtgctctgaggcaaggattctcagggaaggggtaaagcgggaactgactgataccaggttggagggcagctgtttcagatggacatccgtctgtcccccactaacgagccccccatttctccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacaggtatccagtgggggtataggaggaaacagaggctgcagggaagggtggttcttccagggcctctcaaggggaggaaagaggtctgagagaacaggcccaaagactcaccccccaagcagccccccagccctgttcctcattcttgtgttccttctatgagtatgcttactcttacttgtctctccagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtaagggccccggggcctaggaaaaactgccagaaatagtaacttccagggtgaggtaacagcttttcaggggaaggaagatatgccccacccccacacagagatactgtaccctcccttccaaaacacactaccccttcttttctcaactgctctgcagggcttggtttttccttaccttacctccccaggaatcaacctttcctgtccctttacctctaggtttctatggggctagcaggtatcaaccagaagctgaagactatctccattaccaaccctttctccccacaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 7068 - DNA, 6487 bp, Homo sapiens
gttggcaggagggtcccggcccagagccagcggggccgtgctgagacggcgtacgtgccctgcgtgagtgcgtggcggcgcgcgtgcgctaggggagtgggcggtgaggcctggtccacgtgctccttcccgggacccccgcagcttgggcccagcggctacgtgagcaaggcacccggatgtccgcgccgctctccgagtgaccagtcccggcctccggtcccgcagtgcccgcagcctcggccggcgtccacgcattgccatggtgactgtgggcaactactgcgaggccgaaggggcccgtgggtccggcctggatgcaggatggcctgagtccctgcttcttcttcacgctcgtgccctcgacgcggatggctctggggactctggccttggtgctggctcttccctgcagacgccgggagcggccgctggctgctgattcgctgtcttggggggccggccctcgcatctctccctacgtgctgcagctgcttctggccacacttcaggcggcgctgcccctggccggcctggctggctgggtggcactgccgggggcgcccactgccaagctatctacttctggcctccgtgctggagagtctggccggcgcctgtgcgctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggtgagggactctgtgggaagggggaagcctctgctggccgggcttgggagaaagcactgcatgtccagtcacactgcttccaggctttaggatgcctctaagcaaagggagaagggaggggctgagtcctgccgggagctgatagccagctggtggggtgtgtctttgctgagtcactgtggttttgcttttttttttttttttaagcctgtaagtgctgaatgtgttcatgacaccagtccccggccctattataagtagtaatacaatgaaattttatcctcaatgatactctctccacttatatttcattctaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggtacacctcagtttctttttttttttggagacggagtcttgctctgtcaccaggctggagtgcagtggcgtgatctcagctcactgcaacctccacctcccgggttcaagcgattctcctgcctcagcctcctgagtagctgggactacaggtgcatgacaccacacccagctaagttttgtatttttagtagagacagggtttcacagcattggccaggatggtctcgatctcttgacctcgtgatccgcctgcctcagcctcccaaagtgctaggattacaggcgtgagccactgcgcctggcctctttttgtttttaagacggaatcttgctccgtcacccaggctggagtgtagtggcgcgatctcagctcactgcaccctctgcctcctgggttcaaacaattctcgtgcctcagcctcccaagtagctgggattacaggtgtgtacccggctaatttttgtatttttagtggagatggggtttcaccatgttggccaggctagtcttgaactcctgacctcaggtgacccacctgcctcggactcccaaagtgctgggattacaggcatgagccactgcaccagaccccacctcagtttctgaatcctggagtctcttcatttcattccctgtcatcattccttcccccaaaatgaaatgcttcttttccaaatctcagtttgcaacttagtttttctgaccccatcaaggatcacttgtgggtctgagatacctgggagctgtaaccccataggtttttccctgaagggtttctggctagtgcacttacttgatttctgagctcccttcctacgtgtttcaccatcctaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattggtgagcaggaggagcaccagctcagtgtgctggtccttcatcagcctggtggctgggatggtccttacctagggaggtgggacagagctgggtggtcagaaagagactgtggctggtacctggggccattttgcctgaagagagtcctgggcgccataagtgggttctgactcgtttcctccacagtgaacttgctgactgagaaggcaccttggaactctctggcctggactgttaccagttacgtcttcctcaagttcctccaggggggtggcactggcagtacaggtatgagagactccgccctcaccctgctaggtataggtccctcccacaggcattccctcagcatccgcctctcccagcattcctccccagcccccatgtactctcagacctttcacatcctggtgctgggctgacgtccctcagctcccaggccctactgaggcgtcccccggctccctgcaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcgatcggggcacatccagtgtcacagggctgctcaggtgccgccccagtggaaagggcatgtgggagggtggagccggagaagcagggataggggcccgtgggaggaagagaacagaccccgcctgagaagctgccgctcccaccttggtgttttttaaagtataggattattgtatacatgctctcctaataacttaggtaatgcgggcagagggcaaatctctttcgagctgcacttactttttcagagcttcccactctgtttagtatgttgggttctgctctttttttgagacagggtcacgctctgtcacccaggctggagtacagtggcataatctctgcggcactgcaacgctctgctcccgggttcaagcaattctcctgcctcagcctcctgagtagctgggattacagatgtgcaccagcatgcctggctaattattagattttttgtagaaacagggtttcaccatgttggccaggctggcctggaactcctagcatcatgtgatctgcccacctagcattccaaagtgctgggattacagttgtgagccattgtgcccagctgggttctgcttttttgcatttttacatacatattatatatgcagactcacagaactaatatggcattgtggaggtttttcctaaaacaaatggtattgtgacatagccatcattctcagagttgcttattaacagaacattatggagatatatttttcttccatgcctgaaggtctccctcattcattgtaattgatacagagaattctgtagtttgagcatggttgatttagccacccacctcttgagggtagaattaattaagactggttccagtctgttgcttgaaaataaaacactaccctgaaatgcctagaggcagggttgctgggtctaagcccccagacctttcttattcacttgacctgccctcctagctacctggtgttcaatgtcatccccacgctggccgacatcatcattggcatcatctacttcagcatgttcttcaacgcctggtttggcctcattgtgttcctgtgcatgagtctttacctcagtgagtgctgctgggagacaccgtctccctgaactatccagggactcccttggccatgagctgtgcccccactcaagtgacccacctatgggaggctgtggattggtggacttgaatgggctcctagtgctcgtcatgtgatgggcgggtctcttctgtcaaatcaaaccttaacctagctgaggggctggggaaggacattcttgtcacgttaagtctgagccgtggacacaggtcaaggaagcctcgtttgtgtaacaagatgcagcttgctttcatttaccaaaagcgttttctacacatgagactttgtgcaggctgcagaggtgcctccctgtggaatctgggtgtccgggcttgagcataggcttagtgtgtacatggcaggtagtggacattgacatttggtctctgcttttggggatgatgtcctattctgctccccatcctgtcactctccagccctgaccattgtggtcactgagtggagaaccaagtttcgtcgtgctatgaacacacaggagaacgctacccgggcacgagcagtggactctctgctaaacttcgagacggtaacagagggcccggtggcagtggtgtgaggcgtggagatgtggaggagtgtaaccaggaccactggggctgacagagagctgggggtgtgatgtttgtgtgtgatgtttgaactcaggaaggaggattgagagttggggggaatgacccgagtgccatgtgctgtgcccatgccaaataaatttggtttgaattcatcaggtgaagtattacaacgccgagagttacgaagtggaacgctatcgagaggccatcatcaaatatcaggtgaggatgctagtttgaggcctccggagaataatgccctggcctggtagaattttcagggccaagagtgatagtcgagtgttggggtagaaggggcctgggcccaggtttggactcactgatggccattgtgtataggacattcctcttcctgtgttattgccctcagggtttggagtggaagtcgagcgcttcactggttttactaaatcagacccagaacctggtgattgggctcgggctcctcgccggctccctgctttgcgcatactttgtcactgagcagaagctacaggtgaggcaggatcttggatgagagagtggggcacaaggaaaagggggcctgaggcctgtgtctggtcaccaggctcttcggtaggaagtgggcagggtgacacaagaagagcggcctgcaggccccccgtgacatgctctgcttccttgattgccacaggttggggactatgtgctctttggcacctacattatccagctgtacatgcccctcaattggtttggcacctactacaggtaatctgagccctggccctcacctgtccagggcacattattatttcctggctactcagagaagtcctaaccagcacctttttgcaggatgatccagaccaacttcattgacatggagaacatgtttgacttgctgaaagaggagacagaagtgagcgaagggagaggagtagggtttggggagggaggagctgtgtggtgtttctcgtgcttggaaaacacaaagctgagaacctcagcacacatgggtggtgcccttccaggtgaaggaccttcctggagcagggccccttcgctttcagaagggccgtattgagtttgagaacgtgcacttcagctatgccgatgggtgaggccttccttttgcttcctttgcttttccgttcatttgcacactgccttcctgcttctcagtgctctgaatccctgcttttggaaaagagcctgggcaggggaggggcagggcctactagcagctctggtgatggaaggtgcctgctgagcaaccccacctttccttgcaggcgggagactctgcaggacgtgtctttcactgtgatgcctggacagacacttgccctggtgagaggagacccagccacttggcccagatgcctcaagcttccctcattcagtgcccatggtagcttgtgacccaggctgtggagtcagagagcccagtcacgataggcaaccggattgaatggtgcagcctccatggacactggtgacctcttggagagggaacctcaaaagccagtgggcctcggccggctgcggtggcacatgcctgtaatcccagcactttgggaggcttaggtggccagatcacctaaggttaggagttcaagaccagcctgaccaacatggtgaaaccctatctctactaaaaatacaaaaattagccgggcatggtggcgggtgcctataatcccactactagggaggctgaggcaagagaatcgcttgaacctgggaggcagaggttctagtgagctgagatcgcgccattgcactgcagcctgggtgacggagtgagattcggtctcaaaaaaaaagccagtgggcctgagatttttcccatttccaatgcaacaggtgggcccatctggggcagggaagagcacaattttgcgcctgct

SEQ ID NO: 7069 - DNA, 686 bp, Homo sapiens
gttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggca

SEQ ID NO: 7070 - DNA, 99 bp, Homo sapiens
aggccaaggtgggtggatcacttgaggtcaggagttcgagaccagcctggccaacatagtgaaaccccatctctactaaaaatacaaaaattagttggg

SEQ ID NO: 7071 - DNA, 125 bp, Homo sapiens
ggtaatcccagcactttgggaggccgaggcaggcagatcacctgaggtcaggagttcgagaccagcctggccaacatggtgaaaccccatctctaccaaaaatacaaaaattagccgggcgaggt

SEQ ID NO: 7072 - DNA, 141 bp, Homo sapiens
taatcccagcactttgggaggctgagacgggtggatcacctgaggtcaggagtttgagaccagcctggccaacatggtgaaaccccatctctactaaaaatacaaaaattagctgagcacggtggcaggtgcctgtaatcc

SEQ ID NO: 7073 - DNA, 207 bp, Homo sapiens
tctcagcactttgggaagccgaggtgggcggatcacttgaggtcaggagttcgagaccagcctggccaacatggtgaaaccccatctctactaaaaatacaaaaattagccgggcatggtggcgggtgcctgtgatcccagctacttgggaggctgagacaggagaattgcttgaacctgggaggcggaggttgcagtgagctgaga

SEQ ID NO: 7074 - DNA, 164 bp, Homo sapiens
cagcactttgggaggccgaggtgggtggatcacctgaagtcaggagttcgagaccagcctggccaacatggtgaaaccccgtctctactaaaaatacaaaaattagccaggcatggtggcaggtgcctgtaatcccagctactcaggaggctgaggcaggagaa

SEQ ID NO: 7075 - DNA, 146 bp, Homo sapiens
ccaggccgggcatggtggctcacgcctgtaatcccagcactttgggaggccgaggcgggcggatcacccgaggtcaggagttcgagaccagtctggccaacatggtgaaaccccatctctactaaaaatacaaaaattagcgaggc

SEQ ID NO: 7076 - DNA, 117 bp, Homo sapiens
atcccagcactttgggaggccgaggtgggtagatcacttgaggtcaggagttcaagaccagcctggccaacatggtgaaaccccgtctctactaaaatacaaaaaaaaaaaaaaata

SEQ ID NO: 7077 - DNA, 129 bp, Homo sapiens
ctgtaatcccagcactttgggaggccgaggtgggcagatcacttgaggtcaggaatttgagaccagcctggccaacatggtgaaaccccatctctactaaaaatacaaaaaattagctgggcttggtgg

SEQ ID NO: 7078 - DNA, 165 bp, Homo sapiens
cccagcactttgggaggccgaggcgggcggattacttgaggtcaggagttcgagaccagcctggccaacatggtgaaaccccgtctctactaaaaatacaaaaaaattagccaggtgtgatggcacacgcctgtaatcccagctactcgggaggctgaggcagga

SEQ ID NO: 7079 - DNA, 145 bp, Homo sapiens
tcccagcaatttgggaggccaaggcgggtggatcacttgagttcaggagttcgagaccagcctggccaatatggtgaaaccccatctctactaaaaatacaaaaattagctgggcatggtggtgcgtgcctgtaatcccagctac

SEQ ID NO: 7080 - DNA, 7000 bp, Homo sapiens
cggcccctcgtggtggcgccagatactcgcgctcctgcctgccagaccccgaggcccgcagcctccgcggatccgggcccgctcggcccctcccatggtgagccccccgccctttttccagagccttccacggccccgcccccccagcccctatcccgggctcacgcctttgtccgcagcccccgccgctccggggtgtcccctgtggcccgaagggtggtcccgcccggggccgggttcccccgtggagcacccggtggttcgcgccgcgctctcccctttgttgcgcgttcgggccggggtggggggttgggggacgggggcggggcgggctcatattactgctgactccgcggcccgatttaaacgcgggttgggggcggcagacaggcagccggcacgctcgcttgtttttcctattggagagttgctcgctctccgggcaggaaacctggaaatgggggcggggttgggggacagcggcgagggaggggcccgcgctttgtaccagcgcccccagatgtcgcacccgtgggcgttctccctggcggccgctccgtgcccgtggagtgcgcacctagaatacgcgcccgccccacatgtgggatgctttgatggactgccgtgagcccagaccttaaacgtaaacattcagcttcgcaggtactttgggctgcacacgcttctccggacccaaaagatgcacatgcttttcagaaaccgtaagtttacctggggctgtaaaaccgcacatcgcgactttgcaccgtgcacacgcttgccccgatgtgagatttcccctgggttcgcgctcgggtccgcttcttaaatacactgcctcagcggtgtggatggcacagagctgtggcagccctactgaaaccttaaacaggcttcctggggtcataaacatggataccgagacttagatcacctcccacaacttaaacgtaccccttcactccactgccttcgccccttcctgcagcattcgcatctagttgttcaaaagtgctttccgggtcctcagacatgcaccccaaggttttaaacctcagtgcaagtactagatgggcttccctgtgcaatagggatgtcaggcgcgcagttttgcacacgattgccaagatgtgagatttactttaggttgcaccttaaccgtcgtttttaaatatgatcgtcccatcttgatgtgctgctcctgctgtggaaggtatccctgggttttaggcaagcatatgtgttctttactatggctccagatcccagcatatttgaagtcctgagtcaacctgctctcctagacaagcagacattaagtatgtcgcttgggctcttaagtgcgttctcctgacttttacccatctttgtggcagtaaatgcatacgtgtcactgtatatgcggactagatacctcaggtcccagcgccataaacaacttgtatgttgtaagtgtaccctcatctcgaaagtcacctccagctgtgcgttttaactcatctcagatgctggatgtccggtatggtgcctgaagcccccggggcaacatccactctctgtccaactcattctaacgccaagatactcaggttttctatctgatcttctgacgactgcccaaaagtcagaatcacctgcgtgggtgaagaatcacctgcgtgggtggagaatcacctgcgtgggtggagagcaagtttgttcaggtttttctctttttaagcactcacaaaataaaattttttgtgtttgctagtattctggaaggaaagatctccttgtgcttcatagaaaatttggaaaatacctgtttgtaataagataaaaataaatcacccttataatttgttttcccccgcctggaggcgcctattacggggaaactctcgtgggtttcctgctgccaggctgtttgcggagctttcccttgtttgctttgagatgtttttggttttaaaaaacaataagtgaggtcaggcttggtggccctcgtctgtaatcccagcactttgggaggccgaggcgggcggatcacttgaggtcaggagttcgagaccagtctggccaacatggtgaaaccccatctctactaaaaaaaaaaaaaaaaaaaaaattagccgggcatgatggcgcggcttgcagtgagcgaggttgcagtgagctgagatcgcaccactgcactccagtctgggaaatgagtgaaactctgtctcaaaaaaaaaatagtaataaaaatagtggggagagtgcctgtgagtagcatttgtggcgttgcttggctttattgctagaactttctcttggtgttctacatgttttggtctgtgagacccctctgggggtgggtgtcccagctgtcttccaaatgtttcccccttttcctcgctgtctttctcctggatggtttagtcccctctgtgtttcttgtcatctccttcctgcctccccccggggtcagacttataaggccagagaggtgggcactggctgagccagaggaaggaattgaactttgggatgacagggagctttaggagagtttcagcctgggaaagacagggcaagctggtgtgtgggacagacacagcgcaacgcggcttgtgcctgtggaggctgcaaggaagccctggcccagctgggcacggggaaagccccctacagctggcttctaacttgggtctcaagaatcgatcaggcgcacagctggggcaaaggctggaggtggggctggctgaaggcttcaggactctgctgggccagtgtcaaggtgacagcaggctctgggaaggaagggtcctgagggtgggcagcgggaaaggacatgaggaccagcgtgtgggggtcctgaggggtgagcagagggtttggacatggccccgtgggcttccagcaggggatttggggctgaatattgggacgtcccctctggggtgtgtggggactgcctgtccttgcaggccccggcctcagttttcccacctatcccccactccattgcaggaaggtgctcgggtcttcggggcactgggtcccatcggtccctcctcagcctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccacccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggcttcaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccactggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctaggcctcccttctccctcaggagaccaggggcagaccagggcttgtgctggcatgaggtctcttaagtgacccgttcccccttcacccagcaccgtttgttgagggctgcatatctgggccccgagtacccagtctgtagggaaagtggacatccatactcaccccccaggcatggcctgggaggctgactgtgcatggctccagggaggccagggacagggccctgagcgggtgatccctgggctggacaccaaggttgagaagttaggccggcagcgtggaggggacagcactgtgggggtggccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggacctgatcggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggcttggtgagcggt

SEQ ID NO: 7081 - DNA, 125 bp, Homo sapiens
catgcctgtaatcccaacactttgggaggccgaggcgggcagatcacgtgaggtcaggagtttgagaccagcctggccaacatggtgaaaccccatctctaataaaaatacaaaaattagccagg

SEQ ID NO: 7082 - DNA, 134 bp, Homo sapiens
ggccgaggcgggtggatcacctgaggtgaggagttcgagtccagcctggccaacatggtgaaaccccatctctactaaaaatacaaaaattagctgggcatggtggcgcatgcctgtaattccagctactcagg

SEQ ID NO: 7083 - DNA, 131 bp, Homo sapiens
agtcccagctactcgggaggctgaggcaggagaatggcttgaacccgggaggcggagcttgcagtgagccgagatggcgccactgcactccagcctgggcgacagagcgagactccatctcaaaaaacaaa

SEQ ID NO: 7084 - DNA, 755 bp, Homo sapiens
tgaagtagaacatgcatgagaaagaatgcagaaatcatgaataaacagctccagaaagggatcacgcccaactaaccagcacccgaattcagagcccaccagcccccgggatcccggccacgtccactctgaccccatgcctgcaaggatagggtctctatcgtgacttctaaccccaccaggtacttttgcctctttttagaaatggaatcatacagtctgtactcttttgtgcctggtttgttttggttaacattgcgtctgggagttttatctctgtccagggttggcgaaccccagcttacaagccaaatctggtcctttgcctgttttcatatggcctgtgagctaaggatggattttatgtttttaaatagttgcgggggggggcgggggggggaggaaagaatgatattttgtgacgcgtgaaaattatatgaaattcaaatttgtgtccacaaattgactgggcatggtggctcatgcctgtaatcccagcactttgtggggccgaggtgggtgggtcacttggggccagaagtttgctaccagcctgaccaacatggttgaaaccccatctctactaaaaggtacaaaaaaatagctgggtgtggtggttgatgcctgtaatcccagctactcaggtggctgaggcaggagaatcacttgaacccgggaggcagagattgcagctgagccaagattgtgccactgtacttcagcctggatgacagagtaacactgtatctcaaaaa

SEQ ID NO: 7085 - DNA, 554 bp, Homo sapiens
  misc_feature (20)..(21): n equals a,t,g, or c
  misc_feature (31)..(31): n equals a,t,g, or c
gcagctgcagtcaagagcgnncgcctggccntcggcctggcctaagccctgcatccatgatgaggccggggcaggtctccctcctgggtcctgatgctgtttctgtgctcggctctggcttggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccgg

SEQ ID NO: 7086 - DNA, 205 bp, Homo sapiens
gccagggccagccacaatctggagctccagtgtcctggcttccttcttgggcccaccagctagactttccagcttaacccacagtgtctcatcctggtccatcccactagtcaccactctctgttcctctcacttaccccttgctcttcaaagcccatacagtaggtatacaagtggacaaaaaaagttgctcatttatgcaatc

SEQ ID NO: 7087 - DNA, 1274 bp, Homo sapiens
ctgaaagcttttgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccatctctacaaaaaataaaaaaaaattagtcatggtgccacttgcctgtggtccccactgcttgggaggctgaggtgggagaattgcttaagcctgagagttggaggctcagttagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacgtcactgcaagagttgagagccagcgtctaaagtgtccacggcatcctgggaggttttatccttggcgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatctgtatttcatgaaagcagttctgaatgagagtaaatcagcttcagggtgta

SEQ ID NO: 7088 - DNA, 39567 bp, Homo sapiens
tcacctcattagtgtccacctggcactgactgatcagcacactataacatcatgagaaagatggcgggaagatccctggtaattatacatttttacttacgtagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggttagttcacagataacatagcaggcatacacttgtgaagtttgttactttgcagagctgggggatttttagaaagtatacacacatgtgatgcatacacacatgtacacacatacacatatacttagaacttcagatgtatgaacgtggtgaaacacagttggaatgacaccaataaattcagtctcttgtcttaaaaagggtttataaatcattacactttaggaacctgttgaaaccagttaagtggtctctaaatagtataatacctgaaagatgtctgcatgtatcttctcaggcttggcttaaatgctgtagaccccaaatatatgggtgataattaacttttaaaaaaaaaatgaaattaaaaaccaacagtaagaaatttcttaggagaaatatttgaatatccagtggctaagtgaatactgtaatatatatcagcatgtaattctgtatatacacagcacattaaaaaaactaacattgatgagttcaaccaaaaaagatcaggttttaataatatttgcagcattttattaatgtcaggtatgattttatttagaattatttttttgtttcctgaaccacctgtacaaatacaatttgcccttagcccctttgcctttcttgtctttgaattgatctctttgttatgagcttggaataaagaaaaaaatgatatgtgaggaccaatttaaatagcacttggtatctgtattttaaacttataaaccatggtgttaactttcaaatgtgactgttcagctgccgtcctttatgcttatcatgtgtcttgggctttctaagcttgggtctgcatgctcctcggtgttttcccaggaatttcagtgacgctttttatgttacctaattgacgttgtcaaccatttaactgtgtagcgcgtgtgctttaacattccacttatgtttatacctggggtctgcaaagaggaaaacattcaagcttttaagaattaaatcacctagaaataatgattacagttcgatcatgagaggagggtgtgatggtagcaattcatctttaatgctctagtggcagtcattaaattttgtgaatagcaagtatttggcaccacttttaaaaaaaaaaattctaaaatcggttttattctgtttttccctgttctattgtgaaatagtaattcccatgttaacagtgctgtaggacgcatttcatttcagcataagtgtgtatgtttgtgtagatgcgtgttgtgtattgtttgttcattgactatgtgttaggacctttgtggtttggagaggacatgatttttccagctgtccctgtgttgagggcagaaaacaaatgagtgtactgacttgatctttcgagttaagatttaattctgttttgttcaaaaaagaaaatgagttgaaagtcaggttcctttgctccgtcacagttgggttaaggccacaagccttgctagggtaggtattgctgtagcatgtaccatggagggtcagacatagacacaagagacgtagatcccaggtcagaaccagatatgtttgtcagtagccttctgactaagtccgccccacccctctgcccacacccccccagttggcttttttggctcagttttctttgtaaagtaaggttttctaaggatttttatatgctgtaatttcaatattctcccagagatattggttaactaaaacttctgttcagcccatattgatggctatttttgtttcaaggtgtgcaccatgacacaaggggatggtcagcagtagacactcttaaaagggaatctgaatttcaggataaaatgtctcctcgtagtccttcttagtctattcctcttctagagcttttttccctgtccaaaaaaaggaagcctctttggcttgtaaaatgttttatgcttttcaaggttatttcatatcaatctcatgtctgaaccttacaaaaattcctgagggttgggagaggagattttggatgctcatttctcaaatgaggagactgagaaaaggggagctttagagcatgctagggatcatagagccagtcctcagtggaacagggactgaggcctcctggtatccctgtcctttataatacgcatgcagctttgaagtagggttttacccctctctataacatatttgggatgtgtttacttgttttcattgttataatgactaatcattctcttctcattgaaaagaaaaaccaccccatcctcacttcctgctgtctttctctccccttgtccttgtctgtctctgtctgtcacacacacacaagctcatcatggagcctgggtctgttcatttgaggagagttgcccaagtctggaatgtagtcattccaggtgcctttggaattgttagtgaaagcatgaatcatgtttgttgtattttattattaagcaggttttggttttaggtttcaaaaattggtgatctgtgcttgttacaaataatgactaataagcagatgtttactaatcagaaccctctgatactttttaattaaaatcttgatttctctggggtttaccaaccttaagaggaatggcatactgttttaaaattctgtatttgtttacaacagctgtgttctaacagaagtactcttagatcccttcgtgtatattatgggaatgcatatcatcatttgttagactccttaggtcttactggccaatttgaagttcttggagaaatctttagcaatagattttcttcaggtatttaccactaagtgaattgtcactaaaggtgattggagcaaatggttcttggtgctccattcaggtggttctgatgcttttctttgggataatttgattgctgggtgatttctgtgtgacaggagtatatcaggcgacagctagaagaggagcagcggcacttggaagtccttcagcagcagctgctccaggagcaggccatgttactggtaaagccccgcctctgtttcattctgtagcatcagggctccttcatccgtccccaaagttgagcaagctgtggtggtcaccagaccattttggttttgctgtgggcagccaggctgaaatagtgatgcccattttgtggtcctattgctagcacattgcaacatggtctttatttatttatatctctttaataagttaattgttcttgtttggtagaccaacaaggttttgaacagaacttggcactcagtgaacacactagaatgctgagggcagtaggttgaaagcacatgtcacaggatttttacctagtatctataccactaaaactcacatttaattgaattatctcttactctgtccaatgataattatggttagcaacagctgtgagatttttccacaggtaatgtgctatttaaaatcccagccattttgctttcttacaaaacacagagggaaaatatatggtcactttttttaaaagccgaacaaatccagagaagaggcgagctctccagtgtcccatagatttagtgttatcctctccctctccaaggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtatcctctttcctttgtcacttagacattgccctggaaagtcgtataacgactcttcagaactgtgtcatatgagttctagaacgggccatagagtttagctaattatctggtttcttcattttctaactaggaaattgaatttcagaggagtggagggccttgcccaaggtttcatattcagtcagtgctttttccataaaggaccagagtgcctcagttaacatatcccagaagaacttgaaactgaactaaactaaaagattacatgacacagtcactcttaaaaatgtggatgagggaaagagtggtctgatgaactattctgccaagctagtataaagctaaagtgtgcctgtggctcaactttctgactttgcagatgtcaagatgccctgctagattggtgcattagggttacccagagcctcagagtaggctgcggcagggactgctcgggggtgcaagatgggcgacaggtgtgcctccagaggtgttgaatcccggcccacaggtggcagcagccttctattgtgtctgccctcacaggcagtagattctagaaacaagtgttctgtttgttctggagtgcttttatatttggtggagtgaaatgcattccggatttctgatgatagttttttagtctgttggtttagttgcttgtgacagattaatttttttctacttcatcatcatatacagtcttagaattctgagcaaggaggagagcttagagactgccttgctaatttttatcttcataaatattttctttttcctgaatctaatcctagcactgctttatgtaccttcttttttccagctacccctctcttttctggtagcagaagaaaacagaaaacttacctttagatttcttccacttttagactttctttgatatttctgcttttcccctactaacactgagttatgtcttctaattctctgatgcaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtagcgacagccagctttgctgtggttgaggagactcatgcaacggctcgctgagccgcaggcctgctgtaatatcacagtttagtttgtcaccacactgaaaaagaggagagattagcaggagtgagtttagactaaaagaaggcatagactcagttgatagggaaatatctttttctttctttttgagatttctatgtactcattaagagtatctagagtgagtgatttcttctaactttttgccttccctaactcaggtgttaagtgcctcctttttctgatacaaagatcttttagtttagtttttagagaactgggattataaatacatagagggagagccaggaattttctttgaagtattttaaaagtaagcgctttactgtgtgagccctggctcttggccagtcctatgaatgggccttagatgatgcccctgaaattgcatgcaaaatgtctttatttgctcaaatgtgtattttttgtgggggtggggggaatgaccttttatcagattctcacagggttcaagatccaaaaaagtttagatctagtgggttaggtgtggatttctctgaaataggccagggaaaaggctgtgacctctccttgggtctgctgcagcgttctagccttggctaggtgaggggaactgttgggccgatgctgtgtggctggagcagaacccacagtgctgtccatagaggagaacaagcaacgaagatcatggctaaagatcttagagatccttaaaatgccgattcctaatctcttgctgaaaactactgacttttagatattttcccgcttgccactctgtaatccagaatattaggaacaagttcttaaactcgagtttacttttcactggtgtttgcatgtgtgggggacaaaagtttatgttcttgtggcaggaaactgtgggatctgcagcatggaggagttaaaaaaaaaaaaaaaagggctggggcacagtggcacgtgcctgaaatcccagcactttgggaggccgaggcaggcagatcacctgaggtcaggagttcgagaccagcctggccaacctggcaaaaccccatttctgctaaaaatataaaaatcagccgggtgtggtggcaggcacctgtaatcccagctactcaggaggctgaggcaggagaataacttgaacccaggagtggagtttgcagcttgcagtgagctgagatagtgctactgcatgccagcctgagtgacagagtgagactccatcttaaaaaaaaaaaaaaaaaaaaaaaaaaaaggaacagctaggactgaggccagggctgtgtgagggtgagtgggtatttccatgggaccagcagttttttgagtcccaggagagctagcagatgggtagctccagagaggagaggatagaaaggaaagaggaaagcaggagagggtaactggacacaattaaaagaggatgagaagagagactactagaataggtctgaggactcgtgttctttagcaactttgcactgcttgaagattaaaagttttcacactgcaagttaaacttcgcataaatggacaatctttggccactaatagtttagaaaataggagtttctgaattatctaatttttgcatttgttatgaatttgtgtagtaactagaaagagtctcccatttcctcctcctgttcattctttgggggagacttttctcgtgtaggactctattttaaaactcatttttgattataatttcaggtaatactttgaattacatgctttatctctgaaaatcttaaacattttagaagtctaggattataccaatatctggtattatacaaatctcacctgtatattgtagaaatcatacaatagaactaatttcacatcttgtatttggaaaggttgaacaaattgattcagtattttcagtttatgtcaagtacattgatgtaatagatatgtagctatcattttttcagttgccatattgaacaatcattttagaacagtaaaacataatttaatgaaaatattttatggattttttcagagatcattttcccaatttagaagcaaccagataaactcagttgacaagtaattgtcatatttttgtaatttcccaagtggaaggaataccccaacaatagtcaattcagggaatccatggtactgaatatttttaaagaaatcacaattctttattttcatcactaatatgaaagtatatggagatacctgggttatgggtgtttgtagacttgggaaaaataagaaaaattgttggtatatttgaaaaattagctgttcttgagatattatagtctcaaaacgtggggtttgtctttgctcgttgaacgtgccattttgttactcgctctggtgtaaaatgtgacactgcaggtaatgtgaggatggctaggtaggtttgcacatttggcagtgcgctttatcttacaatttttctgcctctctctgcctttccagtctctgctttgacatggatgtgcatgcaacacatcataacccctttgggctctgagagcctctttgtggggaaaaaaaaaataaaaatcttcacattaactgctatctgtaatgtttgtctggatattaaaaagagttttccttgtaaatgtacatttgttcttttctacatactgtgttcccagaccacttcttcactttgaagtgtaactgtttcactgcgtggctgacctaacactgtaccaccccggtgtgtattccgcctctgccagttcctgctttggatttggtattgaccagaaaagccagttttatgcagaacgcattgaatgttttgtgttttgttttcttgtaaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggtaaggagcagaaagacagatgtgtgctgcttttttcctttttgttatttttttttaaagattatttattttaattatgggtatgcaacttgaccaaatttaaaggggcattgaaatttcaaagggactttttactggtgaggataaagttccatagttaggcaattctgtttagccagtggtcagttagcgttttatttttgttaaccctaaataaggtagcaaaatgatgtaagagtaagtctacaaagaataggcttcttaaacaaattcataatctattttagcagttttttatatgtttatacagaagctatgcagttttgcaatattaatgtcaaaatttttagaaaaagtcctataagaaaaattttattttctttttaaatgtaggggattttgttttgtttttgtgtttacataatagtgaaattaaacaaaggagcccatgtcaatttatttttcctcatttggaatttgcttcctctgaatattttcttgcttcctgctagtctttgcttcctgctgatccatttatagaccattgtttggtttctttgagcttattttcctgattctcacattatctcagcaaatgctttgtatgtccctgctaccaagcttcagtccaaacatcatttaaatgttacaggagcatagaaagcctgtttgtactggcttcttggatgcttgtgactaaattttctctccgattgtatcagtgtaggaccagggaaggagttggggtggggagtggaggtgataggaaggactgcttttaaatattaggactgctttaaaaatatattttggtagggaagtattttttttccttttcatgttttcaataatttaattgctatattttctacttaaaggttcctgtgagaacaacatctcgctcccctgttctgtcccgtcgagattccccactgcagggcagtgggcagcagaatagccaggcaggacagagaaactccaccaggtaaaagacaagtgagcactgagaacaggccttctgtgcagtctaccacagccttacattgtctgtttcataaaaatgctcttaaacacagacgttctggggctaagagattatcagttataaaaggaaaagctgccataaaatccatcaacgtggatggcatcaagttgatgtgtagtaaaaagtgggtttgaatccggatgtgtattatagcaactctgaaatttaaactacttttctctgtaagagtaaatggagggagcagcaaggaagggggagaagttctaagagaattgtgatcggggggagcttttcatctaagggatgttgtaaggcctgtggcataaaacagaaatcacaaacaggttactaaagaagtcactggttgacttcacagtctgcagtaaacaagtgaattcaccaaatactatcctttttaggttctagagctgctctgtccagtacgattagctacagaagcttccttatatttaaattaaagtttaagtttagttaaaatgaaatacagtggaaacttcattccttagtgcactgggtatattcatgagctctatagccacatatagctagtggctatgatattatccagctcaaatatagaacattttcatcataacagaacgcttcattgaccagcactatcatagggaagaaaagatgattatgttgaatgttttatatcttgatcatcactgaacctctaaagttagccttctgcgcatggaaccttggtctgacttgaggtgtcagatggatgatagcccaaaagctgcacagaatcctcagcactgctaatggcagggggactgtggtgttcttccctgaccaagtctgtgtcattaattcttacctagcacatgtgtgctttgggtccatccatggcaggaaatccatcccagctcatgctttctgtaccgtttccaacagcccatacaaaggactattctttgtaagtgtcagtttttgagaacagtaacaggcaggtgagagcagcagcctagaaacagaatatagttttgtgtataattatacaaatacggagtgttttcctaatattaagaactgacttgtagctgtgacagaaatggtgctgcttctacactgaacagtagcattgtatctcacacctgatgattttagatctactaatggtaggatatcatttagcatacaaactaaaaatcgataaaaatccatgaacaatgtcattatatcttttggtgaatttaatgttgagtgctgtttatagactgttttttgtctccctacactttaaagacattggatgggcacaccatgcacatgttggtaatttggtgctgcatctagagatgacacattagctgttctctcttcttcttttctaacagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatgtaagctgcctttcctttcctttttccctgctaatgttttgagctgtgatccatatcttggaagtttgtcttaatctgtagtttgcgtgtagccacacgtcacaaaacaatgttttagcataggttgctagtgacaataatagtcatcctgattttaatcataaaggagctaaattttgagagctttatatatacctagcactgtgagcgctttacaatttagtgggattaactaactttcccaaggtaattggctaatgtgtgagctaggatttgaacccatttctttcggtctgggctccagagcctatactgtcatcaatattggttattttaatgtactcataatagatgagtgaatattccctctactgtattattgacataccatgacaaggtatatattgtgaacacgtgtcaaagtgagtgtgatgatggagggtttaagtaaagagtcaggaaggctgctggagccctccttgggccccctctgctctgtaattcagacctgcaggtggagagcctaccatgagtgggcagacaggagtgggcggggtgggcagggcagcttcataatacacatccatatgttgatatgtgtctgtccatcttgtcccttttgaacccaacagcatcatccaagtctgaaggctctccatctcagcgcctggaaaatgcagtgaaaaaacctgaagataaaaaggaagttttcagacccctcaagcctgctgtaaggattgtgcaggatcagttttacttatttcagacttgaatgagatctttctattaaaaatatgtggttgagaggcctgcagtcttttctgcgagggcccctcacagatttgaggaattataaggaatgacctaaaccccagacatacttgttcccttccattggtatcgtctgctttccctgtataaagtctcaagtgagtaaaaccttttttctgttgttccagccatacacttggtgtacagtcagccttacaaaattatgcagaacaaagtatagttcttatttaatgaaatttccttctaaggaaactgatgctttaaaaaaaatacaaaagaaagaaaagcctttttatctctttcttggcattaacctttacttattcttcgtgagttcagcatttacaatactggcttttagactaagtttttaaaaatcaccttcttaaactcactggttgcctaccttctgctttttggtacctggggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggtaagcgccatctctgaaaagttccacttcagagcagcactccgaccgcctgtcagctcagcttgtattcgagctgcggtcctgctccttcctcaacttgacttcttgttcttttctagaatttaaaaacctcaaactttactccagttttcttaacataacatttgctgtatttattgttattaaatgtagcttttttgagtaactgtttaaaaagcttcagctataaccacgaaatactaatagcaagactcagagcccatcactgttatttcagtggctcaagctcaaagaaaagaaacattctcaactatgaagaaaatagaaaaccaagttggaactgctagaaattaaagacagaaagagctacatagactgcgtttttaaaaagtgattacttttacataaaattccccaaaaaagatgaatttggagttttatatgaaaatgtggagtataaatagtaatcactcttgaaaattatatttggtggattgattgagtcttagagtatctcagtgtggaagagtaaagggaaactaagccttttgaacaaattccactattgatttctttctgatgttcccttttatacgtggtgtcacagggtgatgtgggtaaggcttgaaggagggcgttagggacgcccacagcctcctgcccccagcactcagggtcgcagtgtctcttcatgtgtcacagacttgtccatgaatgtggcaggttgtgaacagtcggtgaagtgagatgtcagtggcatcctagtgctcacttcactcctttcattttaatgtaggtttgaagttttttttttttcagtatgaggtaaaattctagatcaacaaatgtatatacacagatccttgagctttggtgtaaagacacatgtctatatgacaaagtcttctttaaaggggtcagtccagaaagcaagcctctagttaaataagcctgatttaaagagttttgggagggaagttatgtttctacaacttttattaataaaatattaaacctaaaatgttgattttagtaaaatattaatatttattactaaaatttcataaatatcctataactagtaaataaaaacattaaatattaaaccttagcgctttgaagtttttaataataaaagttgaagtaaaataaaaatgtgtctctcaaaaccttttttatgagtctaaagaagactttgtcatgtagggagatctccttacaacaaagtccaagagtctgtgtatatacatttgttgatctagaattttacctcatattaaaaaacaacagtaatactatcagcttaacataagcagatcttttttttattgtcatgggatttgaactgtatatgacatctttgacttttttttggtgtcttctattttttttttttaatctctctcttgactttatttggtcttttctatcaaaagccataggagctcactttctcatgaaactgggtaactataaaagtcttacaaaactgacattgtggcaatttatggttaaagaacttctcatcttctcctgtccctgctcctgcttgccttactctctcttttctgtcctttgctttaggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcagtccccggtctcttttagagcggatgagagtattctctcagagcctgctttccactgggacctagttgttcctagactattccgtgaccccatgagcacttactatgtagttctcgtggattcagcagcaggtcgccttgtgtttccccttctcttcgttggtgtgtgcatatgtcagtgcttcccccagcaccccagcgtgtactttattttttccttttgatttgaggatatatgatccaggggaaatttcagtttggtataactactttaattagccataattattcattctaagtttttgctcagaaacaaatggcactggaaagaaattctttgttaaagggagaaagctaagcagttgcttttttggaggaggctttatatcggtagcctcatctcatgttttgattttgagaaggcgaaaagcctaaacaggatctccttgactccagagattaaggcctttcacgtctggattttttctccataggtcatctctgaatttgagcaatggtgaaacggaatctgtgaaaaccatgattgtccatgatgatgtagaaagtgagccggccatgaccccatccaaggagggcactctaatcgtccgccaggtacccgtgtcttctctgttgtcagaggctgagcttctcctgtggtcattaacccacttgctcattcactcactcatgctgtttctccatcatcatctgttttcatgttaacaagtcccagagggtcaagtgtcgagtgtcgggggctagggaggcaggtgtgtactgcatgcccagaaggtagcgagtagtctccaccccacatcgctgctcctctgcatgtctgcggcagccctcattcaagcaccgcgctgagtctcacagtctatgtctgagcgggagagaagccacagggagtccttaaacaggctcacagagtgaggaagcaggtctggagtctggcagagcagccaccatggctctgcagagcacgctgggctctgagtgtctgcagtgccacagtgggagcgggtgaggcaggcaggacgagcctcatcacaggcccagagactcggagagcagaagggttcgggaggtttctcttctatgttccaaaatgttagttttctcacttgttgaataattaaatgtgtgccacccagatatgctcagtttggatcactaagctttataactgtctgttcatttcttagcttagacttaattaaagtgatacgcttctcatttaaatagaacagggcacctatttagtattttggactttgccctaagtgtgtttcatgctatggcaatgcattcggatggaaagtaggaagaatgtggaaaagaccaggattcagagaatccacaggtactttctggagctttgcaaagaaagatttaaaaagaaaaaaaaaaggatactggttttggtaacagaagctagcgcaacagataaaccagattaaacactcactgctcgagccgtgcagccaccagattaggtactttgaattctgttggcacaagttaggcatttggtgaggaagtgtgagcagttcaggctaatttctttggtttttccttggtaatttagcagagtttataagtcacacagcaccttaaagcagttatcaatagggccataggcaattttagcagcgcttgagcgagacaagtgtgcctgttttttctacagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgaggtatgtctcgcaccacagctggctgctttcctggggttagaccagcactgcctaggagttagtttgcaaaggagacctttccaacaccctcaccccttcccttcccaccctgctttctctgtcacctacccttctccccaaccccaagtaacatgtttcagatctgcatataaaccccttaaccctagatcagctcccccaaacttgccagttcactgtttactgttctgtagataagtatagttgcatggctttatctagtttattttttaaaaatctaaataaaatgattgctctgtcctcagaccggtattatgtatttggcatgaaattcttatagtcatttgtggaatctgcctttttcattctttttatccaataaataaaatataggaagattcggttcagcaggcttggccttatctggacaaacttattatcctgtacaggaatctctttcaaacagaactgattttttttttttttcttgtttggggggtgggttgttggctgattactcttacttgttttcaccaaccctgttaaggagtttgttctttgacatttacaatcactcagaggtttagaagccaaattatttttgggaaacctagaaaaaattaggatgttaagcaagaaggacaaaggtttgagcttgtttttaatttaaaattttgtgtgggaaatctgtgtgctcctttgaaggcttggttgtggtgctcggtctgggtgttagctcagtctgggtgattctttgctctttgaacagggttatactccaggtgtagtgacatagcccacttgagcacccgtattgaattaaacaagtgatttgattccacagaagatttggtttaagtgtctttatctaccagttgagggaggttagaaagaatcagaaaaatcctctcctccggaggagcagtggcaagtcaactgcttcctagacaggcttggcatcggctagactggctcctgactcatgggacagggagggaagctgccaggggacagatgttcaggtgggaagcttaggggagggcatgggctctaggacatggtgaccctcaggtgtccatggagggggtccaatggtacaggacaaaagcacttgatcagacatgttccttttttctcctgaggtatatatcccacctacactcacattcttccttatatttatattttaaactttgctccatttcgctctaatgtgcagtattttactataacccttaactcactaaaccggcaaatttatttttctgtttgttttgtttttaattgtcattacatttccacttaacaatttgtttcacttcctttgtgtttttttgtcttaagttacattattaaccaaaacactagtgctcctaaaagatcaaaaagatacgccttcttttgtcatttgcacctttcactaatgagtcctcatttggtatgggtttaatggtgatgcacctaaaacaacagtagccaaagcttctgtagctttctggcaagaggctcaatttaaaataactacaattattaacaattgccaatattccagcatagattatttggactcttgggtaggagaataaattcagaagttggtgaattgagatcaagacatttcagacctcctttaggagtttcattataagtatttacttaatttttttttaaagctaggcacatgaagtctagatttcattggtagcttgcagcactgctttgtaagtgagcaatgtctctggtagagatacggctcctgcagtggttccaggtaaagctgccctgaggggtgctatgccacgtggaagctccccgcagagcattttttgggggaatgatgcaaggcaaatagagcaaagtattgggaaatagtgcaatatagaagtgaattgaaatgtgtatttttaatgttcatttttaaaatgccagttgtattaataacattgaaatttacattgcagactcagtccgctagtagcacactccagaaacacaaatcttcctcctcctttacaccttttatagaccccagattactacagatttctccatctagcggaacaacagtgacatctgtgggtaagtacagtagcaacaagaaagcagctgacaaatgggactttatctttgagttgctcttttgggtggcttaggtgtagctggttgttcacaggcacagacctcgggtacagaaacttcccatcccagttgtatgccttatttgcaatgagatgcagagtccatttcctttttccatatacattgcttacagatttcttctctttgacaaagtgttggttataccacatgaatatttacttgaagtatactggggaagggaggcaggcatagtgtgtgtgtgtacagaaaataatttcaaatatattgtgtttcagtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggtaggtgtctagccactactccaacactttcatttttgttctgagtggtggctggtcttctagagaagtactgcattgaatagtttgtggatagacaggatggaagacttctatgatgtccatctcctgttatatgcagagtggtatattagcagactggtgtggcacatgtatatgattgcactcattttaactgtcaaatattggcatgattaatctccattttatttttattaaacaaatttttgtagtagttttgttacgtggatatattgtatagtggtgaagtctgggtttttagtgtaaccatcagcccattatactcaatagtgtacattgtacccctgaaccctgaggttgactgttctcactataaaattcaatcatatctagcagtggaaatgttggagaagtatatttataaaaacttactgcaacatgcaacccagtgtttttcatttttcatgcttgtaatttccaagtactttacagtgactattcttttgactattagcattcagtactttataaaattatacaactgtacaattatacaacttggaaatatatcatggagaagtagaagatagagtgtaagtgccacaatacctgcagcttttgtgttttgaaaagagtcttcagctttatcttgttactccctcattctttctcactgtaaaatcttgaggttgatgtttatatgttagtttttagaaacacacataataggatttcttcacaaggcccatattttgtgtagttattaccagattcttgacataggagtttaaaaaaatctacttgatactgaagattgaccaggaaaatatcaaaatattgtgtaaaatagaacctttgaaatggtatctgtctggcagcagttctatcaataaatatctgtcttttctaccaataatttctaagctgttttagatcaacttgcctagatatatgcagggaaacctaagcataatattcaaataagttccaccttgacaaggatatagtcagggcagaatggccaacctcaagaataaaattatatgaaaatgaatcacatattacatatttaaatatttttcttatactgataatctttttagttgtacagcatttttttttttttaatctctaagggttaagtcactatgcccacaagcattgcttgggtagatactgtcctccaaatgttgggataatcccaactcaatcaactctataaggaccaggcatgaacagagagagggctgtaggagcgttgttctctcaatgccgtcacaattatttatttcagattatctggaaatagggtgtgggtgggtgtgggcatacatgtatgtgccatgatattcttccgcctcactccctctacacaaatactttattccttgtcttggtgagtttatgactgaggaaatcagtacacacagatatgtgcccaattccctaggaatgtagggtcatctgtgctacatgttacaaaggtgattctgacagtgaaggttctaggtcaaggaacaagagcatttggggaaatacatgaatgatcaagagggagaagtgctttggccaaggggcaggcagtcttagatgccagtccaaggcttttggaacaatttctacatggaatgtgtagtttttgaagatagtcatgacgtgagtattttagcaagattaggattgattggatgtacatcatgagaaagtggagagaagctcctttaacaaccttaattaaggtctctatccgtcacttaaaaggttgccaaaggctgaacaattgtgagagcagaggaaagggaaaggagggacagagaaggggttttctctggctctagtggccagttttagctagtttggcagagcagcttgggagctgttgatagaagcagccaagtcgcgaggctagtttcagtagagatctgcagtgggtggaaagcaggaggcaaagtagcagcgtggaattaggagttactggttctgaggcacactcatgcacaggtgggtgggtgtcaccagatggacagcagtggaaatgtctccactgaggaagcagagggcaggtgtggaaataaggaaggaggcagcagaagagtgtggagactgtgacggtacaaggttagagaagtagggtgagtcaaatatcaaatcacaatattttgatagtcctaagaaatggaaggacaagagaactgactacagttgtttcttgatgatggtggaaagtgatctttaagaaaagcttaaatgtgagtgatggaagccgaatcataagctgttaaggatttgagggctgcatttatatggcccattccagagatttgccaatgaaagatgaggaagcacaaagagatcatggtatcagatgaaggtttgttcaaatgtgtgatgtggctaattagacatagaatctgtaaagataggaaataatcagcatataacattctcgaggaactgaggaagaactagaaactaatggattattaaggaaattgatgggatgagggtttcttgttctttcccttatcctttcttatgtttaaatatgtcagcatcattgctacatggtgatgtattgcaggattggttactttaactgtttaacctttgactattttaaggatttctgcttctgggtgaattaaggaagctacacttttttccaaatagatgatgttatcctttctatacaacctggggatttgccaagcacagcataaaattgaggcctttctgtgtccctgaaacaggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggtgagtgtttgttttgtaaaccagaatatgtgacaccatcttaacaatattgtagctttacacactaaacttcagttagctcattcactgatgtactggctaaataaggtacaaccacattgagacttgacaataatgtgagctgaagacgtattcagaggtgacacacacgcccatttgatctctggctcctccgaaagcagtcttgagaagcgtatgaatgtgctctttctcactggcatctctcactgccctctctgcccagttgcttgttagatttcatttgccttgtccaatatgtaggtctgtgtccactcctttccaccagacttttttttttttttttttgagacggagtcttgctgtgtcgccaggctggagtgcagtggcgcgatcttggctcactgcgagctccgcctcccaggttcaagcaattctcctgcctcagcctcccgagtagctgggactacaggcaagtgccaccaagcccagctaatttttgtacttgcaaaaggaagtattctttgccattattgtaaaagtattgtattatggtttttattatgtgaattaacacaattatgtctcttttttacttatttatttatttatttattttttgagacggagtctcactctgtcacccaggctggagtgcaatggcacaatctccgctcactgcaagctccgtctcccaggttcacaccattctcctgcctcagcctcccgagtagctgggactacaggcacttcccaccatgcccggctgattttttgtatttttagtagagacagggtttcaccatgttagccaggatggtcttgatctcctgacctcatgatccacccaccttggcctcccagagtgctgggattataggcatgagccactgcgcccggccaattatgtctctttttaagaagagcatttttcttagtataaattgtgtaatataaactagtacaggaaaacaactacaagaaataaaaagtagaatcatccagagatcatatcttttaacttttataagtttttaaattccagttttttaagcatacaccacactcactgtatacttaagggaaaaaatctgcataaaaatggttatacaatatttcaaacataggataatggcacccaagtactaactataactagccagtttgaacagttgttgcagtacactgttgtacatacagtcagcatccctgttcctcccatatctacctgtccatggcaacctctttcctgaagttagggtgtatgccatccaggcctgattgtccaaaacacgtagtctgctttctccatgccattgaacatccttccatggcctccattttatatggctagaggatgtttccttgcatagatgtattaaaatgtatttagttatcttctcttgctgccctttaggtgtattcccttttttctctcatgtgaacatttttcacagatatccttgtagcttacttaaccttcaggcacataccatgttgcatagatcataatttcctaataattagtgttattccttggtcagatggcatgcaaaattataagactttaaatgagtcttatataccactacttacagtcacttatgatattataatcacttatgataccaccagtgatttttatttaattatctgcttgttagtacaagcttgttatgtaacatatttgcttgaagttattttacttctaatatatgctttggttgttaagtaaaggagtttcttgaaatgcaaaaatttcactatttatacttaaatgaggaaacagccatttaaaactagagtgctgatggatggtagttttttaagttggagaaaacaaatctgcatttagtgatccagtgaaacaagacagttcatggggatcaatactcagctgagaccaggtgcggtggcgtatgcctgtaatcccagcaatctgagaggccaaggcaggaggattgcttttgcctgggatatcgaggctgcagtgagctgtgatagcaccactgcactccagcctgggtgacagagtgagagcctgtctccaaaaaaaaaaaaaaaaaaaaaaaattaataattataatcagctgataccagtaatcattttttggtctacttttctgttttttttttttttccttccttattaactttcagtggttttcacaatcataaatgtagtacatgtcaattgtaggaagcttcaaaaatagaagaaacttaggaagaataaaacaaaatgtcacccccatctcagagataactcttgttaacattttatatttccctctccttttctctgtaagtatatctcacaagatggaaacaaaacattatatataaaactgtgtggtctttttcttctcttaacatatattgaatattttcctgcaaacaattccccaaaagttaaaaggattatactgaagtatgatatacagagaaagtacagataagcatacagctcaatgagctgtcacatgcagaatccatccagatagccccaccctggtgaagacatggaacattgccagcaccccaaaactgccctgtgaagccaccctgggactgcccccagaggcaagcactgtccagactttgaacatgttaggttgattttgccttcattgaactgattttatataatggtaaaacagtatgtgttctagtgtcagctgctgcttttttttttttttttttaagtagactttttctaaacgttttttcagtattttgcagtttagccattctgaaggggtgtaggaattaataggtgtatctcattttaatttgcaatttcctaatgatgtatggtacatcttttcttatgtttgtatatcttctggtgaagtatttcttctatctttaatccattttgtaattggattgttgcttgcttattgttgagttttaagagttcttcgtgtattttggatctaagtttctgatgagatatgtgttttgcggatattttctgccagtttgtggcttgtttgttcatgctgtggaatgatgtcttttgcagaagagaagtttttattttagtgaagtccaacttactagttttttctttcatgaattgtgcttctggtattgtatctaaaaagtcattgccaaatccagagtcacttggattttcttctgttaccttctagaatctgctttacagctttgtgtttcacatttaggtccacaatccattttgaattgatatttgtgaaagtttcaaagtttgtgtagatttattttcttttgcctatggatatctagttgttgcagcagcattcattaaaaagactaacctttctccattgaattgcttgtgctcctttgtagattactgctatatttgtatagttctatttttttttttttttgacacggagtctcaatctgtcatccaggctggagtgcagtggtgagatctcagctcactacaacctctgccttccgggttcaagcaattctcctgcctcagcctcccgagtagctgggattataggcatgtgccaccatgcctggctgatttttctatttttagtggagacagggtttcaccatgttggtcaggctgatctcaagctcctgacctcatgatccgcccatctctgccccataaagtactgggattacaggcgtgagccaccgcgcctggtgtatagttctatttctgggctctattttttcccatttatctatttgtctctttttgtgctaataaccacactgttttgattactgtagatttatagtaaatcttgaagtcaggtactgtcagtctttcaactttgttcttttttaatgttatgtggactgtgttgggtcttttgcctctagagtcagcttattgatatgtacaaaataacttgggattttgattagaattgcattgactctgtggatcaagttggaaagtactgatgtcttgacagtattgactgttctgtccattaacatggaaatctctctccatttatttagttcttctttgatttcatcagaatttgtagttttccttaagtaaaactagcaaagggctaattttattagatttattatacccattttgtttttttaagtactagtataaatggtgttgtagtcttaatttcaaattctaatgatttgttgctggtatacaggaaatacaggaaagtgactcacttttattttattaggcttgtatcctgcaaccttgctataattcttgctataattgcttattagttccagcagggtttttggttggttggttggttttggattttttttggttgattcttcaggattttctacctagacagtcatgtcttctgtgaagaaagacagttttatttcttcctccccagtccttgtaccttttatttcccttttttgtctaattgcattagctaggacacccaatataacatttactaggagttatgagaagggaaatccttcacttgttctctatcttatgaggaaagcatctagtttcttgccattatgtatgacgttagctgtaaggttttatggtagatgtttcttgtcaaattgaggcagttccccctctattcctatttccctgaaagtttttattataagtaggtattgggttttgtcaaatgtttttctgcatctgttgatatgatcatatgatttttcttcttagcttgttgatgtgtgtggctgacgttgccccccatcatttttgttgttgttgcttgtagctgtagtctctttgttcctttagatgactacaccacaatgtatttactcattttactatccattcagacattattgtttcctgtttggagctattaggaaccatgctgctatgaacattcctgttgttgtacttgggggcatacatatacatttatattaggagagagattaccagaccatatgtaagatatgcacatatcctactttaatagatagtgccaaacttacaaaaacagttctaacagtttacaacactagtttctgaagtttctagttgttccacatcttgcctacctttgatattgtcagtcttttgaattctagacatactgataggtgtatgaaatcatcttattactgttttaacacacgttattactggtgagaatgagcatctttttgtgtgtctgtgagatcacttcttttccaaagttccagttatagtggcacgtccagtttttctattgttatctcctgttctatttgatttataggagtttttttacatattctggattatgactcccttgtcagctgtttctgtggtacacatctccaacttgtgacttgcctttcactaggtttaagtgctggccttaagtgattgatttcttttggttactattgttattaatgatgagacctacttctggatatgcatgtaaaatatttatatttattttgctaggcaaaaaggataagttacgtgtctactatttgtcctggttaagaaataaaatacttcacaatgatccagaagttgagaagaagcagggatggacaaccgtaggggatttggaaggatgtgtacattataaagttggtaagttctagaagcgtcatattttgtttttccagagtttgattagagtttgaattttaaactttaaattttcacaggttttttgaagtttgtaataataaacttgtttctgaaacacgtggatcatttctggtgttctttctgtttccaaggcacattctaatcttgaagtctcatctagacattgtcttactccctctgtgcacctatatgcataacagagttcgtccctgcaactcactccgccctcagtctcccccacgctgtgcatcttgtgagagtctttccactcctcctctttgacagtccacattcttctcctctgtaagatgtggttcacagtaacctctttaaggaaatcttgtcagtggaagccagctgacttgagtccttttttacatgccaggcttattctccacttagaggtctggaggtccttggcaggcactgataagagtgtttgagagtttgactcaagggcttatggcctgccattttgaattaagtgcctgtgcacagctactatgctccttactagtaagtgagcccagctggccagtcagtgttttatggcaattgtattgttttttctccttggcatgaagcagtgattctcatgaagtaaaatctcacaggaacaaaaccaaaactctttttttttttgagatggagttttgctcttgttacccaggctggagcgcaatggtgcgatctcagctcactgcaacctccacctcccgggttcaagcaattctcctgcctcagcctcctgaatagttgggattacaggcaccttgccaccacgcccagctaatcaaaacaatttttttttaaacatgaaaaaaccaaaatactggcactaatgttagacatacgggagaaataatggaccttagccaaattaaagttttataggaaagatgttatagtctaacagaatttaaacaggaagtttttctatatacctaaaactgattaatgttacgggcctattgaatgtttgtttctgcttgtgtgttttcttttttctatgtttatgaaaatatatacatcatcagttcctctgttccgagggatgttgtcatgcttggcattgtcttgttggtgtagtttgtctgcacccctcagctcgtgggttaatggtgattgtgggagctgcctcagtatctctgacagttctaatgatacgggaaagtagaactatctgcttaggatagattttaggattagggttttctgtgtttatgtgaagtatttttatgtgttgaggtataactaaaatcatctaaggctaaatgtaatgaaacagctcataacagatgaaatgtacatgaatagattatcctgcagggggagcaagaggcagacgggttaaaagtctgttgggcttttccccagaacaaaacagtaggccttcaggcctgtcactcatacagaatgaatcacaagtattttcaggagataagtgtgggtaatatcattcattcgttgtcattatggttgccaccaagaatagggagctatttaaatgtatattaaattaataaaaattaaggaaaccttaaaatttagctcctcaatggcactagtacattctaagtgtgcaatagccccatgtgtgtggtggttatattagcaatacagatacggagagtttctatcatcgcagaagtctatgaaacagtaccggttttgtcagactgttataaacctttgtgtcttaatgttcgtttattgatttatttaaacagtggtaatatatagagtttaacaaggggagttatcagttaacaagttcctgctcatgcacaaagaagaaatcaagtagcggtgtgatgttagcttgtaaagaaatcatggatctgcattagtaagtcacaggtactcaaggacccctgggagtacttgttttggcagagttgcctggcagtaagggcaccaaaatagctatgggaaggaggcagttttactacttctgtagatcaggaaatggtcttagtgatacttggacttgttcacagatacttctgttggtagaattcaggactcatgaatattttagtataagccttttttcttcctcagtctgtgtgagccccatgcaggactagggaaagttgtaaggaggacctcggtctctgtgtgtttcaggagtctcttggctgattaatcatgttgttactcatttggagtaatactaagcccttgaagacttcagggtggtatacctggcattgtccttgattttaaaatatcttggaatctattataagaagattaggatcattagcgaaagtactcattgatggtcaaaatacattaaagagctggaaaaggaaactgtgaggtgtgatctctctctctgaatttttcccctgcttgtttggatgaatgaatagaaggcatatttataaagtttgcagaagacaactaaaacagtttagagggctatgttgatactgacctgtgcttctcttgcttttttatttgctgcttttcagtaaaatatgaaagaatcaaatttctggtgattgctttgaagagttctgtggaagtctatgcgtgggcaccaaagccatatcacaaatttatggcctttaaggtaacaacatcaagtgaatttaaaagtagtattggccattcaagctgcaaccaagagtcagggaatatgtttaaaaagtctgaatgttaaaattgctaatataaaagctatgtgctaatatagcatataactttatcataaaccatttctaatgtaataagcttagttaagctgctttctaagcccacagtgagaaggagagagagataaatgttgggtagacactttaatcgatgtggcaatgtgttcacagaggaaaagagaacagtacttccacccttcagttaaaaaggtgaccttcacctgagtcatggaagcgtgtaaagatttagatgtgtttttgataacaaaactgtgtctatcgggcagttttaagatatatctgttcataaaatactaattaaaaattaaattacagaaattctgatgacaacattatatactaagtgaaaaaagttaaaatatttcatatgattccatttttgtttcaataaaaaactcagctataacatctgaactaatgtacaaattaagatgtttttgccattttgcatgtatacagttttaggaaagtaaatgatggagtacttagtcttaaaattaggactgttttcatttgtgagttcacaaaaatactcatgaaatttacaaatatacctcacattgcctggtgattggctttttagaatagtttttttatattttattgaaggggtaggtttcatttatttgcaaaatttgtgtttttggattgcttactgcttgatttcccagtgaagcaggatagatggagtcacaatattcgcttaaaaaataatattcacttaaaaaataaatccaagtgttactgaataaagagaattggttatacagttatattatcttctgagatctggccttaatatcctttatataccaggtaccgtactagttggttttatacatattaccttatttaaagctgctgtttcattatcgtagtctcgtgaactgtgggtagtgatgtcagtgaaaaatggagaccaccagcacaatccaggctgttgtagcacatacagccttttcaccattttagtctagtcagaaaattagagaccttatgctactagtatgataatagtgatacaattttcagtgtgtgactcctacaactcctctcgctctactgtgcatttgaatagttgagtagcatttttaggaaagtcctcactattttactttgcatgattttctgatcaaggcagccaaaagcacagtaaatgacagagcagaaatcttgatctggaaagggagatttggaacatatcttctggaagaagtgtcttctagatgctaattaacaggcaaaaacgtaataaagactaattttgtagagtattgttgccttacggttgttgccagtgtggctcagtaattgcataactgagtatgttgggtcttctctagtttgatctattagaagtaagttctccggccgggcgtggtggctcacgcctgtaattccagcactttgggaggtcgaggtcaggagatcaagaccatcctggctaacatggtgaaaccccgtctctactaaaaatacaaaaaattagctgagtgtggtggcgggcacctgtagtcccagctactcgggaggctgaggcaggagaatggtgcgaacctgggaggcggagcttgcagtgagccgagatggcgccactgcactccagcctgggtgacagagcgagactccgtctcaaaaaaaaaaaaaaaaaaaatgttctccttcatcttctcacttctcttatggcttctttgcagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatggttggttgactggcttcattttgttttgactttcttctttactctgcttagtgaactaacacaagcagggattcatttccccttggtgtgggggtgagtatttaaatgatacgcaattttcaatagctccatgctcttagacaagtggaaatccgccttcctggctctgtggagcccttgtgaaaacctcttagctcttgctttgactaacatgggatggatttggggcagttgctgccaggccagaatatccctgggttgggagtggttctcaattggagcccagcatccaatgtttcatgggcctcaggagatatgagtcagtagagtatattactgggaaaaagcagagttggggatatatattgcatgactattctaaaatgttaatctaattgctgtatttatcttcagagatatggtaccagtgcattcactaagagtcttactgagcacttgcacagggctggaaataaccacagacgttcttccctgtactttgttcctgttctctagatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtaggtatggagaacttggggaaaggcagcatttgtgaaaatggagccgtgtctgagactccatttatttatcatgctgattttgtatgtccttcagaccttttgactaccattgaacagagtagttggcagtagatggtggaaagttagattgtaggccgtggaaatagtcataggtctattttagaacaaaatccaagtaattattttctactttaaaaactctattatcataatctctcatttaatccttaaaacatccagaggaatatcggacatgtttttgttgaccactttgtaaagggagacagagaattggtaaagagacagagaattggtaacgaattggtaaagggagacagaaagggaagttatttgcacagaatgctagagccataactacaaacagccttgtgcatacttttctagtttgcattcagtaataaagaccgatatttgacattttcatgggtttctattccaaaactattttggttttattgtaattaggtcactgtctctgatcactcatgatttctcttccctgccgtctctcatgactggattgataaaaatctgtgcactaaactctaaactcagtgggtaatttttctagataggcgtgaaaggcctaaggaaaatgaaatagatcaaccactgatgcaagtaactacttcacaggataggcaaggtggttacaaaggcagagttccttgaaaacaaatccttaaatgctaggcatttaaattttaaattttaaaaagatttagaagtataaaaatatatttttattaagtaagcaacatcttttcagggctgtttcctcatctttaacggtttgcaatttttccctccccaaaagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtaatagttcccttatggattctttttagttgctctatcttttaataatggcttgttttccatggagtttgatgattaatttccttggagttttgataaaaataatcaaggaactttttaaacgttgctttttagtcatgtttgtgaggattggggaatgttttgctttttgctatgaggggatagagatatttttctctgtagaaattaacatatttgggttttgctttgtatatgtatttttaactctattagatgaccagtctaggctataattagagatagggaagataaaagctgccagttcagttggctggaattcttttgtgagtggaaggaaccgccgtgccatttgggtacatcaaaaggttcctctgacctaatgtgtgtcaagaagatgccccttgttagtctgtgagtggtgaaattgcttcctaggtttgcatgacagaaatgttgcacagtaaaaatcatcttatgcagacataacatacctcctgcaccagagaccccatggcatgacaccccctttgcttttcaaaactggccatatcactccagggacgattcctgtggcaccttcctcccaggaagtcccttttaaactggctttggagttgagcagatagatggccaggggcgttgacccatccctgtttgccaagggagaaggcatcgagggtggaactgatttttactaagcctaccctttctttcttctgcccagtcagacaaaggcatgtctgactacctaaggcaagacaccacgacctttgaaacttggccctgaagaacgtttccaccttttgcgtcacattgacagactagcagtcagcccagttctcagatttaaacatttagtcatttaatgcaagaaagaagaagctacacatatgtccttggcagctggtcctgcttgcccgatacatcccaaacacaaagtcacttcacctctacccactgtcttctgcaaccctacaactcagtttcaagtggagttttgcctacagattatctcccaaatctgtgaccttgaaaatctctacagctcagacctaatccaggattttgtcagcttgttggcttatactttcctaagtatgtttaccatagctgcaactatagcattctttgaatttcaggcatttaaatatttttatcatgcatgtcatgtcctttaagatttattaataaatggcacaaaaattctatttatgggttatatgaagtaattaatacattttttgttgatttttaaaaagaaattaggttgttaaggagtcttccgtgatgctcattgtgttttttaaagacatttatttattagaaggtgttaacagtagaagtggaaagaaataacttcagaaacatccatttttttcctttgttgtctcacaatatgccaacgtgtaaggagttagtagtaacaagcctgagttgtaataaaaattggctgcagatggtcactccttacaaattataaattgataattgccccagaggtttttgtgggttgtttttgtttgtttgtttgttttggtgacggagtcttgctctgtcgcccaggatggagtgcagtggcgtgatctcggctcactgcaacctgaacctcctgggtgcaagcaattctcttcctcagcctcctgagtagctgggattacaggagcccaccaccatgcccagctaattttttgtgtttttagtagagatgcggtttcactatcttggccaggctggtcttgaactcctgacctcatggtccgcctacgtcggcctcccaaagtgctgggattacaggcatgagccaccatgcccagcctttttatttatttatttattttttgagacagagtcttgctctgttgcccaggctggaatgcagtggtgtgaccttggctcactgcagcctccacctcccgggttcaagtgattctcatgcctcagcctcctgagtagctgggattacaggtgtgtgccaccacatggtatttttagtagagatgggttttgtcatgttggccagactggtctggaactcctggcctcccaaagtgctgggattacaggtgtgagccactgcacctggcctcagagtttcttttgaaaaggctctttgggagtctaagcttctcgtacttgacagtgttgaggatgatggtggcttagattccctggctggaagtgcttcatgaccatggtaaccattccctctcttttcttgcttttgcaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacctattttatgtggcatgagtttcgaatatgttctgacccttcagaatgtttccttcctgtgaggatccatattttatgcatacctgcctaccctgagcttcccgtaccagagcaggctcctgtattttgctatttcagatgacaggggcttgcccaaggccaggtatagattacaaaagtagcaaatgtttgtctaaagacctcagagatgaagtgggagatgaacctccatcaccaggttcctgaagacagtatggagtaaagctggtccttaaagaaatgtcacatttttgcagttttgaatttggatcaaaaaatacaacagcatgatgtctgtaataggtcaattaaagtagctctttctcagtttggtgcataaatactaacttgggtttaataattggagccccttcaatgtaaggtcattgtgtcttcagcgctggggttccccatcaacccccccataggcctggtaggcatgatcgccgtcgggcaaatctggggccatgctctcagtgttggcacctcgccttagtctccagggctgcccgtgctgcatcatcatcaattaggcatattaataaaccacttcgtgtttcatcctagaaacatgctattctctctaaagggaaaatataactccttaggctgtcagatgagtaagtttttttttttcctacttggtgtgttgcagttggtggatgattatgaataaaaatctggtggagttttcttgggaccatcatgcaatc

SEQ ID NO: 7089 - DNA, 654 bp, Homo sapiens
aattcttcctgaaacagtctcatctttgcctctgtcctgcccagcttctttgctgttatcttgttcactatttcctaagggatacatagcctgcatattagccgagattgtttctcaaatttaaccacttattaaatttaaactctgctcctcctgaactaccaaacatgctggcacagagcaagcactcagagtccctggctgtttgcttaagtagcatgaaataactcctatgttaatccaagggaaaaccagcctgcctgtgcagtgtgggacgggcaaggaagtgctctggtcttcctcttcttccaggtcttccttccaggaagtgctggggaagtgtagtcccaggagggctgcagagctccattgcactgggcatgggccatcctgtcccataacaggttcctagtacttaccagtccctccagctggagcttgggtgctggaataacactgcaaggactcttgatttctgagaccaatctagtttgcttgtttctaagaaatttggattagatattccagcacaaagtgacttttaaaaaatactcatttctattttggccaaaagtgtaaaattcaggcaagttactcaccagagttctgtggagggatgcggacagagctgaccaaggccattctgctcttacc

SEQ ID NO: 7090 - DNA, 511 bp, Homo sapiens
ataaataaagatggcatagccattaaagttgtagtttttagatactagagcaggagcatcattcattttatgaccccatctccacccatgggaagctgatgagttttgtgtattgaattcgaagagcagagaatgggggaaaaggagattcccccattgaaaacctagataatgagagaggcggaaccaaaagcagactcagaacttcactgagaataatgggggtgtagtagtcaggtgagagagactggactaccaaatcatcgttgctatccagttattccagatgaaagatactactttacatttcttagggcatcatttttaagtgttggctttcagattaaatactagttgagagtggtgggaagacccagaaggaatacttaaactataataaatatgtactttgtgtatccattataaatatgtctaacatccctgatagctttaccctaagctttcttgtttaatggttaattttagtgtcacaaataaagtttgtgttaat

SEQ ID NO: 7091 - DNA, 3018 bp, Homo sapiens
aagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattgagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaatatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttctataacttccttgccaaagtcctgatttagtacattagagaacctgtgtttcctctctcctctaccattcatctctcttccatacagtcatttgggctttttactcaaagagaatcaagaaataataaggtataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgggtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcataccatgcactatgtaaacagacacattttgctatctgtgtcatcaggatagtgtaagtggtagggtagagactaccctagacatctgcatctttgtaagttagccagacaataaagaaaagcagaatgata

SEQ ID NO: 7092 - DNA, 138 bp, Homo sapiens
agatatacctaatgctagatgacgagttagtgggtgcagcacaccagcatggcacatgtatacatatgtaactaacctgcacattgtgcacatgtaccctaaaacttaaagtataataataataaataaataaataaa

SEQ ID NO: 7093 - DNA, 299 bp, Homo sapiens
tgactaggtagactgtagtgtagtcatattttggaatgcagactgtcattaataatctttgcaaagagtaatgccttcgaaagatgttcaaactgactatatgatcttatttctggaagaaaacggggaactgtttctaagtaaaaaatatacacataattggttatctctgggtgctggaggaatgggtgagttctttgtttttactcatccatattttctaaatctataataagcacacactgtgataagaagaaaatgattttttttaactttgtgcaagtacttgggagccagtg

SEQ ID NO: 7094 - DNA, 1052 bp, Homo sapiens
ggacattgcccccccgcctgctgaggctgttccttcctgctgcacttgagcagcctcatcttccttcatctcctctcatgttcacttctctttgcctggaccaatggggaaaaaagtgcacagaatgagattatgtgactacagcaattctgagttagctttgattgctctgcagtaaaattaagggaccatatctttctcatgcacatgatatatagtttcaaatatagatctgtacatacgtgatgatgaaaagttcttcaggatgaggatgtatcagagagtgtgaattgaggccagtcttctgtttcctcccaaactcttaacagattgcatatcttcatgcaaatcttttcatgtattccttgtatactacctatagaaaggtgggacttgggagggtcacttacaactcctgtgatcttattttctcctccaggggctccttgaatagagttttcccccattttactggccaaggctgcagttagagctgtggtttgtcctgcaggggatatttgtcagtgtctggagaaatttaggttaacgcgactggagaagtgctattggcatctagtgagtggaggccagggatgctgctaaacaccccgcggtacacagcagaccaaagaatgatctagccccagataccagtagtgctgaggttggaaaactcttaagttagtaaatatacaactgataggaaaaacatgaagtttcaataattaaaaagctttgcacgaaagtttattacagggctgggcatggtggcttaggcctgtaaatcccagcactttggggggccgaggtgagaggatcacttgagcttaggaatttgagacctgtgttggcaacatagtgagaccccatctctaatatatatatatctgggcatggtgtctcctgcctgtagtcccagctacttgggagggttgaagtgggagaatggcttgagtccaggaggttgaggctgcagtgagccatgattgcatcactgtactccagcctgggcgacagagcaagaccctgtctccaaaaaaaaaaaaaaaaaa

SEQ ID NO: 7095 - DNA, 431 bp, Homo sapiens
ctgtgaattgacacatatagcttcctctactgtaaaggttgatgtggctaatgagaaatatttccacatcttctcctttatttcaaggagataggctgtggaagtcagacgtctctaagccccaagctgttttatgtagcctgttgttagtatgtggaagctgaaattcttacagagttactctagaattgaaaaatctatctggaagtttggggagtactcatagtgcactaattattacaaattttcattatcttacttggattaaaaattattagagagccatttgtcatactgcttagattacaaacaattatagagttctagagtgcattataagctcataggaaatggaactttgtatttggtggcaaacctttattctttaggtagatatttgaggtggctcagcagatttatatgttgcggta

SEQ ID NO: 7096 - DNA, 865 bp, Homo sapiens
aaggttcaattcagtacatccataaatcgacagaatgaagaaaacataacaaaaagccacctattccttcctcttgctcccttattagctaaagtaaaatttacatctgtaagacttactgagttgctgccaaaatggaactgaattcttaaaagcaggaacatgcctatgtgaaacattagaaaaccaaaataaatgggaaaattcagacttgaagagctgaatcatgtgacaacaaagtactgatcttaattcagaaaggctacttggagaaggtgtatcttaaggggtaaaaaacctgtgggttaccacatattaacagggaataatatcaacagaggcacccataagcaagcaagacacaactgagacagatgtaccaggtgaaaaaaatcttcagtatggatacacatgggtattctgaaggctacaatgaatggtttagtctttgacataaggaggatgaacatattatttatactgtgtaatctaatctggcttctatggggaaagcaacatgtacataagtgaattttctacatgaagtgggctacttctgattttaatcaaagctataaaatagattgtatatttcactagcttcttaaagtaactcttccattttcatttatctctaaaaacagttaacttcctgtgctctaggaaatgcaccaataccaaaggtcaatgtggaaatatgggcatgtttgccctatgctgtgtggtctctagatttctatatttgctttgcttttgtctgctctagtaatctccctccttttgatctgtggcctgggaaaatgtggtttctttgtatttcaaataaaagtaaaatagttttttgagtggttcactcaagagtaaa

SEQ ID NO: 7097 - DNA, 651 bp, Homo sapiens
attatttggaaataaagaaggaaataaagatggcttcacatggaaatttaagttctttcagggtggagatttacttggttcatacaccttttgcctgaattaaagtatttcatgtaggaggacttttatcctttttgatagacagtttcatatatcttgaactcaatatctcagatctcttctactgtattactgaatagcatacatacatagacaatgttcgccattcactagatatttttttctattatcttacacttattcaagcttgtctgtgattaatggaattggtgtcagatgctggaatttattctgaccaatgaacacagctgactcaggggagtacaatctcctgccaagtaatagaaccaaacccaatatgcataaaagaaatacaatactccaggctttagctgaaggaagcaactacctgtgtaataacaaagcagcaaaaactatttctcatgtggctgcataggctgtatattatatctgatctctaatgtagcttactggtttgccttttttaaaaccaaaattggaaattttcctttgtaaagaaaaaaagtcttatgagataattgcttgattaatgttttgaacaataccaagaaattgtttaattaaaataaatatttttgtttgaaattg

SEQ ID NO: 7098 - DNA, 185 bp, Homo sapiens
tttgaaataaaatatttatttcagataaagttaatatttccataattaaggtaaagcaaacatatatgcttgagtccattatttaaggactataaaatgacttccatgaatattagagttcctgaatgtcatttgagtatctgcctacatgcttgttggaagcttctgtagccttttctttgtag

SEQ ID NO: 7099 - DNA, 1532 bp, Homo sapiens
cttgtgttgatttttgtataaagtaagagataaggatccagtttcattcttctacatgtggcttgccagttttcctagcaccatttattgaatagggtgtcctttccccactgtatgtttttgtatgctttgtcaaagatcagttggctataagtatttggctttatttctgggttgtctgttctgttccattggtctatgtacctgttgttatactagccccatgctattttggtaactatagcattgtagtatattttgaagttgaataatgtgatgcccccagatttgttctttttgcttagtactgctttggctatttgggctcttttttggtgccatatggattttaggattgtttctgattgacaaaggtattttgatgggagttctgtgaagagtgatggtggtatcttgataagaactgcattgaatctgtagcttgctttaggcagtatggtcattttcacaatattgattctacccatccatgagcatgggatatgtttccatttgtttgtgtcatctatgatttctttcaatagtgttttatagtttttcttgtagagctattttacctccttggttaagtataaccataagtattttattttattttttttgcagctgttataaaaggaatggaattgttgatttgattcttagcttggccgttgttggtgtatagcagtgctactgatttgtgtacattgattttctatctggagaatttactgaattcatttattagatctaagagctttttggatgagtctttagagttttctaggtaaatggtcatatcattggtggacagtgacagtttgacctccttttttccaatttggatgccctttcttttctgtctgattgctgtggctaggacttccattactatgttgaatagaagtggtgaaagtgggtaaccttgtcttgttccagttttcaggggcgtaggcaaagaattcatgactaagaacccaaaagcaaatgcaacaaaaacaaaaataaataaacgggacctaattaaactaaaaagcttctgcacagcaaaagaaataaccagcagagtaaacagacaacccacagagtgggagaaaattttcgcaaaccacacatccggcaaaggactaacatccagaatctacgaggaacctcaaacaaatcagcaagcaaaaaacaaataatcccatcaagaagtaggcaaagaacatgaatagacaattctcaaaagaagacatacaaacaactagcaaacatatgaaaaaatgctcaccattattaattatcaaggacatgcaaattaaaaccacaatgaggtatcaccttacttagtgagaatggccataattaaaaagtcaaaaaataatagacgttggcatggatttggtgaaaagggagcacttttacactgctggtaggaatgtaaactaatacaaccactgtagaaacagtatagagattccttaaagaattaaaagtagaactacctttcaatccagcaatcccactgtcaggtatctacccaaaga

SEQ ID NO: 7100 - DNA, 409 bp, Homo sapiens
tgaaaaagagttaagaaagcctaaagtactaatgacacaccgtcaagtggaccaaatacataatatgcgagtccaagaaagagaagagagagagaaagaaacagaaagtgtatttaaagagataatggccccaaacttgccaaaacagaggaaggagatggacatccagatttaagaagtcttccacataggaggacttcagagatgtccttaccaagacacatgataatcagattatcagaagtaagagttaattttgaaagcagcaagagaaaagtgtctggtcacagaagaaagcccccacaaaatgatcagatttttcaccagaaagcttgcaggtcagaaaattggatgataaattcagaatggtaaaaacaaaaccaaataaaacaaacaaataaaaatgcct

SEQ ID NO: 7101 - DNA, 319 bp, Homo sapiens
aaagaagccattatgtgaacaagacacatgcacacacatagttatagtaacacaatttgcaattgcaaaaatatgaaaccaacataaatgcccatcaaccaacaagtggaaaaagtcctatatatatacaccatggaatactactgagccataaaacaaaatgaaataatggcctttgagcaacttggatggagctaaaggccattactctaagttaaataactcaggaatggaaaaccagattattgtatgttctcacttataagtgggagctaagatatgagaatgcaaagacataagaattatataatggggccgg

SEQ ID NO: 7102 - DNA, 3788 bp, Homo sapiens
ttgttattgcaggtaagcatgtgacattatttgtgtgttgccttccctactagaacatcagctccacaagggcaggaatttttgcctgttgtcaccacgatgtccctggcacccagtatgttcttggtgtccccattgatgatgcagggatgtgtggatatggggcagtggactgtgagcatgtgatgagcatgtgacccagcccctagtgaccgcaccacatggcacaggttgcttataaaaaccattttaaattaaaaaagggaggaagcatcagtgcacacagatggggacacaggggcagagggcccagccccaagtacagtgtggtcaccccacagcccagtgggcaccagggcagactcccctcgcagcacagacagctgaggcccgggtgctggttcctctaggtacagctttggtccttgtgggctcagaggtctgcctttcggaaacttgctctgttcaaggagttcctggaaaaagaatgagggtgggtcagcatggccatggggcccccaactccatagacctcccagcccacatcctcttcctcctcctcctcgtcttcctccaaggatccttctgggatctctcctgtccctgatctggctgtgggattctccgattctctcttgcagtccaccacggaaggtatgaatcatccccattttacagatgtagaaactgaggctcagaaagatgaattcatgtatctgggaaatgactgctcagagcctgccctgcctttgtacatctggatgacatattcagatgcttatgcaaaattgaagccaccgcagccaggcgtggtggtggctcatgctgtaattccagcactttaggagggcaaagcggatggatcacctgagatcaggagttcgagaccagtctggccaacatggtgaaaccctgtctctactaaaaatacaaaacattagccaggcgtggtggcagatgcctgtaatcccagttactcaggaggctgaggcaggagactcgcttgaatctgggaggcggaggttgcagtgagccaagactgtgccaactgcactccagcctgggcaacagagggagagtctctcaaaaaaaaaaacaaaaaaaaaaccggaaacaaaacaaagtccaagctaccagcaaacatgttgctgtgtatgtgtacaacagcccccatcctgtacctgtcctggtctgcctctgcatcccctctctagtctctaggatgggggcactaggtcaggcacctgaggccgggtggggtgggtgccatcagctggggcaggcgctgggtaagcaggggctgcagagcctcccgcaggcggcagtagttgcgctccagctcacggtggtactccttctggtccggcccaatcagggccttatttttccgcagcgcatcctcacatctgagggccagagggtgggagatgctcagagactcgcacacgggactgaaagcaagactaggggtgggggcacccataaggcgggaccaggcctgcagaaagacccgcaataggaggtcaggttgggagagtggacttaatgggaatcgggcagatgggggagccatgcagagatcagatgggcagagagcaggcctatgcaggttaggcagacacgagacccctcctggggggttttgcgcctacttcttgcagaagtccttgaagcagagccgcaatttgttgtgatgccggaagagcttggggtcttccgggatctctgctaaaaacacctgggccacctccaggggaccctgtggggtgagagggactggtgagccagcctgcatggcacctggagtcccccgtgcggcttgcatcccccttccaccagccgtgcctggttcacggtgggccctacagagccctgaagcaccatctgtagcatcttagcatctggtgggtcctgctcggtggcaaaggccagctcccgtgtcttcttctgcatgtcctcgatggccacctccactggcgtcagcaccgtctgtggggtaaggggaggggtgtgtactcgctggggcctgaggaggtcctgatcgaagccagtcgggggcagctcagaccccgctgggagtgagaggggtccaagaacccaggcaatgaacagaatctgggggccttcctgggtctgactctgggggggtccagccttgggtctgctgggtctggtgccctggggtccaggggctttacctctggggtctccagacttccttgggtctggaggtagagatttggactggaagttggagtttggggtccccaacctggttctggggtacatgagccaatttctgggtctagcgtgtccacgcctctcctctctgggtctggaatccctgggcttctcctccctgggccttcttagatttggagtccctgtgcctcccctttgtgagtctagaatccctgggtcctcctgggtctggaggtagaggtttcagtttagagattggaatgcagggtctccatatcttctcagcccagttctggggtacctgggcctcttcctgggccacacctctcctccctgggccttcctagatctgggctccctctgcctcctctttctgggtctggaatccctgggccaccctgggtctggggtccctgcatcttgcctcccaggtctccctgggtctggtctcctcccctcccctccctggggatctggtctagggtccctgtgccacccctctctgggtctgaggtccgtgaaccaccttgggtctgggtccctgtgtctaccctcccctcccctcccagggtctgatgtcccctcacctccccacccccgccaggcccaggatccccacccacctcctcccggtggcacacacggatgcgagtcttgatgtaggggaaggcgtggtcggtgctgagcagcgtcttacgcttgtgttgctcgggcagctccccgtgtgcgcgcccatccggcgtgaacggcgtgcagaacaggaatgtgcgaagcccatagttgcggtcaaagtaggtcacccggtccttgagctcgtaggtatcaaagtacggttccacatacgtgatctggatgtaggcctgggcgcagggtcaggtgtgaggatcccacagccccagcacgcacagcccaagccctgttcctggagagaggggatctggggactttgtcatttccaagtcttcctatgtctggatgtttgggaatcccctgaggaataggttttggggtccctcagtgaaatatgatttggggtttcccagagaaagaggatttgagggtccccaggaaacagcacttggagtctctgtgaatctaagattttggggaaatggttgggggacccaccttttgtgagtcaagcttggacttgtccacagggttagagtctttgataatctcaacgacgtcgtcgccaaatctctccgtgtagaactcctggagacacagggctgactcggggccacccagggacagcccctactccagccccaaggcagccccatgccccgttccacccccaaccacaaggacgtgcctccagccggtgtgagatctctgccagcttcgtgatcgatggctccttgtacacaaactcctgctcatccaggtcaccgaagtgggcgccgtagaagcccacgcggaaatacgtcccgaacacgcgctggggctgtgagaaagggtgtggttgtccgggaggcccctgctggaggtctccctgccccagagataggtgtctcgaatatcaggatgggagtgtgaggaccccgagaacatcagggcatgggcacaggcagggggccctg

SEQ ID NO: 7103 - DNA, 128 bp, Homo sapiens
gagacaatgtcatgggagaggtcagaggtcagagttccctcaacccccagggtcctggttaacactgccccgtgagaatcattccgtggggggagagatcagagacgggaggggggcgggggcgaaga

SEQ ID NO: 7104 - DNA, 3211 bp, Homo sapiens
tgcgagtcagactgcctgcagcaccggctgaggcttacctggggaaagagaaccacggcgccgggagttaggagtctgtagggggaggggaggagatgaggccagccccctccacagctggttcacccagccccccaacccaggtctgggacccactcatagacgcacacccagcctggctgcggaagggccccccccgaccccctcccccccgcaggtctggaacaaagaaaccaaacctcactgcctgcttgcacatctgtccaggccctggacaggctccagctgttcccatagcccagcctccacatagccctggggctggggggccccaagcccaacaggccccacccttcctgcaccccctcccctcagcccaggcccggagctggccacacggaaggatgggggttgaggcgctaaggggttggggaagaagggaacctcgtcttcctgcaaggatctgaggagacagagacgcagggggacaaagagaggcaaagcatggcgaaggggacccccagtgaccccaaagctgagagctgggtcaggcctggactgggtcggggggaaggggtagggaaagttggggaggcagctaggagtgaagcctttcccctttatggaaacaattttctctaaaaataaacagtttcactgccgggctacacagaacttcctgcccgcctaggatgcgtccgggcccaggggcgcagtagggatagagggccgggtggaggcccaggaagtcctgggggtggaggggaggaagtaagagggggcgcctggaggctgcaaaagggagggacagtcagagcctctcactaaacccccctcagccttggaggccggccagggctcttttgtccccaatataacccatctgaacttggctggtcctttctgttatctgacctccagccatcatgctgcagaggccccagcccatcccaccatcagagtaaatcctttctggcctttgagtgctggggccggcaggtaccttgggaggatgggccaggtagggcacctgctgggcatgaaggcagggctggggctccaggggcacctgagcttgtccttgttctcccgtcctgtcttgctttgtctctctccaagtctctctgtgtctctccacgtctctctgtgtctctccacgtctctgtctctctgcgtctctctccacgtctctgtccttctgcgtctctctccgtgtctctctccctgtctttccacgtctctgtcttcgcttctctgtctttcaacacctggaacacatggtcaccaattgcaggaaattccgttttccatttgcctggaggctcacccctgagcaacagaaagttgattgaaaatattttctggccaccaaagagagatggagaagcagggagcaagcgggattggagcaggattggaatagccgagcggggtgggctgggggtgggggaagtgagggtgctgctgggtaaatagtatagtaacagtaatactaacatcaactcttttttttttttttttctgagacggagttttgctcttgtcgcccaggctggagtgcaatggcgcgatctcagctcacggcaacctctgcctcccaggttcaagcgattctcctgcctcagcctcctgagtagctgggattacaggcacctgccaccacgcctagctaattctgtatttttagtagagatggtgtttctccatgttggtcaggctggtctcgaactcctgacctcaggtgatccgcccgccttggcctcccaaagtgctgggattacaggcatgagccactgcacccagcctaacatcaactcttttaattgtcatgacaattctatgagatgggcacttatcgccccgtttcacagacaggggatgcagagggtacagaaaggtacagtggcttcctcggggtcactggggccatggggaagtggctgggcctgaacatgaacctaagcctggtggatccccccactgcccaccaagccaccaccctcagactccacatcagatatctctacccgtttcccagatacggagactgaggtctgagggtactcagtcatctcaccgccctcgatgaggaccagcacgtcccgagtaaggggaagagaaaggagacgagggggtgtggtgggggagatggatgtctgtggctgagacccttctctcgccatgggacccctggggaatggggaaggggtgacaggataagacagagatggagagactggagcctataagaggggacaggtagggagcgcagggaaggggcgcgggtctccccaacccaccacccaagaccggcctgcacatcgcggaggtcggtggtggtggtgggggggggtcttcccgccccaaactcggggtggggggaggcgagaaggaccccgccccgtgcagagagggggcggggcctgtgggatcccgggctaatggcaaacagctgccgctccccacgccggcccagccgccaagcccaggcccagcccggccggacgcccggccgccttcccgccgtctggggcatggccgcggaggagggcgaggggggacagtgcggggagagggcagagccggggaggaacagaggcagaaagtgggacagagacaggggagagcgggcagaggggagccaagacaggagaaacgggcagggcacgaggaatcgatggggggtactgggaggaatcgatgggggtatggggtcaaagacgaggagggggcagggacgcggggacagacactccaagtctggaaagtttgggcacagaaggtggagttggaggcagcggctcgttgagaccagcgaggtcgtgtcccagggttggaggcggggggtagggtagtaggtgtgtgtggagggggtgcacactcgatccccgaaccagacttgaacccctacccagccccgggtcccactcgccttgcgcgctccggccgctgccttccctgggtcccgccgcccgagcgtcttcgcgcgcgccgcagcctgggcgcccggccctcggaggtggctccgcccgcaccacgccccctccggctggtcccgcccccccagccggcaccgccccctccagccgcccgggcgccccggccgcggtggggggtggggatggagagacgctggttggagactggatctcacctggacagcaggtgtgtgtgcgcgccggggtgtccggcctcgtccttccttcctccc

SEQ ID NO: 7105 - DNA, 2914 bp, Homo sapiens
cgggaaaacgtggaaagagggtaaaatctgtttccagattcctctggcacctactggtgccctttggataagcaagtgctgactccagcaaggaagggctgatgtcctgccatcaggccagcagacgctggggccaggtgctcccctgcgtcgtgagtgtctcgaacttaacgagcctcaatattctggggagaagttttggtttctttcagcccctgggggtctgccctgggctcccggcctccggggctgctcctcaggctggacagcctaggtgagccctgccccgcctgcccccagagccgacgcgcagcctccaggttccgccagcaccaacgtggtcctgcgccacgatggcgccgtgcgctgggacgcgccggccatcacgcgcagctcgtgccgcgtggatgtagcagccttcccgttcgacgcccagcactgcggcctgacgttcggctcctggactcacggcgggcaccaactggatgtgcggccgcgcggcgctgcagccagcctggcggacttcgtggagaacgtggagtggcgcgtgctgggcatgccggcgcggcggcgcgtgctcacctacggctgctgctccgagccctaccccgacgtcaccttcacgctgctgctgcgccgccgcgccgccgcctacgtgtgcaacctgctgctgccctgcgtgctcatctcgctgcttgcgccgctcgccttccacctgcctgccgactcaggcgagaaggtgtcgctgggcgtcaccgtgctgctggcgctcaccgtcttccagttgctgctggccgagagcatgccaccggccgagagcgtgccgctcatcggtgagcagcgggggcgcggggggacctgacgatgcgctggggtccccccagggcggggccgcgacagggcctgggtctgcggaacggccccactgcagaaagtgagaggggggcgtcctgggaacgtgccctcattttaagactgaggggaaaggattagctccttccagggagaacacccctcacgacttggcccttgatgatggaacatcagtatccccagatcctaatgataggcaaaatctgtcgactgcttgctgtgtgccaggcactcccctaagcacttgacctttattaactcaggtaagcatcaccacaaacctaggaagtaggtcctctgggtatcccatttgtacaaaaaggattcgtatcttgccccagctcatgcccgtcgttatttgagagcgggactgtcctggattgtgtatgagtgcagcctccagcagtgacgggagcaattagagagcagtagcttccgatgacccacgtgtaggaatgaaggatggggagaactcggcccttacctccttcctgcttccatccatggggcttggagggtctggagagcttcatggtgggcttatttccatttgtgcagaggtggctgggaagctcaggaaccacaggcttttgttttgagtcaattggctttctctctctcttgcagggaagtactacatggccactatgaccatggtcacattctcaacagcactcaccatccttatcatgaacctgcattactgtggtcccagtgtccgcccagtgccagcctgggctagggccctcctgctgggacacctggcacggggcctgtgcgtgcgggaaagaggggagccctgtgggcagtccaggccacctgagttatctcctagcccccagtcgcctgaaggaggggctggccccccagcgggcccttgccacgagccacgatgtctgtgccgccaggaagccctactgcaccacgtagccaccattgccaataccttccgcagccaccgagctgcccagcgctgccatgaggactggaagcgcctggcccgtgtgatggaccgcttcttcctggccatcttcttctccatggccctggtcatgagcctcctggtgctggtgcaggccctgtgagggctgggactaagtcacagggatctgctgcagccacagctcctccagaaagggacagccacggccaagtggttgctggtctttgggccagccagtctctccccactgctcctaagatcctgagacacttgacttcacaatccacaagggagcactcattgtctacacaccctaactaaaggaagtccagagcctgccactcccctaattccaaaaaaaagaggaactctacaaaggccaagatcacagagtacagtcttggagggacagaattgtttgtgctgggtattggagctctcagtggggagcacatgggttataatgagaaactgaactgtactgctgcatttcctgtcttccttcctaggtggctgctttgcagggctttggctgttacctttccctgctgaggggctcagggaaaagggtcggggattctcagtcgagtttccagagcaggaggccctacagacatttggccccaaatccctgactcaataaagtaagcgtgtacctagcacctcctcgatgccctgtgttacccatgaggtctgtggtagtggaagctgggggtccaggtctgtctacttcaggtctcatggccgctggcgcaagtccaagttcaaagcctgagaacctgaagttctaatgtccaatggtaagagaaggatgtcccagctccaggaaagagtgtgaatttgcctttcccttatttttttgtcctctccatgccctcccacattgagagtggaacttgccactgagtccaccaactcacacgccaatctcctgctgcaaaccctcacagacacatccagaaataatgctttcccagctgtctgggtattgctggtgtccatggtggtgggttatcagaacttattaatgtcactgtcactaaagttggtatataaccccccactgctaaatttgactagcttaaaaaaaaaaagaac

SEQ ID NO: 7106 - DNA, 5257 bp, Homo sapiens
gccggcccaaccctttattcagagtctcactcctacagccctgggtaaggttcagtccccagattgtctcctgtttctccaccagccggtctggcagctaccagagaaggtcccagagttccctgcagatgggattgacaggaatcttggttacactgaaagcacacatggccaacatcctcaggatgggcagaggcagcaggcgaggctgtcccgtgtctcatgcatcaaaggaggcctggaccatctggaaaggccctcaccacgaggaaccagagcagcagcagcaaagaccagactgcagagagggggctctgacccatggctgcagggaaaacaggcagagaggttgggggagagagagagaaaaaaagaggtatttaggagcacaggagcaaaagtggggacatgcagatacaaggtggagagattggcagagtgagctggacagactgatacacaaaactgccacgggcaacagagatgaagatcaagtttagggaggagctggtccaatggtaatgggttatcagaacttattaacaccagtgtcactaaagttgatgtacagtccccccactgctaaatttgactggcttaaaaaattttaggcaacctgggcaacatagggagaacccttctctacaaaaaatacaaaaagtagccaggcgtagtggcatatatctgtagtccaagctacttgggaggctgaggtgggaggatcgcttgagcccaagagtttgaggctacagtgagctgtggtggtgccactgcactccaacctgggtgacagactgagaccacgtctcaaaaaaaaatttttttaataaagaatttaggaaggtagacagagatgagaccaattagagtcccagtttctcttccagaggtcattgggtctaacttaactgccttctattgccacaaataaggtgctgcagagtgggatgaaacatggatttaagatcagagtgggatctgctgtggctgaacttggctcctctacccaaaccctggtaggagaggtgtggagtggactagaaggagaaatcctaaacttttccagtatctggaattacataatcagaactcaaagatgcctgggttggaagctggaaacctggcttcttgtcctggctctgccataaactcattgtcaccttgagcaaataatttgtctctgggtctcacttgaccatataaggggggtaatgcctcctgttctgcctccttcccatagattactgtgcagtaaagatgagatgagatgatgatgagatgagatgagatgagatgagatgagatgagatgagatgagatgagatgatgagatgagatgatgagatgagatgagatgagatgagatgagatgagatgagatgatgagatgagatgagatgatgagatgagatgatgtctggggaggggtgggaactatcctggtgtggtggttcagagtttggctcttgagccaggctctctggactccacttcttagtagctgggtggcacagggccagttgcttctcctctgcacctttgattttttttgtttttgttttgttttgttttgagacagagtttcgctcttgttgcccaggctggagtgcaatggcacaatcatggctcacagcaacctccgcctcccaggttcaagagattctcctgcctcagtctcccgagtagctgggattacaggcatgcgccaccacgcccggctaattttgtatttttagtagagacggggtttctccatgttggtcaggctggtctcgaactcctgacctcaggtgatctgcccatcttggcctcccaaagtgctgggattacaggcgtgagccaccacacccggcctctctttgcccctttgtgctttggtactttcatctgcagaacagaggtgatgacagtaccactggggtgtggtgaggatgaatggcatgatgtgcctggagtggatcagaggaagctggggggtccttcctgcccactcacagagttctgaaggacaaaggagttctgaaggcttggggaggagctgctgtttcttccctggaaatggcccattcccacctagaaacatggtggcctgggtaggccttggcacaccaagtgtccgagggaagagaagagtcatagctggggatcatctggtccaatttgcttattatacacacagagaaactgaggcacagagaaagaatgggttggtcgtagagaaagttagagcagagcctggactagagcccaggcctccagcaccaaaagcctggcctcatggccttcaaaggtgggtttgagggagccctgagggcagtaacagagacagtgggttctgcactgggaggcagagaaggaccaaaggaggactttgtggggagcagcccttctgtccctcacctcagtgcagcctgaatctctcaggggcctgatcagtggccttttcctgcaagggataggcagatccaggctggagagcaggtgtccctgctccctcaaccatctgctctcccacacactcatctcctggctaaggctggcaacccccaaggtgccacttcagctagtgcacttttttttattattaatgcagttgtttccttataaaagattcaggtgggccgggcacggtggctgacgcctgtaatcccagcactttgggaggccgaggtggatggatcacctgaggtcaggagttcaagaccagcctggccaacatggtgaaaccccatctctactaaaaatacaaaaaattagccgggcttggtggcatgcgcctgtaatcccagctgtaatcaagaggctgaggcaggagaatggcttgaacccgggaagtggaggttgcagtgagccgagattgtgccattgcactccagcctgggcaacaagagtgaaactctgtctcaaaaaaaaaaaaaaaaaaaaagatcgaggtgatggggccaaccccagagcagcctgctcatccctgaactgagtcccacaggtgcctgcagcccttacctgaattatccagatggcaaggcccagacttgcacttcttgtctatagaaaagaaacagtaaagaatgaaaggctcaggagctgtcaggatggaaagggacctcagagccctggtagtccatccctgacttgttctaggagaagttggtgcatttccccctaattctgctctttcatggtggaacctcccttgactaggtttgcctcgacccatgagcagcagggccagaagggagtgggccatcagagccagggtctactctggggcactcctgctccctgggcctataactttgcctccctgccacactcacctctccctcttccatgcctcgccccagcctggtttgttttctttgcatgccctccttaccttctgtcaactcatgcatgctcctgatgttgtccaagataggaagtaaagcccatagcccttcagaaattaagaacctgggcccatcctcatggttcttcttctggcctgtgctggggacatgaacaggaggagcatccaccacttcctgaccacagcctgagctggaccttaggggcacagcacccaactgctgtctccttgcccccaccaccccacccagcacacccttcagcacataattcctcttccatctcataaatgcactgttctcagaaactgagggtgggactcctactcatttctggcaacagctatctaggtgtcaataatctggctggaaaataattcccttccagcctctgaccaggagaaaagcccgaccgggtctgcttgcccactcaaatggccagagaccgctgcgttggccaggaaacctcttcagcctcccagcaggcaagtggcgaactatggcttagatcccttcaggggcagtaagtgcacccctcagaaggttatgtctccccttagatggaaggggttgggagctggtggatatgacttgtatttatgtatccctgggacacaggagataggggcttcggtttgccaaagtccctggtggatgtggaaggtccaccttccgcacaggtgccgaccagcgcttgccctcctacctttgatgtactcgcagttgtaggtgctgtgcttgcccagggctcggaggtagatgcgggcggggccctgggccagtctgctggcattgatcacttggaaggtctcaaagggggggatcagcacctcttcctctccagggaagaaggagtagcccttgataggggccccaaggcaggtccagatgccgaagaaggtgtcctcaccaaactgctgggctgcaacatgcttcagggaggcagaagcaaagccccccagcctcacggtggcccggggccctgctggccggaagcgcaggccgtgcacacctcggaacacctggtggcaccggggtggacgctggccgctgcccaggagctgcagggcctcagtcagcaggaaatggagtgtcttgaaggagaagtggtggaggtagtgggcccgggagcggcccgcctcacgcacggctgcattgaactccttgtgcagggggctgttggctgtgtaggccaggagggccaccccatgctcatcgcggaagcccaggggtggcggggatggacgggtggggctgagactccactctggccacctggcctgacgctcctgccattggctgcttgccagtgtccagctgtctgcatacacctggttggcctggaactccgtgtggttgagatccgggagagcagctgtcatggcagcagcacagccagcgtactggtcatcaaaggaggccagggccatgtccagctgaatctcttgagagaagaggtctcgtcgtgtgatggggtggctctgggcctgaggggacaggagtagcagggactgagaggataggcccctgggagaatgagtcccctgccatccagctctcccctccactgagaaaggcaggaagggccccaaacacacctggtggggaaggggattgggaacctctggctgtaatttccccaagactagcatctggagctgtccccttgggctgagtgatccccaggggaagcgtcgggcattctttcctctctctctttctccctccagggttcagaagaagccgatggctcagttccctgctggggtgggaacagtgggggatgcccatacctgaagtgcttccatgaggcccacagacacaagaagcagagacatcatagcaggcatctgcatgctggtgaccctgggccagttgctgtctctttttgggtctcagtttcctcatct

SEQ ID NO: 7107 - DNA, 1802 bp, Homo sapiens
ccaggaggacactcataaggacagggccccagccctgggagtggagggtgtgagcagaggccctgggactagggcctgggatggacaaccctccttactgaccctccagagtgcctgggagctgagggccggctggctctcaagctgttccgtgacctctttgccaactacacaagtgccctgagacctgtggcagacacagaccagactctgaatgtgaccctggaggtgacactgtcccagatcatcgacatggtgcgttgtggtggtggtacagctgtggagtcttacctgtcacagtgtcaagaaatgaaggggtgagagactgggattattctccatggaatttcttttctgtaaatgttaatattaacaaaggtagcagttacaaactgttgggtactgactgttgggtactgagtattgggtgcctacctcgtgcccaatattttgttcacctgaacttactgaatccctgctaagcagggattctcaccccatattcctgctgaggaaacaggggcagaaaagagaagagcccactaaggtcacatggcaaggtcaggtctgggtgggaactggacggtatggacaagtcaggtttgtgggtgctgaccagagccctgcaggggagtgtgcacagacagggcaggatatgcatatacatgtccacatctctgccattccctgcccccactaggatgaacggaaccaggtgctgaccctgtatctgtggatacggcaggagtggacagatgcctacctacgatgggaccccaatgcctatggtggcctggatgccatccgcatccccagcagtcttgtgtggcggccagacatcgtactctataacaagtactgcctatctgggcccctcctctctcttacccctctctagacttgcccttagctgtgggggtgtagtgatcccctctccctaccacataacctggttgccacgctgccctggaagcttttccccaggacccttctaagctgccaggcactcagcccctccatggcacccccactttaggctatcccaggccagcccaggctgaacgtctcctcggaacctactgtgtggtccagggcagttgtctgaatcacaagggcctctctagggcacacttttagctctaagtctctcagggctccccgaagagcctgtgtaagggtctctttcctccaggacatagccctctggaacactgctttatgtctccttgaccagttccgtgtctcccagccagcacatagctctgcatattttctctggggcccttctacaagttttgcagatgtcccccaagggaagtcactgtgtgtcccggagctacctctgggttctgcagaggcctttttatacatcctctggctacgtctgtgtcccttctgggcccttcaggcaccaccccttccaggcctcgaaaggcagcgggtctctctaggtgcactccaccctctgtgttgctttgttctgaaaacaagaatcaaattaacgaaaaaaaaacaagcacaagtttatttatttatttgagacacagtctcgctctgtcgcccaggctggagtgcagtggcgctatctcggctcactgcaagctccgcctcccgggttcacgcaattctcctgcctcaacctcccaaataactgggactgcaggcacccgccaccacgcccagctagttttttgtatttttagtacagacgaggtttcaccgtgttagccagggtggtctcgatctcctgacctcgtgatccgcccacctcggcctcccaaagtgctgggatcacaggcgtg

SEQ ID NO: 7108 - DNA, 3310 bp, Homo sapiens
gtccaaggaaaagcctggaggctggtatagcacattccgtcgagggaagaaggtgagtcaccgaggccgagatggggagtgacatgaaaattgatgggaaccagcaggggggtttgaggggtgggttctgagaggtgagatgaagaggataggctttcctctaccttcctagggatcgcaagctggaggtggggtggcagcagcatcagatgtgtaacaggcagtcaattgccatacagaatgatggtgccaggataggggaagcacagggcatggtggaaatttagaggcagtgttggaaagaccagaaggcttcctagtagagatcacagctcatctgaagcctaaagaatgcactgtgttagcaagctaggaaggacaaggacaagtgttccagggagagggaaaggcatatgcaaaggctcagtcaagacagggtctggtgaatttgaagaagaaaaagccacatggctgggtacagtggcctgtaattccagcactttgggaggccaaggtaggcggatcacctgaggtcaggagttcaagaccagcctggccaacattgtaaaaccccatctctgctaaaaatacaaaaaattagccagacatggtgatgtgtgcctgtaatcccagctactcaggaggctgaggcaggaaaatcacttgagccctggaggaagaggttgcagtgagccaaaaccgtgccactgcactccagcctgggcaacagagcgagattccgtctcaaaaaaaaaaaaagcattattaagatattttgtatttttttcagattagctcttcaaaatctgatggagattttacatttatagtacatcacaatttgaatgctaaattttattgggaatatttgctctatatttagatttcataaaaccattgaacaacagttcaaaaagtagattcagactcaagttgttccaagcataagctttctgataactggattgaagctcagtcattagttgtgaatttttttaagtaaaagaattcagggccaggcacagtggctcacgcctgtaatcccagcactttgggaggccaaggtgggcggatcacgaggtcaggagatcgagaccatcctggctaacatggtgaaaccccgtctctactaaaaatacaaaaaattagccgggcgtggtggcaggcgcccgtagtcccagttacttgggaggctgaggcaggagaaaggcgtgaacccgggaggcggagcttgcagtgagctgagaccatgccactgcactccagcctgggcgacagagcaagactccgtctcaaaaaaaaaaaaaaaaattaaatgaagttaaaaaaaaaaaaagtcccagccaggcatggtggtgtgcacctatagtcccagctacttgggaggctgagatgggaggatgacttgagctcaggagatggaggctggaatgagccaggattgtgccagtgcaccccaacttgcgcgaaagagcaagatcccaacccttaccccccaaaaaaggaaaaaaaattaaataaagtaaaaaaaaatccctccttcaaatcagccacatttcaagtgctcaaaagccacgtggctattagacatgtggctgccatattggacagggcagaaatctggtatcagggacagtgagctctgtagatccagcgactcacaagagtggaggcagagttgtgtcttctgggtggggatgagtgtgttaaaaccctggattggtggatgaagcaatcagaatttgggaggtcagatggagtgggcatggaggcctactggatggagaggtggacagagtggatgttcaggtgactcttgggattctgccagggatctctaggtggctggtgggacctcctcagagatggtgacatggggggggtggcttgtctgccagtggatggagattccagggggtggcttctgcagaaagaggctcatggagcccctcatcctctgccttgccctcctctcaccagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccgggtaagagggtggggcagtggccagctagagaggggaggcaagatgtcggccaccttcccggtaactcaccgtctctgtcttctctggggacagctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccatgagggagccccagaatggggtgcatttggtgctgaggctttgaagccaccgtatttttcgttacctgtgactatggagccaatgggatgtgacttcgctcatcacggacagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgccccccacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcctggccccccaccgccaggccatagggcataatttgcatctcaaatctgagaataaactgatgaactgtg

SEQ ID NO: 7109 - DNA, 495 bp, Homo sapiens
actgtaacctaaagcactgggattaagcagtgggagaaagccactgtgcccagccccatattgttttgttcttttgagacatagtctcactctgttgcccaggctggagtgcagtggcgtgatcttggttcactgcaacttccacctccccagttcaagcaattctcctgccttagcctcccgagtagctgagattacaggtgcctgtcaccacacctggctcattttgtattgtatttttagcagagacggggtttcaccatgttggccaggctggtctcaaactcatggcctcgagtgatccacccatctcggcctcccaaagtgctgagattacaggtttgagccaccgcgcctggccccatgttgttatttttaactggtttattttctcctggtttagtgggagctcagatgcccagtggatgggaatttagacaagcttggacttcccactgggcccggagtgcaagacttgatccctaaacaattact

SEQ ID NO: 7110 - DNA, 11311 bp, Homo sapiens
  misc_feature (7272)..(7272): n equals a,t,g, or c
  misc_feature (7274)..(7274): n equals a,t,g, or c
ggatgaacatgggtggcatccaacacatcaaggtaggagaataattcactcccatgtggaccgggctttccccctgtgttttctctctctgtcttctttcttaaaggattgaggaactattgttaatttcctttttgaaatcatttgaatatcaaaagtatggcagtttaaaagtgaaatagctcagtttatgttcattttgcattatctagatactgaatatcctgaagctattttaaaaataaatctgtataaattagattttatgatttttctaaccatgaagaaaatcatatgtacctaatggaagtatcccacagcaggtaaaatctgtttatgggaactaaatcgttgttcaagctcagtagctcagtatagcttaatttcttcccagtttaactcactgtcaagattaaagtgttacttagaatattacttcctatttcttatgtctaatataccttttctccctaattttttactggaaagcaaacttgtttgttttgctttgttttgtttttccaaaggaaaaacactacctttgggtgagtcttcccaaagattgaaaatgacctttggcggactattatctgtaactaatgcaatgaacgattcgccatcattcatttattcattcatccattcattttataagcatttatggcgaacatcctatgtgtcatatcccctgctaggcactgggaatacagtaatgaaccaagaagacaaaaattcctgttcttatggtgctagtaggaggagatatattaatacaaggaggaggaggaggagatatattaatacaaggaggaggaggagttgatatattaatacaaacatacatacatgaatgtttaatgcatgcatatgtgcatatgtatatgtataaaatatattagctggtgataagtgctaaggagaaaaaagagaaagaagattggaatgccaggcaataagggctaaagttttaaattcaggtggttaggaaaggcctcagttacaaagtagtatttgagaagagacctgaaggagtgagccatgtggcgaaatagggaaagagcacaagcacgtgcagaggccctaaggtttgagcacgcctgttgtttaaagtgaggaggcagcgtggcaaggagagagcaaagaaaaggaaatgggagaagctagggtcagagagggtgcagggtcagatcatgcagccttcaaggagtttgtagggacttgggcttttatgccaaatgagtcagggtttttggaggactttgagcagagaaatgccatgatccaacatgtttttaaagaaccacccttgcttagctaactgattttcagtctctgcactgataaaatagcagtgtagtgattaaaatttgaacaaagtcctaacgggttttactgttaagtggaaactgatcactcttggaaacacacacaaaaaagatgacctacgattacacaaatgggaggggttaatgggataattaccctgcagctgacagctttgatctggtaggtggtgaattcaagcacgatatttttcagagccaaattgcccaagctctgatcttaatgatattctagggtgtccagtagtatctagctgggaaacatagaatgaacttactttaaaagagtaaaacgataattttaaatatttttaatcatatgttaaatagttacattttcaaatacagtcatgtgccacatgacatcattttggtccaagatggatcatatatatgatgatgtctcatggtctcataagattataataccgtgtttttactacatcttttttgtgtttcagtatgtctagatacacaaataccactgcgttaccattgcctacagtattcagtacactaatatgctgtacaggtttgtggtctcgaatccataggctatatcatatagtctaggtgtgtagtagtaaactatttcatctaggtttatgtggctatatcctatgatgtttgccaaaaggaaaatcacctaatgacgcctttctcagaaggtatctttgtcattaagtgacaaacaactgcaatgtgctcaatatgttttcagatggagtatatctgcagctaaaataatgggtatagttgttaattagaaaaagtacaacaaatatactcaaaagtgtccaagaagtctggaaatagagaaaatagtatgtctactgcactctttaccaggtgaacccattgctttaaattaggaagtacttcccttgggaaagtgtctagagattaaagaaggatctattgactacattattttaaaatataattagtgctgagtaaaaattagtttatcctgttttttgtctttgtggacatcatgtactaggctgaccaatataaaattgccacctttgcagttttaaagtggtcaaatatcagttaatttatgtgattcaatctaatgtaaatatataaacaggcacatggctcagatgtggtcattttgatgccactattagaatgcagagttgtccttatgaagcctaaaagataattatgaactttctgtgtcttttccattgccaggtcatgtgtgcatcgggcattgttacccattcctaggcctcgctccttccccaaacctgggggaagcttaggcaggcctgagagctccagcaaggttgagagttagaatagtactttgcaaggaggttgcagaaagagatgggggagagaggagcaaatgtcatagttgtctcttgctcatgacacttggttataaaaagtaacgcttcttatgaagttttacatataagatgaagtgagtggaccaagaaattataatacattttttatcatcaaagagttgcatcaaccaggctatagcacaaagtctgattttcagtactgcctcatgacagtaaatatgcattttctagaatggtgctgtccagcagaacttttgtgacaatggaaatattcagtagctgccctgtccgaggcagtagccactagctacacatggctactgagcacttgaaatatggctggtgcaactgagaaactgaatttttaattaattgtaactaatttaaattggaaaagccacttgtgactagtggccatcaagtgaacacagttctggaaactggataattcagatttttttacctagcatctagggaattggagatactgacttaaaggatataattattttttaaaatagggcttctaggctgggcacggtggctcatacctgtaatcccagccctttgggattccgaggcaggcagatcacctgaggtcgggagtttgagaacagcctggccaacatggtgaaaccctttgtctactacaaaaatacaaaaattagccgggcatgttgtggtgcacgcctgtagtcccagctactcgggaggctgaggcacgagaactgtttgaacccgggaggcagaggttacagtgaactgacattgcaccactgcactccagcctgggctacagagaaaaaaaaaatacagcttctagtttagtgaagaaaagggcaatttgagggagagaaaaggaactgcgttctgtgtgaaaggacagagaagcctggtgatcagagaataagatcccaaggcacttcactggggctgacattcagggagcctcctggaagaatcatttcaaaagcaattgcagtcaaaacagattttgagagcactcttagacccagaaatgtatagttgtctgcatgtaagtgctaaggctaataaaaatcagaagacatttggaagacatatccttgaattgaaaaaaataataattgaatatagcaaatgcaagttcccacttgttcagcaatctgtttaacttcttatcagagtcattgttaatacttccttttgttgtacatgccagtgcctggatatctaacgtacaatttcttgtgctgtcatttccactttccttttcaccaatatgaccagtaaatacagtaagaaatagacactattgatacagagcctggatagtcattaataacagtaatgttagtatcgtattgagcactcactatgtgtctaagcttttgacaggtatttggaagataggtaagcactggataagtattagttgtttgttgctacatggtgtcttcactctaagagatacaatttttaattgtgatggaaatgtagagggtcactggtgtttatccacatgggagctataactaagaatagatggaacaaattcatactttttctaatgggggaactccaacaatcttagctctgagaatttgcagaatacagatctaaaagagggtggaacgaataagggaggtaatacatccagaagcagaaaaaatgctgaaaaaagctaatagctgtgactgagttgccagggaccccttctgggaccaggcacacatggttgctagttgaagaatcaaacaaaacagttggaagccaacagagggtggggacagttgtgtttagtaggtcaggagtcacataccatactgcactaaaagtatatagataatgcatactgctgcaaacctgcagtagtaaaaaatttgacttcacattcttatcaagtcttttcattgcaaaaaactttattaggcaaaagttacttttacgttaacagctaaagattagaattggctgctattctctatccataggaaagtgaaactataaaatatttaatctttgtgccccgggagagggggggggcgccacaaaatattttttaaaaacattttctcatctctcattctcccatcccctccaccccattcccctaacatgaattttgtgccatggttccattttacaaggaacagtactagccccctgaggacaccaggaaatgataacctcacaccctgcattagtagaattgaaaatctgtttttctgccatttatccttacagtataactctcctctttcacattctgcaactgatctagtgcttaaaacaaatggagtcttcaaaagcaccaatagacaaggataaaattacacatacagacagggtttccatatgagaacattaatgtaaaactgggcagagggtcagtttcttagtctcttcattctctgagagagttttgtgatggatcagaatgtaattgctccctctttcccacccccagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaatcagccatcaagggcaagaggtctgagagggaaggagaatgacatttacacattttacagatttttgtttggtttaactccagatttctcttgatatatctctgtgcttttgaaacctggagatctaattctgtttagacattttttgtcccacaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattaaagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcacattgaaaaaagtgaatgtctagagctgatataaaaaaaattctttaataaggngnctcgaaccttttcagaataatctgtaatgaaaactcatgcttaaaaatttaatggaaaagactgagccccaaattttgaatagtgattatgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatgtgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcaatctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatcttgcattgaggttgcagttgaataagataaaagcttaggatgtcaaaaaataatatagagaaatattataagattttatgattattcttgaagtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcttattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataagtatgtctggtttcaatctc

SEQ ID NO: 7111 - DNA, 19866 bp, Homo sapiens
ggaataaagaactgtccagacagctcagatttacacaacaactatggggttttcttagttgatactggtaagtgaaattaaagagaaactgtactgctgagattagctaatacaatttatcaagcaaaatggaaggcaaataatcctcagaagtaaaattcactgggcttggcaggaagctcacactattgacagtcattatacctcggggctgtcatttctctagatcttcaagctcgattcagtaaaatctggccattctcatactcatttctctatggaaaactccccaggggacaggaagtagccttatgatttaataagtcccaatcttctttgaatattatttatatatatttataaatccatgatgatgaaatgtttctctacaatgatgcaaaacctgcctctgaaagcagttactggcagatggtaaatacttttctataacatattttttaaaagcctccagaattgttccatcattccttccttgatgtacattagaaactgcattattaaaattgatacaatgctcttatatgacaggtgctatataaaatacacttactttatcttacttaatgcaaaacattactgggcatgaattctcttttctttatgacttatgtagtgcctctgtactgttggcatgcaatgtaagtaatgaaattatatttaaatgtaaggccaaagcaccactttgttcttgttgattactagactagctgccctgcagcaaaatttagtttaattagtttttcaatatgaaatgcttaaaggggttttattttcaaggatatttggagctctcttgttttacagaatataaaatttacattctgatacatctaagaaacttaccttatttttgcctgtgtaaaattgttgtgtagtgccacctgctggttcattggccacataataataaactgtcttaaaaatataaaaactagaagaaacctctagttgggcaggtctaaccctcctccttttacttcaacaacagtcccaccccaccacacccctaaaaatgataactctgtgaccaccctatgacattgagcctctgcctccagagacagaggctcctagggacctcctagtcaaacttgtattcaaacagatacgcttgaaaagatttctgtgtagataatagacattccattctatttagaatttcacagtgttctaaagtgtagttactgaatatagtttcaccaggaagctactttgaagaaacctatcagagtagagggccttcattctgcttctggccttactctcacttgccttgggatctttatcaagtctgttgaatatctttgcactttagtgtctatatctgtaaagtggaaaatttttgtgtgtggttttttaaatatctcttaaatcctgataaacagctaaacagtatcaaaaggcagctaaattgtataaaaaaatacctgcaaaaaccatacaaatgtaagtatttaaaaatatataatgcattggacaagtgcatggtggcattattatgttgtaagtcttattaattaagtgccattcaaatgaaagtgcatgattttaaaagagattttcactatagagctgatatgtgttatttaaagtaatgcttcaattgctatgttgaagtatagttcattgagacagacccttagaaattgcttctggacagttttatttctacagtagcctgttctattttttatataatgagagccagttatatcttggataaataacaatcactaataatctgaaggcatcctattagcaagagcgatgaccagaaaaatttcgactaaaataatatatataattaaaacaataggttttagtttttactgcttttttgttaatttttttggaagtatgaatgaacagtgaaattgttcaaagttaggcaatggccaggatgagaagctgaaatgcaagctaatttgcatattgaataattttggtataactctgtaataatgagaaagaattataagtcagaagagaaagtgaaatgttcatgtcttttataaaaaggcatgttctgctcttaccaacctgtcactggttacaggcttaccagaaaaggcagtggcccattaccagcaggccatcaaacttagccccagtcatcacgtggccatggtgaacttgggaagactctacaggtcactgggagagaacagcatggctgaagaatggtacaagcggtaaagttccctttcttttctttataagttgcccaggaacctcagcaatcactcatcagcttcttagttaatcagaataggtgtgctctcagaatactagcaaattttgccaattcaggtgatacaaatttttatctccaaagaaagcaaccacaatataaatgggatcataattcatgactttggcttgctggttagactatagtgctgaaccaaggttgaaatttaattcccactttagtcagtttgttgttttctgaagccatggattgcaaccccaatcataaacagcaatttaaaaaatgaggatacatgaaaaactatgcacacatgagaacaaattcatcataattaatgagaaagacccttggggctcagtttccatattgataggtcaataagacattcttacgttccaactatggcatcatgatcattttgtaaaaaccttgttcttggccaggtgcggtggctcatgcctgtaatcccagcactttgggaggccaagatggtcgaatcacctgaggtcagatgttcaagaccaacttggccaacatggtgaaacctcgtctctactaaaagtacaaaaattagccgggcatgatggcgggcacctgtaatccctgctactcaggaggctgaggcaggagaatcacttgaacctgggaggtggaggttgcatgagccaagattgtgccactgcactccagcctgggtgacagagtgagactctgtctcaaaaaaaaagaaaaagccaaaaaccttgttattgatataaaaacaaagaccgtattggagcagaggttcaaaccatggaccgtcttccctaaatctaagcctagacatttggaaatgtacctattagaagagaaatgtcatttagattttctccaaactcagcgccctgcaggtggcacacaaagctgagatattgtcacctttgggagcactgtattacaacactggccgatacgaagaggctttgcagatttaccaggaagctgcagcacttcagccttctcagagggagctccgcttggcactggtgagtaggatgaaagaaaatgaagctggcaacctaagcacaggcagccatagagagagctgtagtcctcacgcctcaaaactggagctggaatgccgtaatatatccactgtatgaatattcatacagctaatgttagagccattctctaaagacatggacaccaaaaatactgcatttttgttttgaaataacttcaaacttatgaaagtgttgcaagaatagtaaaaaatttacatataccctttcatccagctccaatgatttgtaacattttgattcatttatcactccattgtgtatgcatatgtagatgtatatgtacctacatgtatatgtgtgcatatttagatatgtatgtttgtatatacctattattagtgtgtgttatttttttcctgaaccatgtgggaattagttgtatatatcattcccctttatctctaaatacctttgcaaatagtttctaagaaggacattctctaacataaccacagtgtatttattagactcaggaaaattaacattcataccaacaaaatttttatttcagtgtttggaacttcactcatccttttccttagatgtgcaataaatcaaatttgttatcttgctgtaaacacactgttctgatgaaatcagaggaaattctttctcttctgacttatttggtcaaccttttttaaaagccacaagccatttcactggatatatttagtgtttctgccactcactcacaaatgcatgcacaaaactaaataaagaaacaaacagcaaaaagtcaaaacctgaaaactggtgattcagccttctctatgagtcactaaattgatgctgagcatgtttgtcaggagtgcgttctgaatgcttctattcagggatgctttatttgataaggtaatgaagtctctgctaagccaaggtccatgtggttttgtaggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggtaaagaaggacattgtttagagttctttggattcataggttaaacatggggtgcacctaagtgattctccagtttgcgtgtttataagcctgggaaatcttaaatcttatccgtcagcatatcctatctcttggaaacttttcacagatatccccttaacacctaagatgtccccttgtaataatatttttcttggcttatctttggtgtaaagcttttatgtggtattgtcttagtttgttttcagctaagtctataaagatcaagaccaacatttatatgctttattattttgtattttccttcttatatattgttttatgtaatcctcataacaaccatgctttacagggttgttatgaggattacataaaacaatatagaagaggaatatataggaagattacatgaaacaatatataagaaggaaacacagggtgacccaatgtcacaactgttattatctccattttaaaagtcacataatcagtaaatttataaactgactcaatgaagtaattgttgaaggcccactatgtcctggccactgtagtaggcatcagaaataaagtggtatgaaaaaaaaaaaaaaaaagtcactgcccttgtcttcatggagctaacccatagagaaggagattaaacaggtactcacaaaacaaatgtagagtgatagctgtgcccaggaatatcatgaagcgctacctctcccaaagagcatataatcaggggacccgatgagtctgggaggccaggtctccctgtaaagtgatgtggaggtgagggctggatgaagaataagagttgttaggcagaggaagaagcaaggaggattctgggcagggaaacgcacatgcaaagccctgtggcagcagtgaggggcctctctgaggaatgggagtgagggagcaggagcaccgtaggaacgcaagcacaggctgctgggaggagactccttggggccaggccaagggttttgttccttaccatgggagaagctttgggtttttgtggagaggaggaacatgatcagatatttgctttgaagggatctttggctgcagtggggtcagtgggtgctgggggcagaatggtcactaggacctgagaggggctggtggggtggtccagatgaacacatggtcagggaaaacgtctgatgccaaatcttgttttctttcaactgtatcacaccacctccctgtaaagtaatcaaggatattttattgccactcatcgatacgtgggaaaactggagtgtaagaaagttattttgtcagggccactaattcccagtgagaaaatcaaagataatgaagaatgtatatatatttgagacaaggtcttcctctgttgcccaggctggagtgcagtggcatgatctcacctcactacaaggtccacctcccagggctcaagagatcctcccatctcagcccccccagtagccgggattacaggtgtgcaccaccacacctggctaatttttgtatttttttgtagagacagggtttcaccatgttgcccagactgatctcgagctactgggcaatctgcccacttcaacctcccaaagtactaggattacagccattagccactacgcctgaccaagaattgtactttgattgtcacataccatacctgctgacacataggaacaaaaagtataaatttgatcagttaaataagtttttctttacctaatctgcatttattctgtcttaatttccaacctctgcaggcacttgatgctatagacaaggctctccagctgaaaccaaaggacccaaaagtcatttctgaactttttttcacaaaaggaaaccaattaagagagcagaaccttctcgacaaagcttttgaggtataaactcatcataaaattatatcatcaaattcacagattaaaattaattgtcttttgatctttaaggaaacatgtacagtaagatctaagatcactggcatgtatgtttatggagtgagtgagttttttttaactaattgacgaagttttgtttattttttatcattgagcatctggcccttgactgaatcagagttgcgcatttatttttctgaataatcatgtttaatttgatgttgacagcattccacattttggcctcaaactagcttctctctgtctgtgtctctgcctgcaagaccttctattccagctggactagtacctgaaaagccttggacattcccacatgtccttgaaatgccctctcttgacttggaggatgagatttccactcatccaccaagatacagtctttgtcctcctgccttaggaagccctccctaaccgtccttattccctgtgaccttacttcttctgaactcttaaaaagcatggactgtctcatgaaggtaccagtcgtttgaaagtgtcacatattacattgtattattaggtccgtcccctaacccccgtatgtgtgtgtgtgtgtctctgtgtgtgcaggcacgcacaaatccttgcatagtttatctccccagttagattggactttccttgtagagagggactgcatccttctctgttctaaaacaatgttttgcatcttacaaggtgttcagtatctatggttttggaataaaacttattcacaggttgaactcaagaagacataagtagaaatagaaatgttacaatgttacatactttctccttatatctggtaaagccacaaattattgaagtcataaaattatactaaatatattataggaaaagtaaaatctcaaatgatacaattgtgttgggaaataagtgagtggatttttaaatattattggaaaacacatggaaagatatttgggaaagctcatttgaatgtgaatcctttaatcaaaaacagaaattgtggcatttttctcagaatttgtaggattttctctgccttttcaacattttcaatatcgtcattcttaagttatttataacgaatgtgaacattattaataacttaattgtgaatatgtatgtgtgtgtgtgtatatatatatatatatggccattgattcataataacagctgaaatgtattatcactctgtgcatgattcatatgtattatgtaacttaatcttcacaagaatcctataagaaaggcatggtcattatcatcattttatagttttgtaaactcaggcttaaaggtcatatcttgctcaaagtcacagaagtgggtaagagacggtgtcagggtttgaatccaggtctcctacactacattcccatcttcactgatataaattaatccaagagacacacccttttggtttattttagcagctttttgaaggtatagtttcataacatttctttctttcccctaaaactgaagtagaggagaatggaccagattttatttgatggacctgtttggtcatattcttgctaatgaaaatagcaaggaacattaaaatatgtgcacaaatacttagctttgtaattaaaggcaatacccttaacctgtggctttatttcaggtgaccacttgagactcagtggtgagcacacctttgatacaaaacatgcataatgttaaaaatataccacacatcactgatactacatttaataggatacatgttattcagaccaaagaaagtgcttgagggataagtaactctctttaaacatttgaagacttttcatgtggcaggggaaaaaagactgtctaatgaataaaactatcccctagtaaagtagatgttcttaaagaggcggtgatccactttaagaatttcagcataggctgaacgactaggtcagttatattgtaaaaggggatactgcattagggttaaactgttcagaagactactccaaaattctgttattataaaaagaattttcttaccaattccatttgcagtgaaaaaaggccagaaagtacaattttcttgcaggtcaaggccagttaaaaatgatgtgatataatagaaatcacctgaattccctgcaggcatcctcagtctctctaagtccaaaggtcagctctgcagggaaattatacatttcagtttcctccactttagaatcatcaactttgaaaaataatagaaataagcagggtctcctgtgaactagtagcggctggtttcattgtattactactttaaattttcacacgtgaagaaagtggtttctgcaatcctggagtttggaggtttgtttcctaacctgaggatatttcttatttatttagagctatagagtggctgtgcaactaaacccagaccaagcacaggcctggatgaacatgggtggcatccaacacatcaaggtaggagaataattcactcccatgtggaccgggctttccccctgtgttttctctctctgtcttctttcttaaaggattgaggaactattgttaatttcctttttgaaatcatttgaatatcaaaagtatggcagtttaaaagtgaaatagctcagtttatgttcattttgcattatctagatactgaatatcctgaagctattttaaaaataaatctgtataaattagattttatgatttttctaaccatgaagaaaatcatatgtacctaatggaagtatcccacagcaggtaaaatctgtttatgggaactaaatcgttgttcaagctcagtagctcagtatagcttaatttcttcccagtttaactcactgtcaagattaaagtgttacttagaatattacttcctatttcttatgtctaatataccttttctccctaattttttactggaaagcaaacttgtttgttttgctttgttttgtttttccaaaggaaaaacactacctttgggtgagtcttcccaaagattgaaaatgacctttgggggactattatctgtaactaatgcaatgaacgattcgccatcattcatttattcattcatccattcattttataagcatttatggcgaacatcctatgtgtcatatcccctgctaggcactgggaatacagtaatgaaccaagaagacaaaaattcctgttcttatggtgctagtaggaggagatatattaatacaaggaggaggaggaggagatatattaatacaaggaggaggaggagttgatatattaatacaaacatacatacatgaatgtttaatgcatgcatatgtgcatatgtatatgtataaaatatattagctggtgataagtgctaaggagaaaaaagagaaagaagattggaatgccaggcaataagggctaaagttttaaattcaggtggttaggaaaggcctcagttacaaagtagtatttgagaagagacctgaaggagtgagccatgtggcgaaatagggaaagagcacaagcacgtgcagaggccctaaggtttgagcacgcctgttgtttaaagtgaggaggcagcgtggcaaggagagagcaaagaaaaggaaatgggagaagctagggtcagagagggtgcagggtcagatcatgcagccttcaaggagtttgtagggacttgggcttttatgccaaatgagtcagggtttttggaggactttgagcagagaaatgccatgatccaacatgtttttaaagaaccacccttgcttagctaactgattttcagtctctgcactgataaaatagcagtgtagtgattaaaatttgaacaaagtcctaacgggttttactgttaagtggaaactgatcactcttggaaacacacacaaaaaagatgacctacgattacacaaatgggaggggttaatgggataattaccctgcagctgacagctttgatctggtaggtggtgaattcaagcacgatatttttcagagccaaattgcccaagctctgatcttaatgatattctagggtgtccagtagtatctagctgggaaacatagaatgaacttactttaaaagagtaaaacgataattttaaatatttttaatcatatgttaaatagttacattttcaaatacagtcatgtgccacatgacatcattttggtccaagatggatcatatatatgatgatgtctcatggtctcataagattataataccgtgtttttactacatcttttttgtgtttcagtatgtctagatacacaaataccactgcgttaccattgcctacagtattcagtacactaatatgctgtacaggtttgtggtctcgaatccataggctatatcatatagtctaggtgtgtagtagtaaactatttcatctaggtttatgtggctatatcctatgatgtttgccaaaaggaaaatcacctaatgacgcctttctcagaaggtatctttgtcattaagtgacaaacaactgcaatgtgctcaatatgttttcagatggagtatatctgcagctaaaataatgggtatagttgttaattagaaaaagtacaacaaatatactcaaaagtgtccaagaagtctggaaatagagaaaatagtatgtctactgcactctttaccaggtgaacccattgctttaaattaggaagtacttcccttgggaaagtgtctagagattaaagaaggatctattgactacattattttaaaatataattagtgctgagtaaaaattagtttatcctgttttttgtctttgtggacatcatgtactaggctgaccaatataaaattgccacctttgcagttttaaagtggtcaaatatcagttaatttatgtgattcaatctaatgtaaatatataaacaggcacatggctcagatgtggtcattttgatgccactattagaatgcagagttgtccttatgaagcctaaaagataattatgaactttctgtgtcttttccattgccaggtcatgtgtgcatcgggcattgttacccattcctaggcctcgctccttccccaaacctgggggaagcttaggcaggcctgagagctccagcaaggttgagagttagaatagtactttgcaaggaggttgcagaaagagatgggggagagaggagcaaatgtcatagttgtctcttgctcatgacacttggttataaaaagtaacgcttcttatgaagttttacatataagatgaagtgagtggaccaagaaattataatacattttttatcatcaaagagttgcatcaaccaggctatagcacaaagtctgattttcagtactgcctcatgacagtaaatatgcattttctagaatggtgctgtccagcagaacttttgtgacaatggaaatattcagtagctgccctgtccgaggcagtagccactagctacacatggctactgagcacttgaaatatggctggtgcaactgagaaactgaatttttaattaattgtaactaatttaaattggaaaagccacttgtgactagtggccatcaagtgaacacagttctggaaactggataattcagatttttttacctagcatctagggaattggagatactgacttaaaggatataattattttttaaaatagggcttctaggctgggcacggtggctcatacctgtaatcccagccctttgggattccgaggcaggcagatcacctgaggtcgggggtttgagaacagcctggccaacatggtgaaaccctttgtctactacaaaaatacaaaaattagccgggcatgttgtggtgcacgcctgtagtcccagctactcgggaggctgaggcacgagaactgtttgaacccgggaggcagaggttacagtgaactgacattgcaccactgcactccagcctgggctacagagaaaaaaaaaatacagcttctagtttagtgaagaaaagggcaatttgagggagagaaaaggaactgcgttctgtgtgaaaggacagagaagcctggtgatcagagaataagatcccaaggcacttcactggggctgacattcagggagcctcctggaagaatcatttcaaaagcaattgcagtcaaaacagattttgagagcactcttagacccagaaatgtatagttgtctgcatgtaagtgctaaggctaataaaaatcagaagacatttggaagacatatccttgaattgaaaaaaataataattgaatatagcaaatgcaagttcccacttgttcagcaatctgtttaacttcttatcagagtcattgttaatacttccttttgttgtacatgccagtgcctggatatctaacgtacaatttcttgtgctgtcatttccactttccttttcaccaatatgaccagtaaatacagtaagaaatagacactattgatacagagcctggatagtcattaataacagtaatgttagtatcgtattgagcactcactatgtgtctaagcttttgacaggtatttggaagataggtaagcactggataagtattagttgtttgttgctacatggtgtcttcactctaagagatacaatttttaattgtgatggaaatgtagagggtcactggtgtttatccacatgggagctataactaagaatagatggaacaaattcatactttttctaatgggggaactccaacaatcttagctctgagaatttgcagaatacagatctaaaagagggtggaacgaataagggaggtaatacatccagaagcagaaaaaatgctgaaaaaagctaatagctgtgactgagttgccagggaccccttctgggaccaggcacacatggttgctagttgaagaatcaaacaaaacagttggaagccaacagagggtggggacagttgtgtttagtaggtcaggagtcacataccatactgcactaaaagtatatagctaatgcatactgctgcaaacctgcagtagtaaaaaatttgacttcacattcttatcaagtcttttcattgcaaaaaactttattaggcaaaagttacttttacgttttaagctgaagactagaataactgctatcactaaacagagagagtggatacataaactatttaatcattcttcttgcagttttaaaaacattttctcatctctcattctcccatcccctccaccccattcccctaacatgaattttgtgccatggttccattttacaaggaacagtactagccccctgaggacaccaggaaatggtaacctcacaccctgcattagtagaattgaaaatctgtttttctgccatttatccttacagtataactctcctctttcacattctgcaactgatctagtgcttaaaacaaatggagtcttcaaaagcaccaatagacaaggataaaattacacatacagacagagtttccatatgagaacattaatgtaaaactgggcagagggtcagtttcttagtctcttcattctctgagagagttttgtgatggatcagaatgtaattgctccctctttcccacccccagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatatgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcaatctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcctattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataagtatgtctggtttcaatctc

SEQ ID NO: 7112 - DNA, 364 bp, Homo sapiens
aaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgc

SEQ ID NO: 7113 - DNA, 247 bp, Homo sapiens
gaatggcagaaattcgacgacacagcgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcaca

SEQ ID NO: 7114 - DNA, 686 bp, Homo sapiens
  misc_feature (95)..(95): n equals a,t,g, or c
caccaaggccagtttggaagcgaacggctaccccgaaattaagatactacagcgtgagttatgagaaagcgccacgcttcccgagggaagaaagncgggacagttatccggtagccggcagggtcgaaccagaagagcgcacgaggagcttccaaggggaaaacgcctggtatctttatagtcctgtcgggtttcgccacctctgacttgagcgtcgatttttgtgatgctcgtcaggggggcggagcctatggaaaaacgccagcaacgcggcctttttacggttcttggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgaattcgagctcggtacc

SEQ ID NO: 7115 - DNA, 364 bp, Homo sapiens; identical to SEQ ID NO: 7112

SEQ ID NO: 7116 - DNA, 288 bp, Homo sapiens
attaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactctt

SEQ ID NO: 7117 - DNA, 288 bp, Homo sapiens; identical to SEQ ID NO: 7116

SEQ ID NO: 7118 - DNA, 7173 bp, Homo sapiens
aatgtgtttgtatgttttttttttaggagatcatgaatcagacagataaaaatcaacaagaaatcccatcataccttaatgatgaaccaccagaaggtaagtatgcatctgtaacactaagaatggaaaaatatactgaattaaagttctgatagtttttattttttacttattttattttatttttttttgagacagagtcttactctgtcaacccaggctggagtgcaatggcacgatcttggcccactgcaacctccgcttcctgggttcaagcagttctcctgcctcagcctcccaagtagctgggattacaggtacctgccaccacacctggctaattttttgtatttttagtagagacaggggtttcatcatgctggccagggtggtcttgaactcctgaccttagttgatccacctgcctcggcctcccaaagtgctgggattataggcgtgagccaccactcccagccctgattgtttttattaaagaaatataacctgtttaccttgtcagtaaatatgtccccaaaataattgaagataacatttttagcttctaataagaaagcatagatagtggtgaatagggacacaattttaccatataaggcataatattttgctgtcattcttcttttaagaccattttagaagtataagtatcctttcatttgtaaagggtgaggatggatacagaggaaggatggactgtgtttagttttgatatcctgcatacaaaatcagcctaatgcaagaggcattagagatctgttgttaaactcctattattcattatattgtaattggtacctctcctctattaacacatgatcttgggatctgcttcatttgtctttttaagtcataattctctttgagtttgaaaattgtgttatcatgaatcattttaattcttcagaaacccttggaaacacacctgaatgtcctgagtacatacagaaaatgactagaggcatgtttttggtatagactgttactaaacttaatccaaatagtgatctccttggagaattgcatgttgattactagggctggaggttgtgactctaggtattatatattttttcctagttctgttacccattgtctaaaattttcttcctatatttcttttattggtaggcaaaaatgaaattgctaggaaaatagcaacaaagggtttacacttaagccataaagaattcaaaagaactatcggagattgcagtgagctaagatcgtgccactgaacttcagcctgggcgacagagtgagactccgtctcaaaaaaaaaaaaaagaactagctgattaggtttagtttagtttggtggaggaatagcctggaaaattactaactcaggtcttttccatgccttacatttttaggtctggaaccatggagttttgaaaagttagggctcagtgagaaagttaacaaggactttgtgagaaagaaatcagaaaagggataaataaaggccatccaggggcatgattgtcaaggaagagaacaaagcagaatgtctttctatgccaaccactaaacaagaggaatctgcaaagcagataatttatatggtgataattaagagtatactgtaataaaagagatcagctgcattaattatttatctgacttgattaagaacaattatttgtcttctttaaatgcatgtgtaccaaatttggcatggcaagatagttttactaatgagatatttggcatgaggcagttatctgttgtagcctcaaatcaggattttgccttttttcttagggctagtgacctcgattacagaattaccaattatgtaatcctttccatcataattttataactaatatattcaaatgcccatctatatattaagtcttttacttcagtcattaaaaatttgtattaactatacttattaagtagttttaataaaaatatttggtttttaaagtttatagctattgctgtatctgtatttatgcactattttgcaaagatattttgactagtcagtgagattttcccacttgtgataaaatgtaaaatcttcagacaatgaaaagaaaaattatctcaaggtaaatttgtgccttgtgcattggaaagctcagttttcagaattttttattttctccatcaaatattgtcagtttccccatgataccttctctgagaacttgattctgctagaatctaatagttttggtgctcttagttggacttacgtacccagtaatttacccctctttttcagaagtaaagcttgaattgtgtaagtaccaaatatttttccatgaagtttagaaaaacactaatgcttatgtgttgttgctgcttaaattattaggttactaggccgggcgcagtggctcacgcctgtaatcccagcactttgggaggccgaggtgggttgatcacgaggtcaggagattgagaccatcctgactaacacggtgaaaccctgtctctactaaaaatacaaaaaattagccgggtgtggtggtgggcacctgtaatcccagctactcaggaggctgaggcaggaaaatggcgtgaacccaggaggcggagcttgcagtgagccaagatcacgccactgcactccagcctgggtgacagagcaagactctgtctcaaaaaaaaaaaaaaaaatattagattactaaagagaaaagacctgtgttcactgtgttcattttaagctagtgcaaatttttatgaaatctttctgctagtcattttattcctaagtttgagcttacatgctaatatatgtggctctatttaaaaaaaaaaaacaaagaaaataaactcatgacttagagcttaatttttcatattgctattgccttttatgggggatatctctagtttttaaaaactagatacttaaagcacacactctctttcataagaattactgaggcagtaattttaagtgttaaccatatctatagtttctctatcctacttatgtctgaataaaaatgattttttaggtagataacacgattttaaatgatgaatagttttttacttttacatagtattagctctttaaatacgtcagtaagggagacatagagcagagacccaaatgtatttacttaataggggttcttaaactttttggtttcaggatgcctttacaatgtcaaaaattgaggccccaaagagctgtgtctttgtcaatatttaccatattagcaataaaaactgagaaatttgaatattttatgcattaaaagaacccatattaacataattaaaatatttttatgaatagtaattctttcaaaacaaaaaaaattgtggaaattgtgagcaaggtgatactggtttatacattttagcaaatctctttaatgtttggattaatgcaagacagctacattcttgcagctgcttctgcattcagtctgttgtattatacatcattctgcttctggaaaactgctatagactcatgacagaaagtgaaaagacaaatgatattttaataatattatgaaaatagtttttaccttgtagaccccctgaaatggtcttcggcatctgtagtggtcccagaccataccttgaaaactactgcattttacgaagaagattgtttcggtaatgactgattaaatcctatcaaggaaatgaaggccaaatgtagttatctttttattttttcatgttccttttaggatgtaaaataaaggttatttgttaacaaaaccgtaaaccaaggaaacatttaaaataggattctgttttacaaaagttgtctagtctctaaagcatttcttctcatagatactaagacttagcattggaccaagatattgtaaaaacatgtacaactataccctgaaggaagagctcttcagtgtctttgaatcagtgtggttggccttatcaaatcaacctcctgttgtgaggaagtcttaggttacttaatgatgtgtactgctcttttaaagacttgtgacttatatttgattgtctcatgatattttctctcattaggttcaatgaaagatcacccacagcagcagccaggcatgttgtcccgtgtgactgggggtatcttcagtgttacaaagggagctgttggtgccaccattggtggtgtggcttggattggtggaaagagtctggaagtgaccaaaacagctgttacaactgtgccttccatgggaatagggctggtgaaagggggtgtctctgctgtggctggaggtgttacagctgttgggtctgctgttgtaaacaaagtgcccttaacaggaaagaagaaagacaaatctgactgaaatatagagatacacttgcgctccacagcactgtaatgccagtggcattgaattgctaaattatggactacaaccaagtcaactgttttggacgtttatcttctaaactgctgtgttgaaagtattgatgactggctttcatctaaaaagaagagaccaatacgagcacagtatatgaaggtttctcatacttaagttccaggtttttatctggtaaaatgttacacttactcggttgtaactgaagatatggtatgtttgaatatttactataagtctttcagtttgactaaaaatgtgaaagttgaatttagtagatgatcttcacagttccatatgtataatgtgccaggtaactcacctgccccttaagaagggaaccttgaattacataagccgtacctttgatgtgcctaatagtttcagatgtcttagttttttataaccatagttgattaggccaagaggcattcatttcttatttaagctggcaaaattagcaggaattagagaagtttaaaaagataaatggttttatgataatgttaaccatcttttgttagtaaatatgcgttctattattttaatcattgatgccttacaaaagaaaacatcttttctaataccctgaatatgtgctgttcttagaatcatctatggattcttttaaaggttgtttgtgaaattagttttccctttttagaatctcaggagtagtggggtaaagacatttcctgctgtcagtggataagacagagcttgttaactgttttggcagtagttaaaatcaaattgtacacttctcagcctgggttcatgcttcatcattaatacacctcacagtgcctaaggaacatttacttactggtcagaaggtattttggaagagtttcatattaaggaggaacaaataataattttaagttcttaaaaattacctaaaacaccccaaatataaaaagaagccttcacacctattctgtctttaggatgtcttaaattattagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcctttaaagcagccatagagtttgtatcatttttcaagccaatttcagtcagggatttgaattgtttgattatggatgataaatgtgtcatatcttattaatatgtctcatgtctcgttccttcttaatatgatttagctggaattcattttcttttcgtttcatgtttaatttcataaaacgtttaacaattggcatatatacttggcattcctgtccaccaaggattgtaatccaagcctgggaaaatcttaaatttctttttacttaaatctggaaatttgtctccattctgccacctttttttttttttttttttatagtggaggggaggaaaggggggtgataccttgcagtaagtaagtcgaaatagcatgcctgaaaatttgaaacagaccattctaacacccaaggcttgtttataaaatacttgagaattacattaatgtggaatcaacagatgcagaagaatataacataacttttaaaagctttcataaataccagcagcaattgtaagcaaatctacaaaggttcttgaacctttctattatatacaaaactgaaaagtcattaaggagttcaactaatcaggaattaaatggtcatttatttcatgcagtatgatttaaggtatttcttgagattctggtcaaatgtcataatcagcaaacgggattaaaaaaaaaactccaaaatcactaaataattatctaaataatggtattggagaacttgtttcctgctatttggaagagattgttgcttcattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgaggataaacttatgtgacccacttgaatggctgatctaataatgttgacattatgcattctgtacttagtgaaatgtcagatgaaaataactgatgaataatttttttgtattaaagggatgggaaaagaacacatgaatttgttaataaagcactatgatctgcaaacgatggaatgtttcataaagatctaaagaaataaaggaaactttaaaacagggtgatcttaccatttttagttactttgcagttcagaaagtgctgtagccagtttaaaattttttttatagtaatgtacaaacatatctttggatatgtattttgatgctgacacaaccatgaaatacaaatatattttaagcaactctaataataaagattaagagtgtagatttctaggttttaccccaacttgccaaatctctgcaaggtggggcccag

SEQ ID NO: 7119 - DNA, 39339 bp, Homo sapiens
ggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacaggtaaagaaaccacttagtggactggtggaggagggaggggagaatcagtagaaaaatagtacttctaatgggtattatatatagttatgaaatatggaggttgcattagaacagatcagattcctatagtctcacctcctccatggaagttaaaataaatgtaccattttctttctttcttttttttttttttttttgagtctcgctctgttgtccaggctggagtgcagtggtgccatctcggctcactgcaatctccgcctcccgggttcaagcgattctcctgcctcagcctcctgagtagctgggattacaggcatgcgccaccatgcccagctaatttttgtatttttaatagagacggggtttcgccatgttggccaggctgatcttgaactcctgacctcaggtgattcgcccgcctcagcctcccaaagtgctgggattacaggcgtgagccaccacacccagtcaaaacgtaccattttcttgaatccagtttctcaaacgtagtgatcttttgtgaggcactcaaccttgctgacgactgaggtggtgatgaggatgtatgagatcctctccttccctcacaacctggctgtgcagtgacagactgaagccccgaactgtaacgaaagactgaaggtgacggtgtaacagcagagagatgcatgatcctagaagatgggcatgcaccagccagcccgagccagggctaccaaaacgttttcctagagaatcagagctaggccttaaagtgtgaatggaattgtggaaagttggcacaaaagtaagaaatagtgtgagtggaagagagaagagagggttttgtttttattgagaatcattccacatagcttgatgagagatatggttggagatgctgttggcaaaaatactaggattagtaaaggaatttggactataatattcacaggaagctattgaagcatttcaagcaggggattgtcattatctgagctgctttaaagtggactgaaagggacattgggaagaggcagaaaacagttgagaggtgtttcagcatccagggcagaagggatttgggctggaaccaggggagtagcagaggtagtagtaaagagaaaagtgaagagcaactgtttgttttccatttcaacttggcaattgattgattcagagaggtctttttataaacaggcagtggtgggctaactatcttttcattgtttgtttcttattctagctacccgaccactgggaaaaagctgtcatcacagtgcagcgacctggaaggattccaaccagcagccgatgtggtaataccatccccgatgatgacaaccaggtggtgtcattatcaccaggctcaaggtcagtgtgacggtggtttggcagctcaacgggcttcatatgcaaattagtatttttctaatattttgcgagttttcaagtcaccatttcagagccagacgttgactgctgacttttttcctttggaattatcgatgcagagctttgtttttaatttttattttttggatgcatgaaggttgactttcgttgttgtctttcttttttgtttgggggcagatatgtcgtccttcctcggccggtgtgctttgagaagggaacaaactacacggtgaggttggagctgcctcagtacacctcctctgatagcgacgtggagagcccctacacgctgatcgattctgtaagtgcgagattgcttctggcatatgcaggaaagcctgggcggaaagtgcccagctgctctcagggtgttttgttgaggggtaatgctgaggccagcgtaagcagaatcattctttcttgcctccacggttactttgcttatactccaccccatggaaaggatttattccttctaaaaatataaaatgtcttttaaaaaaaacagcatttcactaggcgtagtgactcacacctgtaatcccaacactttgggatgctgaggcaggaggatcatttgaggccaggagttcaagaccagcctgggcgacaaagcaagaccccatctctaaaataaaaataaatagcatttaaaagccatcaagctgtgtaaaacatatctaaaatttcctgccaagagtatttaggaatagggaggtttatactttatttaatgagtctaatgatttctgttcaagggtcaaagaagcatttgggttttctacacgtttgcttgcttaaacccatgccatggggcaccactgtaaggatgtttggccgttctcatttcttcacagcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctgggtaggtattgctgggcagctgcagcagctgctgtttctggctctgagtatatctggcacatgaagtacagtggagtgcccaccccctagccctgtgttaggcagcacaagggaaatagtgtctcagttacagtttgtctttatctttttaagtaatatttcagtgaaagagcaccactgaagatggaattgatattcaagaaatatgcaaataacaggtgaccaggggaaaagtccatgaggataaagcatttccataagcagggtagggagaggggaatggaatcagagaagcatcaaatacctgaaatgtatgtttttctctttgaaacgtcagaccatcctctgaaggtcactgggctttggtctaatgtcctgtgatatttgagctttgaaggcaaggggagaaaacattaatgacctcctgcctagaaaaactgttttgatctgccaactctgcctcccctttcttcccttccgctcatcatagggatgatactgttttaaaccagaactctgaataatccaaagtagttaaaggagaaaggatcagggagagcccgatgatgtgctgctccgtgtcatgggttctggcctctctttacccacagcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaagcattgttatgcattcattcagattaactcagccattgtggcagggttccattgctgcagagccgatgcttccctcctgaagttgatcacaccaacccatgagcattctgaattggggacagggtgcttataaaaggagcatgtttccattgaatgagtttctcaaggcagttccttgtttgcctgtttctttagcttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtatgcagatgctgaaagtaaggagaatgtagtgatctctggctgagcagacagcatcttagaccaaccacagaattcatctccaccaggcttcagctcgctcattcatttctgaccacctcactattttctaggatcttgtttgtttatccagtacatattgagttgacatcctctatgtgccaggcaccgttctggtgctggagataccgcagagaacaaaactgacatgaatccgtcctcttggcgagtcaccctagagcttaccatagggctgtatagaaattctgtctgtctcagcagattctggcggaggataagagttgtgaaatgctcctgcctaatttaggcgaaaggagaaactaatccaaatgggattagtcattttaaatagctttgtttttcagaacgttttatgcaactacagtttccaggagactctataaaacatgcctaagtagatctgttctccagttagcaaatgtcagttgaataatcattatggatgtgctagatgtagagtaagaataggagagagaatatacctccataacattaataggatagctcaatagataaaaaatactccgtatgaaaaagttacctgctgacttacactgtttattactaattaagaaatgcagacagtactgttagaactggctttttgggcgtaatagtctccaccttttcactgtgataatttttctctcttccaacatccattcgccctatcgaagatatttgtttttaaaagtcacttgtgaaacattgcagcaagtgcttcagtcagtggtgaagttactcatcaggtgaaagagaaattgttagtgaaaaactgagtatgtgattaacttttggcatgaagatgttcatggaggcaaacacgtggctctcggctcaatgctagaacggtactcaagaatttggaggtcccacggactaccctttgaataaaaattatcccttccaaccttaaaattgtgttgtagaaagatagcaaggacacagttatacaacagtgaaaggaggaaattaatattttggggtcatctttttcttttcagccgttttccattattgttttttcaaagagagatggagaataagtacgagagaaagatatgagaaaacagagaaagacatgagaaaaagattaacagggagcagagagaggagggggaacagaagcaaacagcaaagggagctgccacaatgctgattcagaatcagcactcacactgtagaatgcatttgaacgaacatcatgtcagaatggcatagttgatatctgtgaccagctttggattttatttgtaaagggttttgagaatgagaaagggtatgggagaaggaagatttttaacaataggtttgggtggcaaacacttgattttaagtatttggaattctactatctagtttgagccagtttctcatcattcttttttctcattccaagataaccagagtttcaatcctgtgaatttacaaaaaaactctacacttagattgtccccaaggggaggcaagaaatgaacactcagtttctatcatgatgtatttggattgcctccaaaagacttgagaaacaaattgaattggaaatccttggacctcagttcctggcccaattctgcttctaacttgctttctaaccttgggtgagttaggatatccagcttctagaaaatttttttgagacggagttttgctcttgttgcccaggctgaagtacagtggtgcaatctcagctcactgcaacctctgactcgcaggttcaagcaattctcctgcctcagcctcccaagtagctgggattacaggctttttgttgttgttgttgtttgtttgttttgagatggagtctcattctgttgctcaggctggagtgcaatggtgcgatcttggctcactgcaacctctgcctcctgggttcaggtgattctcctgtctcagcctcccaagtagctgggattacaggcacaggccaccatgcctggctaatcttttgtatttttaagggagatggggtttcaccatgttggccaggctggtctcaaactcccaacctcaggtgatccacccgctgcagcctcccaaaatgctgggattacaggggtgagccaccgcacctggccggaatatccagcttttcataagtagaataactaggttggatgagattgtctccaaagttccttcaagatgttatgttgtaggacataaaaaagtaacataattaccattcaccttgacaagcaggctaacatagtaaaagaatgtattgctttaaggaccccaaattcaaattctggctcattatttaactagttgtataaactttgagaatcctttgacctccctgtatttgttatctttaaagagtgggattgacatgttggatatgggaattaataagtaacatgacccatccctgcctgagtttggaaccacctgagagacaaacacaggggctacacagctggagagcacccctgtcaccccctcagctccagtactgggaaaagctgggttatagcacatggctttagacctgtggccaccgtgggcttgccaacacatcacccctctcaggcataggcagaggctgacaggtataagccccgcctaggaggacagactctgtaatacaaggagggagcagaactgaatggtcaggacaggcaggcagctgatagaacaatcaagtgcacatggggagaggtggctcttcctctggggagcagtgagtgaggggccagatgaagccatgggtgtcactcgaacgcagtggtcctgcaagtaggatccctagatcagcagcatcaatattatcggggacctactgaatcagaaactcggtgggaggagcccagtcatctgtttcaggtgattgtgattgaagctaaagtttgagaaccactgttcccatagtaaatcttccacatgaaaacataaagagaggtgggcagatcacctgaggtcaggagtttgagaccagcttgaccaacatggtgaaaccccatctctactaaaaatataaaaattaggctgggtatggtggctcacacctgtaatcccagcactttgggaggctgaggtgggtggatcacctgagatcaggagttcaagaccagcctggccaacatggtgaaaccctgtctctactaaaaatacaaaaattagccgggcatggtggtgcatgcctataatcccagctacctgggaggctgaggcaggagaattgtttgaaccaggaggtggaggttgcagcgtgctgagatcgtgccactgcactccagcctgcgcaacagagcgcgactccatctcaaaaacaaacaaaaaaacagccaggtgtggtggtgtgtgcctgtagtcccagctacttgggaggctgaggcaggagaatcacttgaacccaaaaaacagaggttacagtgagctgagatagtgccactgcactccagcctgggtgacagagcaagattctgtctcaaagaaaacatgaggagtggagaagagtgtgcccaaacagaacagttttcaagactttccttggaacaggtttcttagaactgtggggtcatggcctgttctcttctgtgactgatgcaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggtaagtcgtgtgcatactttgggaggcaaagagagagaaaaagatgtctttatgagttcattgttaatgagaaaaaaagatgcaaagtgaaccaattaagtctacttttataatttttaattaaaaattagaaaagatgctcttttcctatttggcacatggagtggagtcaattcatattgagtctctgataagaacgttataacacaaagcaggaaagtaagctcgtggaaatctagaaaccctgtggaacacttttctgttattaaacattagaaagattaacttaagttttactcctgcctttctttatccaactcctagcaaaagtatctcaaagctgtgaggttaccaaatagtagtcagaagaaagaaataatatcatccagggaatcacaagatggccgaatatattcttcactgttaatgatactcacattatctatcaagattcaattaatctagctgggttgttaaaaactccctcttatttcatccttgaagccactgttacaaatactgattatgtttatatgtaactcagtaaaatttttttgcatataatttcagaatttcttagggaaattggtcatcattaaagatcccatttttcaggttgctcacagaggagtggtaacttttcagtttctgtaattctttgttttgttttgtttttgagacggggtctcactctgtcacccaggctggagtgcagtggcacaatctgggctcactgcaagctccgcctcccaggttcacgccattctccagcctcagcctcccgagtagctggggctacaggcacctgccaccatgccccaccaccacgcctggctaattttgtttttgtatttttggtagagatggggtttcaccatgttagccaggatggtctcgatctcctgacttcgtgatccacccacctcggcctcccaaagtgctgggattacaggcgtgagccactgcgcccagcccactttctgtaattcttgaattaggctgggtgtggtggctcatgcttgtagttccagcactttgggaggctgaggcaggaggattgcttgagcccaggagtaagagaccagcgtgggcaagatggcgagacaccatctctccaaaaaaaaaaaaaaaaaaattttacaaaattagtcaggtgtagtgccgcaaacctgtagtcccagctgctgggaaagctgaagtgggagaattccttgagcccggaaattcagggctgcagtgagctattatcatgtcactgcattccaacctgggtgataaagcaaggccccatgtcttaaaaaaatgtaatccttggattaggatttctacatgaagctatgctttacattgttagtttgctcccaacatgctccacccccatgtgctcagaagctaaagtctcatgtgctaggacctaactgtccacagccgctgtggcctctggggcagttgcaacactgttagagactacaaaacattagattggtgcaaaaagttactatggtttttgccactgaaagtaatactgccttcctctcacaactcaaagcctattctttccccttcagatgtgatcaccctgggctctttaaacagtgcagtgaagatgaagcaccgccacgatcagctctctctaggcatgagtgtcggtgcactggtgagctttcagtcaataagctaaacatcttgtgtttggttttatcgggtgacaggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaagtaagatgcacatttattctgcccacttcttagaatgacttccacctttttttcattatcagcagattttattcttcctgtatttatttcacttgggaaaacacttgttcagagaggtaaaatttcactttcaactaaggaaagatgagaccaattttttttttttttttaatgagacagagtctcactctatcacccaggctggagtgcagtggcatgatctcagctcactataacctctgcctccagagttcaagtgattctcatgcctcagcctcccgagtaggtgggattgcaggcaccccccaccatgcccaggtaatttttgtatttttaatagagacggggtttcaccatgttggtcaggttggtctcgaactcctgacctcaggtgatccacccgcctcggccttccaaagtgctgggattacaggcgtgagccgttgcacctggtcatttttatttttttctttacatccacattttctggcaggagtgaggtctcaagatgtgactcagtgcctgggagagataacaggaaagaaaaaccatgtagctgtccccatgataaatggcatccagtagagggtactgatggtatgctctgcccatgaacttgctggttggatggacttcgaaatcctaaatacccactgtggtcccaccttttctagtggcattgatggaatagagccttccagcttaaggaagagaaagaagtagcatctctaacatctctcttttggacctctttatttctctcttaccgagatcaactagcatttcctcttgctgcagctgcacagcccccaggctcctggctttgtttatacaaacatgtgtggaatgctagggaccagcaggactggattccttaaaagccttagtagcttaaagggcttttacctgctatgtccaacacgtttattacggctgttctctgccaagagtttgaaattattagatatctcaattcccactggcattttttaaaattatttccagttaagccttcaattttaaaatgactcaccagcatcttgtcaaatctgtgtattttgaacatacttttaggtgaaatgtgtcattgtgtgtatctgggaaatgtcagaactgtgtaagaaatcacgagaacttctaaacagtaattttagctttatttttgaatcacctccatttctttccttctttgcatttcaaggtcaagatgtgaagtgggaacatcttagcatttagatgtggctaacatccgcatgcctgtgtatttgggagtgtgacaataagtaaatgtgatgttcttttgcagagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgaggtgaggggctgctgctggggatgatgcctttatgagctcaggtgtcagcccatggtgactttgccccagttagagcaaggcaccagggcacacagcttgaaacacagcgtggcctggatcttagccctcatttgtaccccttggctgggtctacataactgtgcacagagtccccatcagacacatccatagcatttcagtagagggtcccagctgcagatgcagactcacttaacaatagacaagggtgtgctatttctcttcagtacctgggcgctgaagcagactcttttcttagcttctcgaaaggaaccaattagccatacccagcattgtaaaaagtgctgttgtttcctgacacatgctaaggagggcatactccctaagtcaggcgagtcaaaggtggcccaggattgtggctgatctgtgaggataaaagtgaggaaatatgtaaataaataataacatgccacagacctttccaagccctgttgcaaaagagcacttagatgctggcatggggctctcgacacctacgattgaagtgggagtcccttttcctagtcaatggagaccttctcaggtaaacagttcattcctacttctaagtggcagctagaaaaaaaagatgacaactggcttctggcctgaagcctgcttgaccaaggtctgtgttctggccgcagttcacggggcagtgccagtgcatgcctgggtttggaggccgcacctgcagcgagtgccaggaactcttctggggagaccccgacgtggagtgccgaggtgagttgtgggcgttctcgcattgacttgatcagagagtggagggaactggggttctacaagagccttctgtaaattataaaacacagtacaaattaacgtgtctataagaacctgtatttaattgcaaaataaattaacactgattgtttaaaaaacaatctaacaaatctagccctgcccataagtataggtagtcaagagtggatgtgcatactctcccggcctcacaccctggggtaaagtttgtttctgtgtgtaagcacacacacacacacacacacacacacacacacacacaccacaaatacacacagagctgctttttaaaatacttttaaccaaggtgggaccatgtgaaccctatgtttggcaaagtgactttttatcccctctgaacagtattttgtggccaacttccttgatggcacaagaagaggtaaatggttatcctagtaagatcactggattcagtggatcaactagactctgttgacagtttaagctcttggcgtatgtgtgtaagataacatccccaccagtgaaaactggagggcaatgtcatggagacttcgtgcacaacaaagggctccaaggtcaggggctccaagtcagtttaatgtgaataaaacccagattttcacctaagcttatgattaaacaaacaaacaaaaaaagatggaaatgacattttcttacaaacaaaaacttgttaaaattatgtgaatcatcaggattgcttgatttttatggtattgcagtttttttgacctggaaaattatttttcagatcttaaagtcaaaatatggaaaagactgaataggctgttgcaactctgtttttatattctttctttcctacttgattttcttccctgtttttaattgatcattatggataaaaattttctgtagtttcttaagtgctctttcgtatatttgttgcacatctgaaattataggtctctgttggactcttgaattttttttttttttgagacggagtctcgctctgtcacctaggccggaatgcagtggcataatctcggcttactgcaacctccacctcctgggttcaagcgattctcctgcctcagcctcccaaataactggagttacaggcaagcgccaccacgcccggctaatttttgtatttttagtagagatggggtttcaccatattggtcaggctggtctcaaactcctgacctcatgattcacccgcctcggcctcccaaagttctagaattacaggtgtgagccactgtgcctggccaggactcttaaatttttaaaatgaccgttttctttttttggacacaactacagcaagaaataatacagatcttcaagttggcaactcattcaatatctcctacagaaggtcaggaacctagaaactgtgttccttcagggtgcaaacccatgtgttccttaacagcagaaaaaggtcagtgggcaagaccagaacaaattagatatgatttgttttttaagttgaggcttagccagaagggtttgtatggacctcttagattaaggtttgtttcacagtggggataatgtttgctatgtcaataaacaggtacttttctttcatcattctccaaatttggttcttaatgagatctgacatcccctcttccattagaaggtattgaaatccagtggaccagtttctccaagatgtctcttgaaagtaaaactctgcttaaaatctgttttttccagggctctaatcactactctgttaaattcctcaaacttgtaatgccccaaggcttgattttttccagataatggctctatcgttgcacataccctgattctgtcagcatgtgtcattggcaaaatagctttctctgccaaagctttctgacctttggctccatcttagctttgttagcaggaaaggcctgctacccagagtcagagtcaatcagagaattgttcatgtggtccttagaactttactccttacccttttatcttttctttaaactttcgcctctaaatctgccagggaaattgtgacttatagaaaccttgtcaacttgtttgggtcaaaagttagatcctgttttagaaactctgcaaagagtgagattcatggcatcattgttcgccaacttctttgttcctttcatccagaagaaaggtcagctcattacgtaagaaacttttcatcaggaaaagcaaacaaccgataaaaaacagaaactaagtattctgcaaggaaacctggtttaaggagaatgtattgaaactggatatgtctgttcctttttactcctccctttggcatttcctttttttttctgtaagataatcatagaaatttagttaatggaggaactacaaagatcacatggctttatggtttgcctattatgctggccaatcccggtggcacgagggcagcagggatgcagacagatgaagaggtcccatagccaagagtgtaggtcctggagccagactgcccacattcacttcaagcaattggtactcctgtattagaagaaaacaaagtcccttctcatctcctcacccagtatactcctctttttactcagcttgataggaatctttccagtcctctctgcatttatatgtatacatcattcgtattcgtgaccctaataatgatacccagtcagctcacaccagcaagaaaaagtatttttcaagccctctggaagcattggaagctccaagtgagcataagtgaaaataccctaagagatacttccaggttctagatccaggtgtttcattttccccttgttttcccactacattgtcatctctccaaccttatctttagttttgtttttttcatggaagaccagaaagcccctttccccaaagtgttaaaatctggggtgaaggcaactgacctcattgcatactttggcaattcaaagttataaaatgttagccgggcacggtggttcacgcctgtaatcccaacactttgggaggccaaggcgggcggatcacttgaggtcaggagtccgacaccagccggaccaacatggtgaaaccccatctctactaaaaatacgaaaattaatcaggtgagatggcgcacacctataatcccagctacttgggaggctgaggcatgagaatcgcttgaacccaggaggcagaggttgcagtgagtgagcagagatcgtgccactgccctccagcctgggtgacagagcaagactgtctcaaaaaaaaaaaaaaaaaaagaagaagaagatataaaatgttggggcatctttatttggggtgttaaagtagatactgtctctcctttgtgcccacagtggctgagctggggtggggacatttggaaatttgggaggaggggagtattttgggtcatcaccataatggggtcattgctataggcacttggtatgcaggagccaataataataaatgtcccacagtgcttaaggcagtctgtcaaacagagaatgtgtcggatcctcaatgcttttagcactctttggagaaagctcataacctacaaagcacccagagagagtgagaattgatttgagtggacaatgggggattgattcatggccagctatggggtctggtgcagacagggtggcaacaggagtaggaccagtgtggcctgtgaaggcaggggccaagatgcagaggcagacaaggctcttggttatgtttgtgctggaatgcattcacgattagaaacaggagcacaggggctttctgaagggatgggcccagagatcagcagggacaagaagaggtgtcattcaaaattagatggaactatgcaaaaagaacatcagctcttttctccagttatgtaattgcttgacaaatatgttttcagttgaattggttgttagagggcataaatttagactttctgatgccaactagctaacaatatgcttatagaaagatttaagtcctagctaagtattctccttatggaaaaaaagaatgtagttatgtaaaagacaaatgagttgagcctccaacttacagattgttgaatgttcctattgtccaggcgggttggggctgttggtcgatggtgccaagcctgaacaagcccaccactgtgctgggatggagagggaatctcatccacccaccatgaacgtgctggagaaaacagcctggagcgctgcattgtcctcctcaggagtcaaagagtcacaggaggaatctttctgttgattcatagatagcaaaaaggaagggtaaagtttccatttggggcctctggctcttggaaaagggcagtgtctctaaacccaggcaaacggtaaatgtggggcataggcaagagggtccgggtagtggccacttccccatcatgctcgtttctcattttgtgttttttagtagaaaaacacagtgtgttcttttgcccagacattaatctttagaatgcctgtattttctaatgttgggatttctttcacaaccacccaccttaatatttccattgtgactcagaaaatcagacttcattcgattctttagagaactataaatactgttgtcagtagagtgaagtcttgtcttatgtaatcctaattacagaatgtgttctcagaagaggtaggctagaccagagctgggcagaccacaggcagaggccaaatccagccccctgccgatagtagctaatataagttttacacccacttgttcatgtattttccctggctacttgtgggcagcaatgccagagtcaagtcatcataacagagacagaatggcctgaaagctggatttactatttcaacttttacattaaaacttgatgacccctgtgctagacaggcagctcatttctgcaggtaaaattatattcatctcccaactttcattccaaaattgaacctatattactgaggccaaaaagggaaaaggataaaagagaatgtcagaaaaaagaaaatcccatgtaagaaataaaaattatttaaattgcccttgcttttagtaaatagaaatgcctaagtaaagtatcagtaaaattcttggcattgcagcagatcctggagtcccacgttgctttgaggcaaggtccacggcagaagaaaaccccattacctgaatcttagggtgtagcagtttctctgtcccaaggcaaatttaagtttccaacaaaaaggaggataatcagcccagtactgagtgaccaatggtatagagtggggagtggacacagagagaacagctgatactgttctgccacttgcaggctatttggggacatggggtacataaaatgaagtaacaagatagcagaaagtaagtggcacaaacttttcagttgtcagaagagggcaagatcagtaggaaatggagtcattagggaagggtttgcagaaaagattagctctagtggccatctacagagaacgtgctgagtgccaagcacttttaggcatattatataagtattcttaattttatccttgcaacaaagaacctatgggggtaagtatcatctccatttcacacttgactaatctcagactcagagaggttaagggacttgcccaaagtgaggaaagaactgggatctgaagccaggcctatgtggccctgtgtcccagctgtttccacaagcctgggggctcctcattgacagctggtatttagagaggaaattatcatccaagctaaaggacaacacagacaacatgaagcagcatggctctgggaggtgccctcgggaaacagtctcagctggagagtcatggagagatttggtttcaccagattgtgtgaagccttcggtgctgggccattaagggtagactttgttcagtgggcacaggaaggtctggaggaggagagggaaggatgtaaaggaagcaggcaagttaggtctatgtgataaatgggtacatagactatttcccattgtggcattgacttgctagtgttttcctctggaccttagtatctttaaaatcggtacaatagctttcatttacctacttcttaacaattatgtttgaaatgataagaaaacttagtaaaaatagaggaagcctactggccacagaacagagagtgtgtttacagatgaaagtcaaattattatggcttgttaaaatgagtatctcatttaaaaaatactattcttcatcttcatgatttgttcatcttaaagattaggcaacaacttttgctatgtatgctctcctttccaagagaaagtttctgattctctgccaagtaatcccatttcttaaaataagactgctttatctaggtcatttggattctgattcctttctcttaagagagaaggagcccactggacctcatcagctgcagcctgaatagtcagttcacagtttttcagatcctggtgggtgtgtgagatgatgggagaatctcctccatacattagtgtccatgaagttttactaacttgtcaagtgtgaactgacctttctgcttcagccacgtgagtgtgggagtttcactgaaaatattcttgaagtggagggggtctttttacaaggttgtaaaatgtgggccttctggtgcctgcctcttaggtgactccaagagaagcaattctggaaattcaatagccagggaaggaagcacatgaccaggggcttcagcttgaaatcaaaacctggtacatttgagactagttatttggtgccctcccggagagtcaggcccaactttttcaataatgacactgcaatccggtcatctgtgagatttgatggtttacttttcaggtgggagaaaggaatgttggtcagtttggctgaactggttgttgacttctggagagagccgaagctctgctagctcattggaactcttacccaggctaatttccctcggccagataaagagggaagccttatctgccttttaagtctttcagggttgggctgttttccccttaaagatgcctatgacagaatgggagcaagacatgtctttggcaacgaaataaatgaaaaatgatcacagaaattaaaaataaatcaacgtatgcatgcatcccttgccccaagcatgaatccagcaaaaacctaatgtttaggactgaacaaaggtatacctttgcatcatctatgggaaagaaataattgtctaagcaaactataagcatatgcaactctgcctcagttgtgtcaagtctaagggagatgggtgagtaggccccagagggctgcctcaccctgaccactggctggtagacaaggtaagttttattacaaatggcatcacttcttcctctgttacgtaagtcctgagatttgtgcatcagcctacattgctgaacttccgaagtcgtgattctgctccagctccaccttttgaagggtatctctttctccatctctcacacagacacacagatacacacacacgcacatgctctctttttttctctaatatacagaaggcgggcagaaacagctgggaaagtaacagtcagtgctccacaaaacggggtcgcgtgactgtgaacatcagtatctcctgggaacgtgatagaaataaaaatagttctgggccccacccagacctactgaatcagaatctggggatgggaggagagtagagaagcaatctgttttttatgaaccttccaggtgattctgatacctacccaagtttgagaggtgaggacccaggtgactcgggggtaacttttagctttctggaagatgactaaattttaccaaatgataatggaaatgtattcctaaaatctaaacaacataaactcttaaggtactaagttatttaagttatttgtaagttatctaagttcttcctaatctcagaaatcgattaatgtagtggttttcccaagcctttctcattatttctcttgggtgtcactggcattgacttccactaaaaaaagatcccatggtcaaatgactttggcatacatacaactggataaaaacaatataaaacagtttttcctgcagaactcttctgagtctgtaatatgctgacacttgtttttaatcttcaagataaggatacagaacttttcatcatgggatagttttttcaaggaacacatcatagaacgtatggtctacggatcaccattaaagttatccatggtttgcctaaacagcttcctgattcattacgagaatattccccaaacaagaaaaatgaaacatactttaagtacctggaaaggatctgttttttgaaaagcatacacccaagttttacttttgaaatcctaaggtcttggttttgaaaaccccaggcgctaaggaaattacatgttttaaaatcctaaaggttgaggaattaatattctaaacttcaaatttttgaataatcatgacgttattggcaaatacatataaataaacatataaccggaacacgtttttcccctttatccaatggaaatacgatcaagcatcactcttagcagaagactaccagacacttgtagggacacgaaaagtgataataaaaacaatttatttattgaatgcttgctatagaccagatgctcttctaagcactttgtaattattttatcttgaaagcagtcctgtatttataatcattacctcttcttacagatgtggaagacgtgactcagtttcctgattacccagggtcacataacatgtgtggagaaggcaggatttaccacctcagtccgcagttcatgctcttaaccataatgctgtactcctcaaacctgccactcgagagcttggaatgtagggggagaacaaagacaataaaaagataaactagcaatacaaggcaggatgtggtgagggccaaatgaatgggccacaaacacacacctctgggttgaaaggatggtgatgttatagcagatctcaggaccctcagtataactggttctgggagatgttccattagaaagtttttcagaggaaggccgggcgcggtggctcacgcctgtaatcccagcacttcgggaggccaaggtgggcggatcacaaggtgaagagatggagaccatgctggccaacatggtgaaaccccgtctctactaaaaatacaaaaattagctgggcatggtggtgcatgcctgtagtcccagctatttaggaggcagaggcagaatagcttgaacccgggaagtggaggttgcagtgagccgagatcatgccactgcactccagcctgggagacagagtgagactcttccaaaaaaaaaaaaagtttttcagaggcaaatcacagctattgacccaagagtggctcacacctgtaatctcagcactttgggaggccaaggcaggcagatcacctgaggtcgggagttccagaccagcctgaccaacatggagaaacaccgtctcttaaaaaaaaaaaaaaaaaaaaaaaaaaaaaaaaaaaagccgggtgtggtggcgcatgcctgtaatcccagctactcgggaggctgaggcaggggaattgcttgaacccagccaggaggcagaggttgcagtgagccgagatcgcgccattgtactccagcctgagcaacaagagcaaaacctccgtctcaaaaaaaaaaaaaaatccgagaaagcatgaatctgttgtgctttgccacagttgacattgcacttcaggaggattattttcttttatgaaggtatgtaagtgtccttgcatgcctagactaaaatgaggttagggcttcatttggcaaagacgtttggattctgattgcaagttaaccctgagtccgatgctgaaaaacgaaaaatggtttaagatgtgcccctgcccttggagtccacaatccagttagggaaataagatagtatattctttatttattcctgtctttcctcagaatgggtggaagcccagcgataagatgttagcataaggcctttcgtaattcaaaccctgtataaatactttcaaatgtcagatgttgatataaaaatgatttggtcacctgaaatttgggaatctaagccagggttcaagggcacagccactgtgctaagtaatctcagccacagctactggccaagaacacattttgtcctgtacggcacgtgattttcctgtgccatttggctttgcatgaggtgccaaccctattgggcctgtgagacgctgagactgaatggctcccaagatccctgcttgtagtactggcagtggtcatcacaatggcagacacccccaagttagattatacttagttgaaagcctttaaactggatacttagaattcctttgggttttgttttgttttgatcatgtttattgcatttcatcaagtatgttttgttgtgagatagagtcaggtacgtaaagagcttctcatttgtgatgtatccgatgccaggtggcacattatcaggatgtaacctggattgtttgtacagacatggtctgtggggaaatcctaagtaagggggaggcaaaggcaggacggaggtgaagagtatagactccggagttgcaaagaactgaatcagaattctggcgtggccttttccttgcagtgagacttggggcatgttacataatctctctgatctctgagttcccacatctgtgaaatagtgattattataacacgtatcccatagggttattgtgagagttaaatgggatcattcatataaaacatttctgtttaaagtattattactgctaagaaggggttagcaaccactgaagtcacgcatgtgctagaggaagctgctacagtctctacctgagccattggtcaattgttgtcgatggttgacaccttcccattttcacagtgaagtgagtattctaaatgccacatcttgtcactgaggttcatgattaagtagatcagctagcattgcttattcccttctagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagtaagtagttaatgagccagaggaattactcataaagctgaaaaaatattgtgagttaacagcaaagatttcctggcatggtgcttccatcaggaggttttgttagtcctgtgggtgagaacagattctgagccatttattttccagcagtcttgactgggcatttgggtgagtgaacgttggcacatcagtggggaccagccttctggaggctgcagtacagaatatgcaagcattatattcagtgctcctccttgcaaatcatgttctaagtcagtaaaatgggaggaatgctggatttagaagacaaagatccataattgagtcttggctctgatgctaggcttgtgaacttggatgactcaattcctgagcctgtattttctctcctgtggagaaggggtaggataatatatgccattaccttatgaagtaatgaaaggatttatatataaaataacaacaggattgcagaaaattataaattaagtattgctactatgggggaaattccattacctcaaaataagactgcttacttcaagttttttctgcttctccgccattagtccaccagaccagtgcttcattcatctagttataacagctgctctatgctgaaaagtcctcatcccaccccttctctaggtaatcttccctctgattggacagtgtttgttagtggaagcctagagaattgaccttctcaaggatcatttatctaccctttctcctacctcccctctcttgcccctaaacttcccaactccttttgccaaaaaggaacccccaaaacagcacaataagacctaagtgctaaaggacaaaaatagaaaagggtatgaggcatctgtgcttccctagatgctatggttttttcactgcagactcaccatctaggcctgaggggactgcttcacagttaaatcctgcacactgaggtgtttatatgacgaaatgacagtaacattttttgtgtgtgatgagactttaatcagcacctttaagaagccagagggacttttcatctcataccaggcatgagtagcagaggacagctgacattagctcaagcgacttgaaggaggtccttcctagacctagatttaaagtaactggaccttgatgtcaagccttgggttttatgcccaagaccatgtagctggccagagtgttaggaaacgtctgatgtagagtgacaatgcatttagtgaggcattttacctcactgaaaagactaagcctcctaatgtgcagagatcacagttttggcaggccgtggtccgaatgcaagcccatttaggaaatgatccttggcctgggtcttaggcatctctgggaggaagaaaaaaatctggtgtcctttgagagcctgccagaagagagattacattcccaaaacagctctgtttctaccgtcactattcatttaactagacagattgtaataatcacaggaaaactagttccattactcttttttttcaacatactatccaaggatacatgttttaggaaccaaagtggccttattttaaaatacgatgttagatttgcttgttttaaaaaaaattgtatcattttatgagacctgagaagaaatgaaagccttctgtgagtcatataattaataaaagcaaagcactgaaaaaagaaactatgtatattagcctcaggaaaaaaaggcactgaaatgtaatttaatctaccattttaaaccatccctttaagtactttttctttgagttgggttatagttttatctcagccttacatatcatttttctaatggctcccaacctttcagcatctttacattttcctggttttttatactattatatcgccaagaagacaattacattcaattaggtgaaccagtaatacccagaggtaaaatctgctcaaatattactttctttacaatacacatacaaccctacccacacccacctggagcacactcgcatgtgcacacacacacccatatccacactatgtacacaataatatacaaatagatgtcaaaagtacggctttgtaggtttgaaagtacagaacaaaatgcagtttagattccaaattaaatactgtgaaagctaaatcttcttatttcattcttagtagatgctattttcttataaaaaataaaaaggctgttggtagaaggaggcccctctgacggaagagaggagtgtatgaaagctgatactggtggctcctgttgtctttgtggcaggctatagggcttcccctctgcatgttccatcttgaaggagatccctgaggcttagggaagaatgttttgggcttgtggctgggaggcctaattgtataactggagtcatttatgtcttcagttttcacaattgtaagggcttgaagctgcctgtgaatagagccagaactccacactctgacctgtgctcatcttacagcagaaatttggaatcccttaaatggcttgtctgccacaactcagctgagtggtacttctgtgtttctctcaaaagtcattgaacaaagaaaaattgttagatttaatactatctgttataaggaaaataaaactagcacttagggatgaaatgttacaaattactgaattggtttgaaattagtaatggatacagtactagtagaaaatatgaaacgtgaaagttctcccttgggtttattttatgtaagtaagcttaactttctctttacaggaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgagcattttttggtgcaaatagtcccagacaatggatttaacgatatgtctaacgttttaatatagcacttttggggaaaaaaaaaagttttctaataaattttaaaacttttgctcatccagtttctggcacaaatgaggatcaaagtccccattttacaaatgtgggacttgggcacagagaacctaagagacatagcaaaggtcccacagagtgaatggcagtagttgtatcagaatggtatccatttcctgattttttttttttccctccagttagtagtttaatcccctggccttttcttggaagggggttcttttgaatagttaaggtattaatacttctgcaaatcctttcacattcaagaatgctgcttggtcagaaaaaaacttttgcaaatcattatttatatcatagactgtaaaggatcctcagcaaaaagtgaatgtagaaatatgttacatcatactgtccaactatccatactgttttatgcatgattgcttttggactaaagctaaaaacatgtcatgctgttatatataataccgtcatcccttggtatccatgggggattggttccaggacccactgcagaaaccaaaatccacaggtggtcaagtccgttatataaaatggcacttgcatataacctatgcatatcctcctatatacttctttctttttctctctctctctttctttctttctttaagagatgggctcttgctatgctgctcaggctggtcttgaactcctggactcaagtgatcctcccgtctcagacttctgaatagctgagattatagaggtgaaccaccacacccagctttacttttttctttttttcccttcagtatatttaaaagtaatctgtagattacttacaatacctaatacaatgtaaatgctatgtaaatagttgttatactttattgtttaggaaataatggcaagaaaaaagtctgtacacattcagtacagatacaaccattttttccaaatgctttccatccacagttggttgaatccacatatgtggaacctacaaatatggagggctactatattagtcatttgagtggatccgaataaaggattgagaaaagtcatctagtcatataatcttcaggctgcctgaaaccagctatttataaagaactggatgtttgcttgtgtatagaaacaagattgcatgattttcttaatttttcatttttcacccagatgtttgccatactcgagctggagtaggtgctaatgggacaaaacatattcattgctcatgaaaactgtacttcataaatattttttcttgaattttaaaactttacagtaaatttaggacccgaagacaccaaatatagacactgcttggggaggaagcctagtatgatgaggttaactgtgggcaatttcatttcctaccctaggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatggtaaggtttggggatgtggccttactgctatggtgccaagcaaaaaaaaaaaaaaaaaaaaaaaaaacaaagaaaaacaaaccatcttttgtcattattacaataatttgcaaatgaatcagcaggactgaaactcctaggctgaggtctctggatcctggaatggggtatctgtaaccaagacagattaaaagcagcagcatatgggtttccagccttcccctcttctgtttctctgtggtcctcaactaaagaatgaatcatgactattctcccatactgttttagctactcagtgacaccgcactgaaacttgatcctttttacactgtggacatttctttaatattttttttcctaagtagagacagggtctcactacattgctcaggctagtcttgaactccgggtctccagcaatcctcctctcacctcagcctcctcccaaagtgctgggattacaggctaacaccccagcccacccccacccccgcttttttttttttttttttaaagagatggagtctcactacgttgcccaggctgacctcaaactcctaggctgaagcgatcttcccacctcaccctcctgagtagctgagatgacaggcatgtgccaccacacccagcttggacattccttttttagtttgttctgatttgaattataaaacccatctcagtgtaggaattcagagtcattctagaaggggcttccattaaaaattaaagggagcaaaagaattttttcacgggtattagctattatgttcctttgttccagtaactttacctggtgaagattaaccctgaaaccagcctagaaagtagattcatttcccagaagcttttaaaaaggaactctggagccaaatgaaattgggttgtgagtttaatgaaaatcaggcagaaggccccaaaaaagcctaactgagcctgtttcttcctcttccttcctgtgttttcaaggaaggatacctatgtgaaataatttggagggtattttttatagactaaggtttgtgttctcttagcccagagacacagagaaagttaaagatggaaggtacataggcgcagaagagttcaaacttcattacagctttgtcttagtgatgcttcctccctcctctcatcactttctctgaaatagacaaaattggtcacaatataagacagtgtttattgatgcctgctaggtttcatactcattatcttctgaaactttatagcaaatagggagcaaataatctgtcatttattaaatggaaaaataaaagatgaagaaaaaagaaaaatgaaggcttagagcaatgtgtaaattgcagctaacaggagacaaagttatgaagcatgaaatgccaattctctccatctttcccttcagcattgattccttccttacatattgtagttaaaaaaaaaaaatcagttatcacaaacaagttctgtgtgacctacaagaaacagctaagcatgctaaaggatttttgtcttgaaccggaggcatctccgtgggcggcagggagatgcatgggcggtgggtggggttcggggttcctctggcctttcaaatgtgtgcccttccctgtgcttgcttttccacctggtaaactacctagggattagcagctgcttcagttctcttactgtgtttttgtctttgttaatgatcctgtgagaattctttctgtaagttctttactgccatttccttgtgtagagagagttttgtccttttgtttttcaggtacttctagttctgtatctttgtggatgtttagctagagccatactgtgtttttttttttccatgtctgccccatctgttgaaacaaaacagatcttctatgtgtgctgtcagattgtttttagaaagcaaccgaggttttacacttatgttcttaagactcatgttttacagcatgcagaatacactttattttctgaagctttttgtttttgtaagccagataaatgacttatttagttgtaatttgagatataatggaattataattatcttaaaattattaggctaaatagttgattgtatttatttaaaaactacttttttgtactttttaataacaatacttgtttgggaatattctgttaactccttttcactgcagtaaatctttgtcttcttttcagtatgagaatttccacaaacagctctaaatgcaattttctccctgctcagccttttctatcatatagcacacttgtattataatttatcaatttgcatttgtatgccatgaccaagtggtgatctttgagaggttttggtaggtaagaaaggaggactctatgcatgtgtgatggcagtcgggggtggtaatttgggaacacttcatctacctttgttcctttgtttgtactgttttctttaacctgtggaatgttttcccacttcccctgctcaaatcccaccagccaacagcttcttcagctacaactgtagcattcctctgcagtctctcctttgtctactttctttcatagtgactgcatctgacctattcttggctattttatgtggaatgatccagtcctaactagatgggaagttactaaaacgctaggtaatagatcttttatgtcaccatatttactggaggagttaacatggtgctggtgctggtcccaaagatggttcacaataggttttttttttaaactctaactggttagaaaaaaaggaaggcattccttggcccttgcactggcagaattcaacttgatatagcagatgtttgcatcctgggcagagctcatatagtattttaactcatttgggcagaagatattgatgagttgtaaacttccattgtttccttggaaataagcaggttagtttactcctaaactctctgctcctctctccattctgtctcccaaacactgttttcaagcacccttgctgaggaccacctacacattctctggggccacccaggccctgcacagctgttttgctgcagcagattcactatccgaagtattgtgcctgatccttggcttgttgcagacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtaactcagtggatggcctcagtttttgttatgtatgtttgctttcagctgtggactaaaggatctgaaagggagaaatcaattctaaatgctaactgaaatgaaaagggcatatcacaatcaaatatgaaagttcatgtttctgtgaggtcagagaaagagatggggagattttcttcacagataaagaatttgctttctcctcactcaacacatgctttagagcaagatgtttaaatcttatactggataatttgagatagccatcttacttttctgactccagggttataaatacatccagctgtatgacaaaaactctatactaagcaattgagcatttattcttctaaagtgacacacactttttaagtatttatgtgggcacctgagaaaaagactcaggactattttataggccaggagttaaaaaacaacttgaaaaattttaaatgctagttctatttatatcagaatactgtttaggaatctctatactgaatacttgcagtctgtaagatacaatactttgttgaatgggagaaagttgtttcccagacatatgattccaagtacatagtttttcaacatcatttttgagccatttccaatattctggtctcctttagaaagaatgaaagtcttccctgggtaatttattcttcatatttaggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccgtaagaaattttttcattttacttttagacatttgtttctgtgtgattctctgtttacattttagataaaatccatttctgtcagggtactaagtgacatttccaaataagaaaaacgtccgtatattaaatgtttccacttcttaaacttatatatgtgtatcaaataactttctccaatgttacgcagatacagacacacctgatgggatactcaggtagccaatcaaaagtcaaatatttacattgaaaattgaacgtggaatttgttagaaattacgtatagtaatttctaaccttaaagaagtggagtttgttattttggcattgcccccaaagctttgtaattctattatttacaggatattatacctatagttagttaagagtgttgctagtcacagttcaagtgttaccagtaaagatggttttggctgcaaattacagaaaactctcaagtgaaagggacttaatcaaaaaggatgtttattatctcacatcttaataagatatccagtagcaggatagcttcctgggtctgcgacccacatacttttcatctttctactctaccatcttaagcatatcagctttgtcctctagctcctcatggttacaaggtagctgccaaagttccagacatcatataaagattaataatggaagaagagaccacctattccttgcatctttttaaaaaggaggaagtcttccctagaagcctttaagcagtcatccttataaacctcactggccagcaataagtcacatgccaatgcataaatgtcactggaaaatggaaatgcgattacagtaattcacaaactaatatttaatgctgggttgataattttacctgacttagaggcaggtacctgaaaaaaaatcagtattctgttagcaagaaaaaaggcatggctaataaggagtcaacagtatttgctaaggatatcttaggtaatattttatggaagccatcattcaagtacatattttatttgaataaatcctctggggtccatttttatgttcaatagtttaaaacataagcaaagcttgaaagtaaatgaggatctgacgtatttgaagcttaacttcataaactttttttttcaccatcttccacattttacatttgaaactccttggctttgttgacaacccattattccggttctcctgcttctataattttctccctttctataatttcctgaatctagatcatttgtaggaaatatcaaatctccatatctgcattcacaagtttctgagctattcgtccaacctcaattaaaagatttcattgcctttaagtctcagctttaagctctggccctctatggttttccacaatgttcagattcactctgctatactttcccgtaacatactctgccgttcctgtctccccatctggaattgtcctttcttctttcaaattctattatcccttaaaatctgatcagctcctcatcttccacgaaggtttccctcactacccagcctaaaacaaattctagtagtactcaattgtctgcagttacttttttgtgtgtgtaggtctcatctcccctcaaaatcccagatagattataaactcttaaacaggaagttagtgtctcttggtgtgtaaccccaccatgctagtccatagtagatgaccagtaagtggttgaatgaatgaaccatctattcttttcacctctttttggggacatctttgcttttcacagaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaaggtatctaaagacatggcatctaaggggcttattttgtgtatctatcatggagtaaaaagtatctctttaaccaatgaaacttctaagaaggacctatgcgagtctctctgggtcatttcaggaaggctattctttaaagaaaagaacactgagagtacttttttcatgttcagcaacaatatactgtctcattattttttactcagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcggtaggcatacacaatcattacatgaatgggaacacacctacatatacacttaccagaaaagtacatttgttatctatgaacagaaattcttacaactcaacattaaaggattcctttaataaatctaaactactccgttagcatggatgctaaaaataagtggagataggttttcaaggaataaaaggactctgattcagacactggaccattacgtcccatctcattttctcccccacaaagtctgagaaagataaaaacttctattcttgggcgggcatggtggctcacgcctgtaattccagcattttgggaggccgaggtgggtgggtcatttgaggtcagtagttcaagaccagcgtggccaacatggcaaaaccccttctctactaaagatacaaaagttagctgggcatagtggtgtgtgcctgtagtcccagctacctgggaggctaaggcaggagaattgcttgaaccggggaggtcgaggttgcaatgagctgagatcacaccactgtactccagtctgggcaacagagactccatctcaaaaaaaaaaaaagcactcctattcattgaggaaacagcatatactctgttcagtagtatgaagtataataattttagaaaactgtcctgatgttataaagcagcttatctggttaagaaggccaatgtctcaagattttggtcatcaaacattttactatatagtagttttggaaactatgggagaacagtcagtctgctttcaatacccaattctagagaaacctaatagagcacttatagctaaacaatctgttctgtttagaatgcatggaaaacttaatgttttttataagaaatatactgtgactaccagatattaaaagtactcattacgaatttttcatagggatctagcaccttgctctaaaaatcctctttatctcttaaaagaagtaatgcaaacataattccattaaattcttttgtttctcagaaagttaatgttttcgttccaattttacgagtttttaaaaaatgaagaaaattgatgagttatctaatccctatacaggttctcagaatatactttgaaattaaatgctcccatacccagcattgtcagccttctcaggccaatcctccatgtgtttaaaacctgggaagatgaattttcaacatgcttttcttaccattagttggtaaaaacctgtgttcccctattctattgctgtcagttaaatgaaggccaataattctgtccattttcctccttaaatttcgagtatcaataagactttttcttcaggctatttgttcaagtttagaaaaattatgttttcccaccagactataaatattttgatgtttcgatctctaggtttttccattttctcagtttgctgttaatattttagtgaatattatgtcagtgactgtagaaattattgttttgaaagccaggtgcagcagtgtgtgcctgtagtcccagccacttgggaggtggaggtgagaggatcacttaaggccaagagtttgagactatagtgcactatgatcatgcctgtaaacaaacagtcactgcactccagcctgggaaatatagcaagaccctgtttcttgaaaaaaattgttctgaaaagcaaattagaaaatactgaattataggtgagatgtggcttgatgatgcaagttaataattggggttctgtttttcaggggccctagggggcaggaagtgttttaggttagtaacaataagaaacaaagagaacctctaactaaactgtgttcatgaaagcttatcagaaacaattcactcaaactttatcttctaagaattataatttctaagaattttattctaattaaagggtccttaggtttgaaatatttacaaattttagcctatgtcttatactgacccttattaacttcattatagcagtactgttattcagttaattctatgtaattagacccatccttgaagatcattttaaagaaaaattgagtgctcagtgaaattgattcttttgtcatgggctcaactgcttactttggctagcttttaaaagtcaatgtttattgattctactttgaaaggagatcagatgtggatcctcaccagttgcccagatatttttttttccctaaataactttgtgtatttagagtttacagctgtaacgttcccagaccatacatcatctcacaattctatagaaattcaaagaacatccctagtctccatgtcttcagtaattagctgaaatctccactactagagtttaacatttattttcccactcacattaagttggaaatttatgtggaaatccctcttcgcacagctgcttatttgtgaatgttctttagccaaagtttgcaggtgtccttaaaatgctttctcaacacatcatgctccttggggaggtggggttttttgtttttttttactgtcagaaaaaattttacatcaatctcagcttagatcatcagaagtactgaaagaatgaagtgaatatatgaaatgtagcaaagactaaagttagatacttcatgtaacttttcctgaaatattctttttagtaattacttcttttggtctagagcaaaatggcacagcagacttttaaatcttcctccaaacttgtactcatagtaattccatttcttaaactaatgtcttgctggaaaattgacatgcttttagattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaaggtacgtaaatctttgtaatttcagagctatgttgttaaaggagccaccagtctcctccttgcctgccttagagtaagggacatggacctaacagaaacagaattcatcagaaatatcaaatgacctgttttgcaacagccgtctttagaagtgtggatgggaaagaatatggaaatatctaataagtatgacctatgtcctcaaatccaaatttggacaagagtttagaagaacggaattaacttaggggtagaagtctcaaaacaggctttttttttttttttaaaccaactatattgacaaaaaccagtcatattgaacttttatttctgtgcggtagtcagttaaattcttcatggcatatagtaattatcaggccatttgagaatattttacaagcaggttggaacagagaacaggtagtaggaaaccaaatcttatctctttgagactcattttgaattaactacccctcacctctcattcgaaggcactatattttgcagagaaaaactcacacaacccaaatgtttaatcagaagccatgtaataactgaaacacatgttcagtttctcaataatgcttatttctaaagagaacattaaaaacttggtggcgccggggtggggcttaaaaccattgaatcactggtccccaacttttttggcaccaaggaccagtttcctggaagacaatttttccagactcgggggtggggatggtttcaggatgaaactgttccagctcagatcaggcattagattccataaggagtgcacaacctagatcccttgcatgcacagttcccaataggattcgtgctcctatgagaatctaatgtcaccactgatctgacagaaggtggagctcaggcaataatacttgcctgcccacccagttcctaactggtccgtaggcctgggggcacctgcatttactgacctaatttcagtatttaactccctactattcaaaaattttctggaagttactgtagcttttcgggcattacgtaagagtaactttccctacctctctctaggttgggaaagagaacaaaacaatgagaaaagttcactgccacaatatcagacagctgtcttttctgttttggtttgtgtggtttcctgcagtactgaggacacaaatttctcaagtactctgcttcagggcattttgcataatgacattttatcacaagagaaaggaacaaaatctcttgaaatgaaatttccataaatggctatttgaacagtttctaaaaagaatcatttgcattccaaccccacaccccatttctcttctcctcactcacttcttgcatatgctacaatctcacctttccttcctgtatcttttgtttaatctttttcctctgatttccttataagcaagtcttcacaaatcctaatttagtcaagatccaaagagcctccacttcttcaatatgggcttctctaatgtctaatctacttttgaaaaatctgcgcttctctatgtaatttgcaatacaattatgctacaacttttctatagaaaagtaataatcaggagaatgaggacttagccctaaggatttgctgcaactccagaattttttgaaatgttctttaaaatcatgtcaattttgcattcaattccactgtttgaagataaaattttaaattacttaccagtgaatatccttggtggcccttaatccagaatgcatgccatgattacactattgctcttaaatgtaattactgacactaacattaccacttctttctgtctaaatgtggaactatagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaaggtgggtcttttcacacaggcttattttttaaattactttaaggcatccatagtttatttaaaagtgaaaaatatattcactttgtcttgagatcatcatagtataaattgctcagactttatatatatatatctccccacagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaagtacagtgcttttgtatatattttggtgtacttgttactttcactgattgttgatgaatcccttttttcactgtaaacgtggatttataaacaa

SEQ ID NO: 7120 - DNA, 136 bp, Homo sapiens
tttaataaatggtgttgggaaaactggctagccatatgcagaaagctgaaactggatcccttccttacaccttatacaaacattaactcaagatggattgaagacttaaacgtaagacctaaaaccataaaaaccc

SEQ ID NO: 7121 - DNA, 5252 bp, Homo sapiens
gtggctcatgcctgtaatcccagcactttgggaggctgaggtgggcggatcacaaggtcaggagattgagaccatcctggccaacatggtgaaaccccatctctactaaaatacaaagttagccaggcgtggtgatgtgcgcctgtagtcccagctactcgggaggctgaggcagggggatcacttgaacctgggcggtggaggttgcagtgagccgagattgtgccactgcactccagcctgggcaacagagcgagacttcttctttaaaaaaaaaaaaaaaaaacaaaaaacaacaacaaaaaaaaacttcaacatatcttctggggacagaagtttacccacaacattaagtgatataaaaggcctgaactgaagctgcaaggctttatataaccaattacccttgaaggtctagactgtcacttctgctacattctatttatcaagaaagtctctactttttgttcaaattcaagtgtaagaaaattagattttatatctccatgagaggagggctgaagaattaccactgtttcacacctattttgctccctttttactttttcctattcttttttctttttctctatctctctctctctggtgtactttaattctttaagttaaatgcatttattatgcagctcccctaaaagactgataaaaacatttgaaaaaatcctttttgttttagaatatttctatgatttttaatcaaaagttttcctgagagtttgtggggtatattactgtgtgtatgagacaggcggtgggaggaagggagaaagagagagagagaaagagacagacagacagagagacagaggaaggtaaggtagaatggggaaagaaaagtttgtgtagtaaaagcattaaaatgaatagcctgtgctggatcctcccacagatccccacgattgatgaaatgccttctcaccaaataccaagtacaagcattctttctatttctagaagttgatctgctctttactcagaatagcctagatcaggtagaaattgaatagtttctagagctcccatttaagagatcatggaacagatttattgaaaaggaaaggaacctgtgctgtctccagaagaaatcctgtttggaaacaattgggacactgcatgcatttgccttatgatgtctctgatatgttactgttttgaggttctaaaatattgaatgtataactcttccatttctggcacttggctgccacattaggatttctttctcaaacaggtacctccagagaacatacagttatgcgcattttgaataaaaagctatttgtctttcatgtgacaaatgaatcacttggatcatttttctttgtaattgtaaaaaggtagaattatttttcaaaaatgtttattgtttttcctaccaagatgctctttccctggcccttctctacttcgcttcttcccgaagaagggctatattttctgcccactgatgtcacacttggccacttgacttgcttcaaccatataaactgagtgcaaggggtctgtgtcactcctgagtgcaaactgcaggagccatcatatggttctgttatcactctgccagagactggcatgtcccagcaggaggatctgcatcttgggatgatggagcagagcccatgtcacttcacaatgacaatacaatatgagccagaaaaaaactttgagtgttttaagtccctgaaatattcatattgtctgtggctgtagcataactcaaaatggctgacacattgtctatgaacataaaaacttccctgggaaatggaatatgtgctttctcaaaggggcagagcctgtccatttctgtatggctctgagaagatatctatggatacacagaacttgatattccattcacctggatcttggagtgaggtagttggattcaatgattatattattgagatcttcagtttatttgatttccatttttatctgtgtgacattgagcaaatcaagcaaattaccaaatttcttaagcatccgtcacctcacctagaaaatagaggtggtaatgcattgcctcatgggattattgagagaatttaataatctaaagcagtggtcctcagtggaggcaattttgccaccaggggaaatgtgaaaatgacaggaggcatttctgattgcttcaacggagcagagagtactactgtcatctagagggtagaggcctgggatgctgtaaaacattccacaatccacaggactctccccccacaataaatcactttctggctccaaatattaagagttctgcaactgagaaaccctgagataaagcaaagtgcttacttacctaccccaagtttgggcactcggtgagagaaaaatgtttgtcatatacaatattatttaatgggcttaaataacagcctgatcatattttgcaattatgagtttattcatcaaccccaattttttaagtttaccatcaatatctgtgtttgactacaaatatataattatagaaaaatgatcagtctttgagatagtttggcagtggcattctgtaaatccaacagtggttataccagtagtaaaatagaagatgcttataattctctcaagtttcatagaattttttatgatatacttcaatttctgataattattgtgggcatacaatgtattttagacagggtttataaaaccatatgcatttaaaatattatataaatatgtagtgcataaaaataaactgcctgaataataaatatatttacccaaaaagtaaataaaacagctcataagaagctgttccaattatttaggtaaatactaccttctgtgtttgactttctttcattgctttgagtcatgggaataaaaccaaaatactttcttgcaatgaaattgggaaatgacatcacctaaagcatcccaaaaatctaatataaaagtgtcattatcctaactctctccctttgtcagtgcccaagggcattccagaattgcttcagaagtctgattttcctcacaagaaactctactgtagctgataattaagaacaggaatgaattgtgtggaaagctgttggtctttatagaaagactggcagatacttgggttctagtgttggtaactaaccttctagtgatcttgaaatattcattttctggccagatgcggtgtctcaagcctgtaatccgagcactttgggaggccaaggcagacagatcacttgaggccaggagttctagagcagcctggccaacgtggtaaaactctgtctctactaaaaacacaaaaattagctgggtgtggtgatgtgtgcctgttaatcccagctaatctggaggctgaggcaggaaaatcgcttgaactggggaggcagaggctgcagtgagctgagattgtgccactgcactccagcctggacaacagagcaagactctgtcttaaataaaataaaataaaataaaataaataaaaaataataataaggcctgatgtggtggctcatgcctgtaatcccagcactttgggagcccgaggtgggcagatcacgaggtcaagagatcgggaccatcctggccaacatggtgaaaccccgtctctgctaaaaatacaaaaattagctgggcgtgggggtgggaaaataaacactcattttctaggcatgaatttactcatttctaagatgagtgtatagaattagatcttgtctgtttctttccagcaataaattatatgaattcatgtctccacttgctctattttacatacatatcttttaagcttcataggaacactgtccttgttttgaatggcatttaaatgaaaacaagccttctaaagagagtcttagcattgctttccctctttgagccttgttttgcttttaggttgtagctggctgggatttgtttttgtttttgttttcttttaatttaaaaatctagcagaaggctagtctttatcattgaaaaataaaaaataaaactattctcataaatgttttaattagcaaacaataatagcaataataatagctatcacattctggtaacatgctatgtgccaagctttgtgctatattttgcatacattatctcagttacttatcaaaataacccagagatagagacattattacttattttacctgtgagttaactaagatttagaaaaaaattcaaggtcacataatatgtgtgactctcataaagactgtcaagccaaagcatgcttttaacctccatgccttaaatctgaaacaccgttagttgacatctctcactgaaaataatcacaacatcgacttcttagaaagataagatacatttgtctttcctgaatatatgatttgcttttgctgttttgtggagatgttccttgttctttgtatgtgtcttctcatgtgtgtctctgtactcacattgctagctgtgcggtctttgtctcccttcctctcatgccagctagtggcatgatggagagactgtggtctagactgaggattatgacagcatacaaaactgactcaacacttacaggtaaataaaatgagcagtggtttcctttatttatttctgttatccactacatagattccatgtggatttaagaaactcaaattcaagtagaaatatctattaatagctattaaccaatcatgcatctcatgtcttaggagattctatcctgtagataaaatgaggaaatcatttattgactgcctttttgggaaataactctatggtctctagaagacatcttcgtttacttcaagtgccatggctttgagtttcattcaggaagatggtccaaaatatgagaatgtgtttattcttttaagatatgtaaattgtttatatcaatatcaacttatcctttttgggagagaaatacataagtagtacttcactttcattagttatttaacattcaaaatctctcaagtcatttaaccaggtgcaatggctcatgcctataatcccagcactttaggaggctgaggcaggaggattgcttgggcccaggagttcaagaccatcctaggcacacagtgagacctcaatctctacaaaaaagaaaaaaaaaattagcctgatgtggtggcatgtgcttgtggtccagctacttagaagtctgagtggggaggatctcttgagcccaggaagttgaggctacagtgagcagtgatcgtaccactgcactccagcctgggcaacggagtgagaccctgtctcaaaaaaaaaaaaaaaaaaaaaaaaagttattt

SEQ ID NO: 7122 - DNA, 18564 bp, Homo sapiens
gtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcaggtgagcggcgtgtttcataggttcctgcggccctccggagccggttcggactaggtccagccttcggggggcctcccggaagagacctctcttagtcccttcctgctgttgccgtccctccgctgggcggggcaggaatccactttcgggggccccgcgtcccgcacgctactgaacgcgggacacgaccttgtgggtgaggtccttggccctcggccctgctcagtgcccatgagctgggtgaatttgattgtcacttaactcacctgggttaagacggaggggtaacaacaaagtctttctgaagtggccgaaaactccctgactttttgagtgaggtcttaggggtaccaggctgagcggtgtttggcccctgttcttaggaattcacagtgcataggttatctttccttttttgtgaaactggaggctaggatagagaagtagatttgatctctgatcttaaatctaccccaccccctgttcagcgatggacggcttatgatctgtagtggcctgccaaccacagagccccttctgagtgccctcttggaacctccctatcctgcccctgtgactagtacagctgttacttcgtttttgctgagcggctcagtttctcctcctggttccgctctgctcttaaaaaaaaaaacatttattaaagccagggtatctcatccctggctttccagggaggtgatgcaggtcgagcctcgggcctcttcccttcttgagcttctgacagaacccgattttttaaagtgtgttttgagactcgttgtcttggtattatgatgtacggtctcaaacccctgatctttgcgggctgctgcccagctgtaatataatggaaagaaggctggactgacagcaggcaaccctggaaatcaaatctgttttgaaatgatgaggtcagctgcttgagtaggctgagcttcaaatttttgcctctaaagtaggggtgggggggtggtcaatggtgttaaattatctggtatagggcctaacacgtaggagctcagcaatatttatttaatacaaattgttctgagaccaccaccctttttcttctgtcctcttcctatagtttctattagaaagatgaaacttctaggttcatcctgtgttgctgtcacccaaatgtcatctctgaaggaagcctcaatctccccagcatggggctttgaggagagtttactaagttcagcatacctgttcttttgattgctctccagcctccaagaaacatttgatttttgtttttttgagacggagtcttgctctgttgcccaggctggagtgtaatggcaggatcttggctcactgcaacctccgcctcctgagtagctggtattacaggtgcccgccaccacgcccagctaatttttgtatttttagtagagactgggtttcaccatgttgaccaggctggtctcgaactgctgacctcgtgatccgcccacctcggcctctcaaagtgctgggattacaggcgtgagccaccgcgcccggcctccaagaaatacttgtgtagtgaattttcctctaggaactcgccttctaagcattttcagaaggttacaacggaagataaatgcataggtttttttatagaagtgtcgggcagccatctgctatacagcgccggttttttaattcccaagagggctatagcattatgcagagtgcagactctggggtcagactgctttggttcacgtttttcatccactagcatttcaactttgggcaatttcttcatttctctgtgctttggttttcttatctggagagtgcggataacattggctcctacctcacaggattgttggcaggactgtatgaatgaatgagtggtaaacagtaagaacagtgcctggcagtattcatgaacatttaacatggcaactttgggcctgaggtctgtggggacctccttggccctctggcagttcttctgcctggctttatgtccgcttgcactgcacacaggatttgcgttgatggcagaaaattgaaacaatgagaaaggaaaattgaatttcaggatatacttaaagatctttttttctcagcactctatatacataaatgcacttttgcaagtctgaatacttgtgtggcattatacaaagtgcttagaacaaggatcttgtttattttgcagatggaaaagactaaggtggctggacgtggtggctcacgcctgtaatcccagcactttgggaggtcgaggcgggaggatcatttgaggtcaggagttcaagactagcctggacaacatggtgaaaccctgtctccactaaaaacacagaaaatagccaggcggcgcttgcctgtaatcccagctactcaggaggctgaggcaggagaatcgcttgaactcggaaggcggaagttgcacgccactgcaccccagcatgggtgacaaagtgagactctgtctcaaaaaaaaaaaagaaagaaagaaaagactactaagtcttagggaagttgagtttgtatgaattggtgaaggtatatctcagaaccaaaacaaggttactatatttgaaaaaacattaggacattttatcaaatctgacaccattaaatttttttaaacacttatgtaacacagaaaaagaaaaactaccaatcaatacaacaccctgtcaaacacaaggtgcagcctcattttaaagatgttacagtaaaaagagagtgtcgtggaattaatgaaatatgaaaaatcagttttgtttgcattcttctcagttttaagtacatattcacagtataattaacaaaaacagtagtagtcgctcaacagttgagggttccattttgcgtgttgctttttgagttctatcatttatgtctttgcttacttcatatggagggtgttttgtactctgaggccttcgttcatgccgctactcacatgatttatatttttcagattttggaagatggcaaagttcatgacacccgtgatccaggacaacccctcaggctggggtccctgtgcggttcccgagcagtttcgggatatgccctaccagccgttcagcaaaggagatcggctaggaaaggtacatgcctgtcagcaggagtctgaatctttgcagctgtggctgctactctcgagtccctgtttagattttattgtctcaaaatcttaactcctgaatttcttatagggatgccagctgagaaaggttatctctgggtgtagtcatagaagagctgggcacttacagaggtgttgtgaacaaattctgagactcttccacgctgtcctctcgcgctcagggatttctggttctgcagaaacttgcctggttgacctgtgcattctctgtcttttcttgttcttcgtaggttgcagactggacaggagccacataccaagataagaggtacacaagtaagtgtttctgcaactgaatgccccaatcagggccttgggaaagttgttctttattctaatgaccttcttctgaaagctttttagaatgggaagaaactgccaacaataattcataacttttagggatgtattctgggctttaacaataaccacatttttggaaatagccctcaaaacttagaccattcattaaagaggtctagcctattaaaatggggttttgggcccttttaaaaacctgttgaaaacattagctgggcgtggtggcgtgcacctgtaatcccagctactcgggtggctgaggcaggacaatcacttgaacccagaagttagaggttgcagtgagcagagatcatgctattgtactccagcctggtgacagagccagatcctgtctccaaaaaaaaaaaaaaaaaaaaaagtaaaacccctggttttaagatcctggtaccataaaaaggctttttctctctgccacttcagatagttggaggtggctgcctggagaactaagttaggatagctgaggctgagattggcaagaaagtatatcgtgatctattagacatacctgccatgggcccctgataatggagatggtggttagcaataaatacctcagattctcacacaataacgcagagagtgaaatgggttagtttgagtccttcagattcttggcttagaaagttctttaggccagagttgttcaaaattgaatgtgcatatgaatcatccggggatcttgttaaaatgctggttctgattcagtgggtatggggtgggactgtgagtctgtgtgtctaacaagctttcagccaatgctacaggtctcaagaccacacttgaaatagcaaggctttagactggtgcatatctggtaaagtctgtgggtgcagttactacatgccatcacctttgcctccagataagtactcctctcagtttggtggtggaagtcaatatgcttatttccatgaggaggatgaaagtagcttccagctggtggatacagcgcgcacacagaagacggcctaccagcggaatcgaatgagatttgcccaggtaggccaagagccagcaaccacaccatcttggggctgttactgttggccatcacctgctaaaaaatgctaccttgtgactcctaatgagagagggaagcatattataggtcttttcgtgaatctcgggtcaccgttccataacaagtggtaccaaggtgaacttgcactaggatcagggatgcatttaaatagtttatatttctgtttgccagtagctaggacatcagacttgtatgctaaaaacatttgtgctggataagaaggtgcacctgtgcctgttaccacacttaattgctgtgtgcagactttattaagtagatggtccagtcagattgcctattattatttaaagaggcaaactcagaaaatctaatgagacccagtaaacatacttcaatgaaaaatatatcatgggagtataggtctaagcaaagtccaagcacttaccccctaacacccccaagctgttgatgccgtagagtgaaagcacagagtaagatgtgaaacttgggatttggcatcctaaatttactccaaagacctcccacttgttctgcctattgtgagccaaatctccaagattttaacatggatgtttcttgctgatgcccagaggaacctccgcagagacaaagatcgtcggaacatgttgcagttcaacctgcagatcctgcctaagagtgccaaacagaaagagaggtgagattttcatcctgctggaacaagacacccttcccagactggccgtatttggaaaccacaggaccaaagcaggaggatggttgtattccccaccactgcaaaaaaggaaaatactttctacaaccagttaagcccccttttagcttgtcgttctcaggctggttcatggcagatagcatgggcaggaaactaactccttgtgctggtcatgcgcactaaagggaaacacaggcaggcaagaagaggctctggagcttacctgggctcagttctgctgtgggtcaactctaggaagccccctgtatgctggtcctttgagcctcctggtgttgtgtggtccagcggccactacaccccagattggaactatcagtgaacagtcactatagatgaagtaaaatcatctggtcagtatttggaggcagtgtaccttttctaacacctccagtatgcaccgtctgggtctcttcctttctctaagcccatttttcgtagtttaaaggagttagtggtgatggtaaggtttagctgaagagaatggcagcgtgtgccttttgaagaagccactggtttaaaggtctgcactgagatcatatgtctgtctttccagagaacgcattcgactgcagaaaaagttccagaaacaatttggggttaggcagaaatgggatcagaaatcacaggtaatgtatttataccagaattctgccttggaatttggttctgtttatttggttgtctttattaatagcttagatgagatatacttcacataccgtacaatttagtggtttttaatatatttgaagagttctgtaactggtcaatttcagaccattttcatcaccctcaaaagaatcccttaccctttagcagtcaccctgtcttgatctgttttccgttgctagaacagaatacctgagagtgggtaagttataaagcggtttctttagctcatggttctggggactgggaagtcccagatcaggagccacatctggtgagggcctcatgctgcttgatagcatggcagaaaaagcagaagcgggagcagggtgcaacagagaaaagggctaaactttgggtagttagcccattcctgagagaagggcatgaggcatttattccttttaacgacctaatctcttaaaggccctacctcccgacactgccgcagtagcaaccagattgccaaatgaattccaggaggcacacccaaacaccagcacccccagtagcccagcagtaggcagctatgaatctgttttctgtctcgggattttttgttctagacattttacataaatggaatcatacaatatgtggtctttagtaactggcagcttttatttagcgtgttttcaagagtcatccatgtggtagcatgtgtcggtacagttttccttcagtatatgaaagtctacacattctcaagtcccacattcggcctgtggtagccacatatatgaaaagtcggccctccatatactcggggtttgcatcccaagaatactgttttctttttcttttcttttttgagacagagtcttgctctgtcacccaggctggagtgcagtggcatgaatcttagccaactgcaacctctgcctgctgggttcaagtgatcctcctacctcagccttctgagtagctgagactataggcatgcaccaccacgcctggctaatttttgtattttctgtagatagggggttctgccatgttccccaggctggtctcaaactcctgagctcaagcagtccacccacctcagcctcccaaagtgctggggttacagccatgagccactgcgcctggcttgtattttcaatccatgtttgtttgaagaaaatctgcatattaagtagacccatgtacttcaaacccatgttgttcaagttcagctgtgcttcatctgttgttggtttttttggtttttgttttttgtttttttaagatggaatctcactctgtcacccaagctgcagtgccagtggcgcgatcttggctcactgcaacctccgcctcccgggttaaagtgattctcacacctcagcctcccaggtagctaggattacaggcacgtgccaacatgtctggctttttttttttttttttcatatgttttgtagagacagggttttaccatgttggcccggctggtttcaaactcctgacctcagatgatccacccacctcagcctcccaaagtgctgggattacaggcgtgaggcaccacacccagcccagatgagcttcttttcttgtttattgccaaataagagtcctttgaattatacatcatgttgttttgagccattcacatgctgatgaacatttgagttgtttttcactttttgactattattgatgctgctgtgaacgttcacctgcgtgtgcttgtgtgggcattctgagaacagaacacatgtaagcaaaagtgaagctacattttgttggatatgatgctgtatcaagaatagttaataacccgagagaaatataaaggaccttctacatgttcatcaggtgacatcattacctgggagtggaaccccatttgcttttgaacttttgatccctttggtcctcttccacaccataaattcctgggagtcagggattctgtcttataaaacagtcagcactccatttattgaataaaagctctttttcttttctctcttttattgagacgcagtcttgctctgtcacccaggctggagtgcagtggtgctatctcagctcactgcaacctccgcctcccagattcaagctgttctcctgcctcagcctcccgagtagctgggattacaggcatgcatcaccatgcctggctaatttttgtatttttagtagagatggggtttcaccatgttggacaggctggtctcgaactcctgacctcaggtgatctgcccgccttggcctcccaaagggccactgagcccctccgttttatgtggttgttgtttgagacaggatctcgtgtcactcaggctggagtgcagtagtgcaatcatagctcactgcagcctcaaactcctgggctcaagcaatcatcctgccccagcttcccaaagtgctgggactacaggcatgagccactgcaccaggccagctcttcatatttttagcctgtcttttatttatgttttgtatggactataacttttttttcctctaatggttttcaactgcagaaaccccgagactcttcagttgaagttcgtagtgattgggaagtgaaagaggaaatggattttcctcagttgatgaagatgcgctacttggaagtatcagagccacaggacatgtaagcagcatcttttactactttctacactgctcttatgtgtgtggaccagctggtgatgggtattttcttaagccctagtatttccaaaaaggctttgaagccacttactcaaaacacatttcataaggttaacagaggtatttgaaaaaaatcaagaccggccaggtgcagtgggtcacctgaggtcaggagttcaagaccagcctggccaacatggtgaaacccagtctctactaaaaatacaaaaacttagccgggtgtggtggcacacacctgtaatcccagctactcaggaggctgaggcacgagaatcacttaaaccctggaggtggaggttgcagtgagctgagatcttgccattgcactccagcctgggcaacaagagcgaaactccatctcaaaaaaaaaaaaatcaagaccaaggggaaaagcagaagttcactgactgcaaacttctttttaacttcctggtatcctgaggaaagaagaaatgagttatacaactcttttggcagaaagagaaagcagaatggaatttgctgattattaaactgtatatttctgtttcctggcatcctgagcaaaagagcaataagattaagttataaaactcttgtcaggaaaagaaacacagcaattcttcaggaggaatctttgcttctcctgacatttcaaatagcttcttacctcaaaggacaagtaggtggaatttaggtagtgggaaaccagagcaccagacgagaagtcagcctacccaggtgcttctataactagtcatctcctgtcttagcctcggtcaccctacctttaaaatgggggcgttgggctagatgagttgtgcttgctgtgttctatgccaggtgttaagtggacaggaactgagcaagcactgaggattcgtctctcctgctctggccagagattgctttccacctcttttagacttttggataagacttctggatgtatggcttaaaagaaaaaactgggggttatctctcttactttgcatgtctttgcctgctcttcccacagtgagtgttgtggggccctagaatactacgacaaagcctttgaccgcatcaccacgaggagtgagaagccactgcggagcatcaagcgcatcttccacactgtcaccaccacagacgaccctgtcatccgcaaggtgtgcgcctccttctgcccctctcccccttgttaggaatgctgtcggcttctacagctgaagctgcagaaagaacagaagacatgggaataacgtatgtattataggtaaaagcactttgccaggtagaccggaaatgtggatgttaagcacagctggacttgaagcccagttctgccgcgcttcctggcttagtctctggagccttagttctctcatctgcaacaaggggtagatgtacatagcactaccactggggcaaaggtgaaagcatctgaagcacttggctggaatctagcaggtgcttagggtgctgcagtgccactgccacccgaaacttgctggctcactggctgcagtgtttttggtcaatgaggtggggcctccttattaaggatttatgtggtcagcaaaggagttctttcccatccatgtgagtgggcagtgagacctgggagtgtctttccatcttctctctttgatcctctttgcagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttggtaagaagcgtgcctggggagcaactcaaaggcattgagtatttttgttggtacagaacaagtctctggtactagagaatggatagaaagtggtctgtcttcccaagggaattgacagcagcagtgtctgaatctcccacactctttagaggttaggagaagagactgtcactgcagtacctgcttgaggcctcagcttttggagtcctcacagcaccctaatagcaagcttccaaatgttgcttttttgttgtttttttttttttttaattgagacagagagtctcactctgtcacccaggctggagtgcagtggcgcagtcttggctcactgcagcgtctgcctcccacattcaagtgattcttctgcctcagcctcccgaatagctgggattacaggcatgtgccattacgcctggctactttctatatttttagtagagacggtttcaccatgttggcgaggctggtctcgaactcctggcctcaagtgatccatcagccttggcctcccaaagtgctgcgattagaggtgtgagccaacacacctggcccaaatgttattcatttaaatacccctttttcgacttttgccatcttgcataccttgttcagtgtttgcttactgtatatacatatatattttttataccatacatatatgtatttatacaccataaaggaaaaccatgtcactcaaaaattaacaaaacaggctggacacggtggctcacaacctgtaatcctgccactttgggaggccgaggcggagaatcacttgacatcaggagatcgagaccaagcctggccaacatggtgaaacccagtctctactaaaaatacaaaaattagccaggtgtggtggtggacacatgtaatcccagctacttaggaggctgaggcaggagaatcgcttgaacccaggaggcagaggttgcagtgagccgtggacacaccactgcactccaacctgggtgacagagcaagactccatctcaaaaaaaaaagtgtttatattctgagcctgaagcctgaggtctttattaaaaagcttgcaaaatcattctcttgaggaatccaaaacgactgaaaagggacagcttcgttactgtgtgattgaattgaatgttggacagtatcttgagttatcctggagcagctgccccactcccccgcttatgtgttccacaccagggagacccactttaggagagggcagttctttgaaggaaggacttgtgttgtttgcctctccacatctccccacagcgctgcgcacattgtcagtgactctttgttgcatggtgagtgaccatgccacgcttttgcagacctcctgacagtgagtgagactgccaatgagccccctcaagatgaaggtaattccttcaattcaccccgcaacctggccatggaggcaacctacatcaaccacaatttctcccagcagtgcttgagaatggtgaggaaacgagtctctgggcattgattcattcttatttaatcagctgctgtttgtggagcatctgctttgtgctaggctcttggttgtgggactgagcaggtcagacgcagtccccacctttagcaggggagttacatgcctgggcttggatgttaggctctctgactttgaacaaagttcctgcccttacagaatttaatgatagtggaggaggaaacacagtgaacaataaataataaattgatttacatcaaatggtgaatatatgccatggcaaaaaaatgaagtagagatgagcatggttactaagtcattgttctaattcatcaggtgctaacagttgggaggggtcaagtaggcacaaaacaggcagcgagctcagagccccatcaagggccccaggaacctggccagggctgcaactaagcagaggtgctgggtctgactgattggccttggccttgtcaacaaagttagctctgtcttgtgacacctttgtttttgcaggggaaggaaagatacaacttccccaacccaaacccgtttgtggaggacgacatggataagaatgaaatcgcctctgttgcgtaccggtaggtcacctctctggtgggtattgtggccagactggagcacgggccccactctatagaatccccagtgaccacatgagtttcttttttgctgcagttaccgcaggtggaagcttggagatgatattgaccttattgtccgttgtgagcacgatggcgtcatgactggagccaacggggaagtgtccttcatcaacatcaagacactcaatgagtgggattccagggtgagccgccatctccatcaccctcctggtgacaccatgtctctattccctacagtgcctgtttacgcaggctaggttgtataaactgtttcttatcccctttcgttacttatagagctacctggatgtttttttttgtcttgtgagttttttcctctgcttagttccttgctgagaaagagcatgactgtgtgtgtagaactatgttaagtgttaagaacttttctgcttattttttacgcaggaaccagttaactcccttcttccagtactttcttcatctctgttccattgtggcctcctgttgacttctgctccctgagcatctgattttttcctctccttattatctgggttggcagttttcctgtaagtctggccgctcttctttttgacctcttctttcattgactgagccactgccttcaatcttttcacacattttttgcaattcctcatttctttaactcatggattctaagatctggctcagaattgactcttcagaggcaccttgaaagaaacatgcttccttcacttttcctcctctatttccaccccacccctcccaatccgcccccccgcccacatcacctgttgaaagagcacactggaaggtttgccgctctggggccagcggccttttcttggatttttcctggtgagctccccaaagcattcagggccgtcgtgcctgtgtcgttttgccgtctgtgttaccgcgttactctggtctcacccgtttccctgttccgtttgcatgtcgtctttgctggctcccctcctttttgatcccagtggagtcacctggacagctctcttcgccatacatacttctgtattatataactttgtattagttttctttcgcaccataacaaattaacagaaacttaatgacttaataccgatttatgtattttacttttattttttattttatttttctgaaacggagtttcgctcttgttgcccaggctggagtgcaacggtgcgatctcggctcactgcaacctctacctcccgggctcaagcgattctcctgcctcagcctcccgagtagctaggattataggcatgcaccaccacacccagctaattttgtatttttagtagagatggggtttctccatgttggtcagactggtcttgaagtcccggcctcaggtgatctgcctgcctcggcctcccaaagtgctgggattacaggcgtgagccacagcacccggcctaacaataccaatttattagctcacggttttgtaggttagaagtccagtgctgtgtgcttggtccttgtattagtccattgtcacactgctgtaaagaaatgcctgagagtgggtgatttataaagaaaagaggtttaattggctcacagttctgcaggctctagaggaagcgtggctgaggagacctcaggaaacttgcaatggtggcagaaagcaaaggagaagcaggcacatcatggccagagcaggagaaagagaggggggaggttggtatacacttttaaacaaccagatctcttgaatactcttaccacaagaatagtgccaaagggggaagtctgcccccatgatccagtcacctcccaccatgctcctcctccaacattggagtttacaatttgacatgcagtttgggtggggccacaaatccaaacaaggcagaaatcatggtgtcaatagaaatagaactgagttctcatctggaggttctgaaagaaaagccacttccaagcccattcttattgtgggtaaagttcatttccctgcagttagatgactgaggcccccatccccctgccagttgtcagctgggagcctctcttggctcctagaggccacctgcattccttgtcacatggccccctccatctccaagatagcaacagcacatcagatccttcttgtgcttcagatctctgacttcctccgtctccgacctctacacctagatttaagagactcatacggttgggtgagcccagccaggtagtgtatattaaggtaaactgatttgcggccttacatctgcaaaatcccttttgacatacaaggtaggatgatcatgggggtgatacttgatcctagccataggttctgcccgtagtcaaggggaggagactctgcaagggcaagggtcactgggggtcatcttagaattctgcccatcccaggcctcaaccatgaactctttgaaaatgatttctcaaatctactctgatttattatacttcccattgtttttctgctaaaacaccttccccttccatgtgtccccagtcccgtcattgcctctgggccagctgtccatcagcattgtctttcttccacctaagctctgagcctccaacatctccaacttcttttttacattattctgttttgctgttagcaaaatagaaggctttgctgtcttctgaatctgtcctggatttcactgataattgccctagttcagggccccatttcatcatgcctgtttgacatttgtctcctaactgatttctctacctccacccaacttctatatttgatttatctccgccagtcaattgtccaatacacgcttcatcagcagtgcagattgggagaagaattctaacatgccccagcaagctgtatgcagtagtatgcacctatagtcctagctactcaggagcctgaggtgggagaatcgcttgggttcatgagttcaaatcctgaactcaccagcttgggcaacatagtgagaccccatctccaaaaaatgtgccacagcaaactcacaggagtgctgcaggatattttaaattttttagggaaacacagagacatcttgtcagaatactaatacatggtttgaccctaactaaataaaaggaattcttggccgggcacggtggctcacgcctgtaatcccagcactttgggaggccggggcgagtggatcacctgaggtcaggagttcgagaccagcctggccaacatgatgaaaccccgtatctaccaaaaatacaaaaattggctggacatggtggcgggcacctgtaatcccaactactagggaggctgaggtaggagaatcacttgaacccgggaggcggaggttgcagtgagccaagatcgtgccactgcactccaccctgggcaacaagagcaaaactccgtctcaaaaaaaaaaagaaaaaaaatttaaaagaaattcttgagtatttcttttgccctgtgtttgccatgaaccaagaaagtttgggaacctctgtcatgtgacctttgaccagtcatttcactctgggtccaacttcccacgtctacaaatgatatgggtagaaaagaggatctctctggggtccttttctactgtgtgtgcatttatgtaaaatgtcagactcagctttgcacccactgcaggcttccacccccatctaaggccaactctgcctgtctttcctatcccaccatgcctctcagatcaagacctcctggctacacctgcacttgagccaatattctccacttggctcactgttacacgtcctctgtgaagcccttccttaccacgcaacacatagtaaacacttggctctgctgtttatatgacacttctaaagtgtgtgtgtgtgtgtgtgtgtccgtgtgtgtccatccatcattccctgtctaggcgagcttttagaagagaggaattgtaagtcgttgagtgactgctgtgcggcaggctgtgcaagggaagggactatgtctttgtctcttaaatggtaagatttagtgcgtacctacccactttctaagcaagcagactagggagttccttctctgccagaggaggtcccagcaccttgggcatttggagcttgcttctgtttctctaacggggctctcctgcagcactgtaatggcgttgactggcgtcagaagctggactctcagcgaggggctgtcattgccacggagctgaagaacaacagctacaagttggcccggtggacctgctgtgctttgctggctggatctgagtacctcaagcttgggtgagattcctgtgcaggagctggcagctgatcttgtgaaaggaagggtctgggtagggaggttgaccctcccctccccgtgtactggacaattgactggcagagataaatccaggggtggggtagagatggaggggtcagttaggagacaaatgccaaacagcaggcatgctgaatggagtcctgaactagggcaatggtgtcaatgaaatccagaactgagaactcagaagacgatgttttccctttcccttgaaaatagcagtggactgccgggcgcggtggctcatgcctgtaatcctagcactttgggaggcccaggctggcagatcacgaggtcaggagatcaagaccatcctggctaacacgatgaaaccctgtctcaactaaaaatacaaaaaattagccgggcgtagtggcgggcgcctgtagccccagctactcagggggctgaggcaggagaatggtgtgaacccgggaggcggagcttgcagtgagccaagatggcgccactgcactccagcctgggcaacagagccagactccgtctcaaaaaaaaaaaaaagaaaaaatagcagtggaccaggtatcaccatttaattgacatttgatcccaagtgttgctgtctctgtgctgccctgctctgaccactgatatcccttcccctgttagttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaaggtgtgtagcagcccactttctgaggtctagagtgatctgtgggctagcacgggagcaagctctgtagccattgtgatctttaaccttgataaaacttcgagaattccctgagacttaagtatgaagaagcattcactttggctccaagagcttcttctagagcctttagatcacatcaagtggttggggaggatagcggtgttttagagaagcggctggactgtggcagaggtagaggaagatgagggaagtcccagattgaagccggtggtctagagggaaaagctccgctccgggttaaatagcctgaaagttgtctctcctgctccaccagctggtgactgaaggaaatacctgcccagccctgtgagcatctgaaaggcttaacttcggaatggaagtgttgaaaactcacgcacagtccagcagaggttcagaaaggaaagtgaacatcatatcacacaacctggctcatttctcttacattttttgtgtctttcagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttccctcat

SEQ ID NO: 7123 - DNA, 140 bp, Homo sapiens
gagtgcagtagcatgatctcggctcactgcaacctccacctcccaggttcaagcgatcctcctgcctcagccccccagtagctgggattacaggcatgcaccaccatgcctggctaatttttgtatttttagtagagacg

SEQ ID NO: 7124 - DNA, 1628 bp, Homo sapiens
aaatcgcctgaagatagtctttcaaatttggacatttaaaaaagaaacttttactgtagtcatgaagtagtatcaaagtttaccacaagtttgtattgagagaagaacaaacaatatatgctaatatgaaaaacagctctacttagaaagctactgcttgggttttcttattaggcatagttctccagactgagttggttttactcatctacatgatttttccttgccttatggaacagaaattcaggcccactcgaattcagttattttagggctctttaaaatccagtatttgtgatttaaatgatgcggagggactttcattacctgtgtctttgcttatttctctctggccctcagaacaccccaccctgacctttaggggaaattgacagaggcagagggtttcacctgcctcaattgtcaccagccctgttacattcttccttccaagccttagcctcacagggaccttctcattattgaacaattgccttcaaagcagtagaatagcccaattgttatggagattaaagataccgattgcaaaactcctgtaaataaaatcttcactgacaaacccagtttcttttcataggcttttcttctgtaatctctttctggcagaacatctcatgttttgatgttagagattcagttaccaaccacagtaaataaagcaaaataataatagaaaaatagtatagaactcaccctaaaaacaaacattggccaaccatgtttattttttgtctctctttgcactcctgagaattgataggggaagaatgtaccacctctaattcaggtgatttctgattagcaagctatggaaagtcttcaggttgagttttagccagttcacgctcccctaaatggcatggaatagactattttctgttttaagaaaaaatagaacaatggcactaaatgcttgactgaatgtttgactaaatgttgactgaatcatggataggaaagattgggcagaaaagacagccactgcctccagacacaggatgccacaatcctgggcaccatcattattccatacaaccttagggtcatttttagggtttagaactttctcaatagggtttcaagattttgaaaagtgtcttccaattctgatctccgtagatcctgttatgggaattaacctttttggaaggggattcttgttcttaaagatgaaattccctactttctttcctggagggaatcagtatgggcagagggaagaggagatggcgattctgacctgtgtgtctcatgtcacctaacacctatggggtggcatgaaacttgagctttaaaacacaccaggggccaggcacagtggctcatgctggtaatcccagcactttgggagaccgaggtgggtggatcacctgaggtcaggagttcgagaccagcctgccaacatggcaaaaccccgtctctactaaaaatacaaaaatcagctgggtgtggtggcgggcacctgtaatcccagctacttgggaggctgaggcaggagaatcgcttgaacctgggaggcagaggttgcagtgagccgagatcaggccattgtactctagcctgggtgacaagagtgaaactccatctgaaaaaaaaaaaaaaaaaaa

SEQ ID NO: 7125 - DNA, 526 bp, Homo sapiens
gtagccacacagcagcctcaatgctttgctgcttaagtatttcttccacaaatatcctagttcatccctcttaagttctgcattccattaagtcctaggacacagacacaatttcacccagctctttgcaaccttatattttataaatatggcctttactccagtttccaataccttgttcctcatttctatctgcagcctcatcagaatggcctttaccagcattctaccagcactctggtcacatacacttaagtaatcacttaagtaatctctacgaagatttagacttcccctagttctaaggtcttctttcagagccctcaccagaattgcccctaatggcagaaccgttcttggcaatgcaggcttttttctagcctgctcctccaaacttgttcagccttcacggttatacagttccaaagccacttacacactttcaggtatttgttgtagtaacaaccccacatcttggtaccaactttctgtcttagttcttttgttaaatgcctgagactgggta

SEQ ID NO: 7126 - DNA, 8125 bp, Homo sapiens; identical to SEQ ID NO: 7027

SEQ ID NO: 7127 - DNA, 5786 bp, Homo sapiens
cgcaggacctcatgagtaagctgtggcggcgtgggagcacctctggggctatggaggcccctgagccgggtaagcgcgaatagatcaagcaatttaggtcgtgttagaaaagaagtcccgttcttgctcctcggagagtccagggtacttcggccacaggtggcaaggagaaaggcggtgctgttgttatggtaacagcgagtactgcgggaagggtgggatccagtaggggcttaggttattcagggcttcccctgccaccctccggccaaacactgtcgacaggctttccttccacaggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagaggtgaggccaagagggtcatagttttataaggggaactttaggagcagagatagtagttagaagccgactgggctttctagaagaccgaatggacactgtgacttcagggtccagatttaggcagcaagagtctaagagggtggggaaagttgggtgtagctacggagtaggaggaggagacgcttgctcattttaaagagtagtgttgcttctctgcagtgttcctaccttcactgtgatcccagaggggcctcgctcaccctctccccttatggttgtggataatgaagaggaacctatggaaggagtcccccttgagcagtaccgtgcctggctgggtgaggatctggaggtggggaaactgggtttcttattatacccgcctaaagaaagaaggttggttctgaaatgggttaggattttccatgtcccagtattaactcagccaaattagggtgccccatctgaacaattctgtttttctttctccaacttccttcccagatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacaggtatgttggttcattgtttattcactcaccaaatgtatacagtattgagaactctccacgacccacgcactttgcgtggcattggggatatcgatagtagagaaaagacaaagtttctgttctcctggagctagtattctagtgtgtgtgttggggggctgggaagtaaataagtaaataatttcaaaaagctatatggtttatgacaaaaagaaaagggtgatgaaatagaaagtggcgtaaacaaacagatagaaatgatggaagagagacattagggtagttagagaaggcttctttgaagagataacatttgcaataccagaagagcttttgagcagagaccagcaggcgcacagaccttgagactggaacatgtctagcaaaggagaagaaaaagtggacaagccactgaagggctgtacgcagagaagtgacatacttggtttacatttcaatagattactttggcatctttgtagagaatgaatcttcgtggagacaagagatagaagtatggagaacaactaggaagctgttgaagtaatcagctgagaggcagtggttgctttaaccaagacgaaagtggtggagatggagaaaatcagatgaattatggctatattttggaagtagatacttgtggggaggggaatggagagaaaatatatcaaggctaagcctgggattttggcttgagcagttatccacctgatactctctattgagataagattaaaaataacaacagacctctgggaaagctggtacagttttggtgcacaggtcaggcaggtaacattactgatgcttctccccttgagagataaggacctaaagctaaatgtcaggagatctgggaggaggcagtatttatgaagaggaacctatggaaggtgtcctggagagggtgctcattaattaatatcccgcctccgaaggcctgcactgctcaagaccctgccttccatgtcccttctttcccctcccccgatctggccgacctcgcctctccatcttcctccattttcagacagcaccccgtctctgtctctccctagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcttcggcttgtacagaactgggggagtgggatgttgtgggcagaccagtctccggtatacacgtattttgcccctgtcggagcttgcgtcgatgcctggggcttggaaaccaccgcaaaaaaccaggctgcaaaccagcggaccgacttttgggactccgcctcttccagccgggattacctggcgtgcttcggcctttggcgtcattccgaaaacataccgcaagccaatcagcggcaaccttgctcttcggggcggctgttcgttggttgatatgccagagcctgttctgttgtctgtattggctattgccgctgtcagtcagggccgtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcaggtatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgcgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacagggtgggattgtgtatgtgcatgcaggaggtgggggtggacagtgccctgggctggaatcccccttagttctaagtgcctccttgcccgcagcttcgagagctgtgcccaggagtgaacaaccagccctacctctgtgagagtggtcactgctgcggggagactggctgctgcacctactactatgagctctggtgtaagtctccaagagggctatttccaggtccctgtgtccaccctcccttggacctcagaatttcggccttcagggccccttctctgcatgaaagatgcctgagttgctccctccttgcctcttgcagggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgtgagtgacttgatgccctgggtcagctaccagtggccctccccaaaccagaaccccaaatcgtctcacattcccttttccacacatttcaaagtatttttccctaatataaaaactagcaccctatacctggttgtcttcaaccaatcatgccaattttctcccctgcaggcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagctacttgtg

SEQ ID NO: 7128 - DNA, 4332 bp, Homo sapiens
tagagttcaaaatgttttttccaatttatttagaaaaatagactctggattcacattcaccccagggctatgtgggatgacagcaaggagacacctgagatgaaatgaggaaggtttgaattactggtatccaaggggctgggggcaaaagccagaagcctttgtcccttcagagccagagtggcatgagtgtcttggctcccctcctctccctcccttcagtagtcttcagccatggccagtaagacaaggctggtccagccgtggaaagggcggcagcccatgcctcgcccatcgcggtcactgtactgctcccaaagaaagcctgtagcctggtactggcgccatacattgcctaccacgttggcacggagctcaccgtggagtttggcagcccgagcctggtgaggaccctccagatgcccatagtggtggagtgctcccaaagccaggtagttgacattgagccacacagcaccccgccagtaggggggatcatgctctgaattgcgctggccataaaaggagctggaggctgcaagggagcgtaaaccaaaggggctccagagatggcggctgtcggctagaatgtccagcaggggcccaaggcgggatgaggtggggtccagcagtcgcagcagcaagggaaaaagactgacatagccaagagcatctacatactgcagttgaggttggggccgacccaccacccgaacgagcccctgagggggcctgggcttcagctgtactgcttttgtgtggttcccaaagtctgcaaagactcctagctctggggcccagtgcagctcatccaggctctctgctgcctccagtgaggcagccagtgggcccagctcagcagctacctcagcctcacccagatgctctgccagccgcgtcagcacacgggcacccagtgccacccaacatcgcaggtccaggtgccgctcggttactgaagggtgtgaagcccgggggtagtcatccagcccagagggtagggtcttggggttcagtaaggttggtaaggcagggtcccgtccccgccagcggtaagatagtggcagtgggcctgcctggctctgatggagccaggaaaaccaggcatgcaggcggggcaaggcctttcggaggaaagccaagtcgtcagggtcaccaacctctagcatatgggctacaggcaaaagtagggttggggggttggcgtggactgctcgttgtactaggaattctggaggcacccgggctcgggcctcatcccccagtatctgctccctcccaatccagccatcagcatttagcagccccagccagtggccaagggcttcccgggtgagggagggatcccaccgctgaaccaccagctggtgaaagccttcatcccaaaggaagcctcgtgggaagaatgaccgggagggcactgctgtaaaaagaggtacgggtggaaagagggctgggtccaccttctgctcagacccttccaccccgatgtctggcaataccagcccttgtccgtagaagtagccaattccaccaaggaggccgctgagggcagcctgacccaaaacctgctcgccagagctcaggcccttctccttcagctggaaggtcttctcaaagcgctctctaaagccttcagcatggctctccagggcctgggtcagtagactgcctgccagtcttggcagggcttgatttcctcctgcctgggcactgcctgattcaaacacaaactctatggaaatgggaattttcagggtcacctgctgtatcaagaactgcccctgcccttgcccacttggacctctgtcctcccacttcagggatcctggcaagccgaggtagcgttcagggggggcccctgggggccgatgctgaaaccagctatttaggcgactctttaccatctctgtcagcaggggcagtcctgggttggaggtccagaagacattgtagcttgaaggggagaagataaataggaaatattattcaagagaaggcagtgggcattataaagagaaatacaaagtgttcaggagtcaggttgggaggtctcaggcaggggacatggagactggtgaaaatgggaataaccaccccttccatcccccaacattcttttcccccagttacctgccatacttgggggctgtatcccctggactggttggtggcaaaagtgtaaagcggaagtcaccaagttcactggtgtgcccactgataaacttcaactgccccttggccccaacctctggtagtaggacttccttgccatctgtcaccacatagaagaacagggagaccaaagggagggcagaagtacctgagtcctgagtgaccaacgaggacagaaaagaacagtgttagattggcattctctcttgaattccctcttgagaatcagccttagtgagggaaaggaacagtaggcaggggtaatgtaaacaacatacgtctggcagtaatgagggtcactgagggtaaccaggtacacccaagcgggatgagataaagagccttgcactgggtgccctgggagataacagtatacttttgtactatgtcctacactaagaactctacacagttgatttcatttaattctttttttttttttttttttttgaggcggagtctcgctctgtcgcccaggctggagtgcagtggcgcgatctcagctcactgcaagctccgcctcccaggttcacgccattctcctgcctcagcctcccgagtagctgcgacaataggcgcccgccaccacgcccagctaattttttgtatttttagtagagaccgggtttcaccgtgttagccaggatggtctccatctcctgacctcatgatccgcccgcctcagcctcccaaagtgctgggattacaggcgtgagccaccgcgcctggcttttttttttttcttgagatggagttttgctcttgttgcccaggctggagtgcaatggcacgatctcggctcagcgcaacctccacctccctggttcaagcaattctcctgcctcagcctcccaagtagcttggatcacaggcatgcgccaccacgcccggctaattttatattttcagtagagacggtgtttctccattttggtcaggctggtctggaactcctgacctcaggtgatccgccagcctcggcctcccaaagtactgggattacaggcgtgagccaccgcgcccagcctctttttcatttaattcttacagtcctgtgagttaagtgctattattatctacattgtacattttacaagcaaggaaatcaaggcttagagatggtaaatagaaatggttatacaggcagttgtttaaggcaggatttaagccaggcagccagagcccacttcatgctgcatttgctggcagcaagggaaggatggagggggtctgggctgagaaaagggtgtcctgaggccctgacctgaggctctacagtcactctccagctccagtcccctccgtgctgacccccaggcctcttgacgaactcagtggtgagccttaaggccccatcctggatgtgttggcgcccgaaggagaggccgtcgtggaactcccagccatagggacccacaccgtccccctgctcacacgtgtgcctgagcttaggagtccccggggtggtgccctgctgcgcccacatcagtcctgggggtagaatggccacgtaagtcaaagagcaggggacctgtccctccgggtctccgggtcatccctcttcataactctcctgatccattccttcccacccttgctctcgcttcaagctggggcgcccagattaggagtccgcctgcctgcccgccctggggcccggttaccggtgaggaggggcttcgggctgcgggtcttcatgccgaagtagacgtgagggcggtaggttccccagaagaggtccggggccacggcggggctggaggagtcggcaggcaacacaggaggcgcggagtgcagcgtgaccgcccgccgcgcacggtaccacgccagcacccagcgccccgacatacccagggccaaagacaggaccacgacggccagagccactcctccagccgtgctacgcggcccgccgccccggccgtcccgtcgcccggggcctccccgagccgccctctcggctgtccgcactccctctgccggcactgcgcggcgccgccgctcgccccgagccatcctggcactgaggtccgcgtcacaagagctcggagaggcggcagtggagcccgggtcctgcctcacctctccggctcccgcctctcgccctggcgaccaccgtccggttagcgacacctgccagccagcgcctgcgcctcc

SEQ ID NO: 7129 - DNA, 143 bp, Homo sapiens
tgagacggagtcccgctctgtcgaccaggctggagtgcagtggcgcgatctcggctcactgcgacctccacctcccgggttcaagcgattctcctgcctcagcctcccgagtagctgggactacaggcgcgtgccatcacgcc

SEQ ID NO: 7130 - DNA, 1936 bp, Homo sapiens
gaacttgagttagaagaacctcagctctgtagtgatcttattttactgttttcccaggataaaatgcccttggtaccacatactgtatgcagagtatttatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggtgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaataaaaaaaaaaaagtcctggaaagccagaattttgctaatatcttacatagaatctcaatgatgggaattgggagtagaaggcagagagtggtgcttggctgatggaagttaaaagttgggttaataataaactacatttatatatcagttaacagcttgctaagtgcccacatattatttgagcttcatacttgcttgctgagaaagaatggctattattatcattatcatcattaccactttccattttatagataacaaaactgaggctctgagaatttaaagagattttccccaaatcattaaacggtgacttctgaatctggatatatgacaagacctctgtccccagtccccttgctttcacctctataatatatagtagctaagctcagctttctgagaacttccctgtcttatgtcatatttgacattataggagaattgaagatgttttgtaagtacatactttgtttactacctcagtagccagtataacaaatggcactgaagttttatgctttgcttgctaaaaccagcaccatttgtgaaacaggtcttggctccgagttacccttaaatgtaactcctttattataaaatcatttgcaaagagctgcagagatcaaggaatacactcttcccacttccctaatgccaggtagtactatgacaggacttcatagtaccacttcttcaacaaaataagtgtctgcagtgaaatatttgttaaaatgcacatttctcagtgaatatatttcttttaaaactgaaaaaaatagtacctaacggaaattttatcattgctttaaaatgtattttaatgaagatattaaaaaatacctttgatggattcttcaatattgtcgaactgctcaaaatgattatactgttatatgaagtctaaaatctttcatgcaacttacaagaatatttttgttgtatgcaacacagttggaaaattctagtgggaccatgtccatgcaattactgattatgtaatgctgtaaatttttgataagcatgttccaagttttcctgttctaaaaacaaaaacattaaaatcacccactgttgaagacaaaagatcattactttattaggagatattattagatatgtttagaactagttaaaaaaaaaaagtaaaagact

SEQ ID NO: 7131 - DNA, 1936 bp, Homo sapiens
gaacttgagttagaagaacctcagctctgtagtgatcttattttactgttttcccaggatagaatgcccttggtaccacatactgtatgcagagtatttatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggtgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaataaaaaaaaaaaagtcctggaaagccagaattttgctaatatcttacatagaatctcaatgatgggaattgggagtagaaggcagagagtggtgcttggctgatggaagttaaaagttgggttaataataaactacatttatatatcagttaacagcttgctaagtgcccacatattatttgagcttcatacttgcttgctgagaaagaatggctattattatcattatcatcattaccactttccattttatagataacaaaattgaggctctgagaatttaaagagattttccccaaatcattaaacggtgacttctgaatctggatatatgacaagacctctgtccccagtccccttgctttcacctctataatatatagtagctaagctcagctttctgagaacttccctgtcttatgtcatatttgacattataggagaattgaagatgttttgtaagtacatactttgtttactacctcagtagccagtataacaaatggcactgaagttttatgctttgcttgctaaaaccagcaccatttgtgaaacaggtcttggctccgagttacccttaaatgtaactcctttattataaaatcatttgcaaagagctgcagagatcaaggaatacactcttcccacttccctaatgccaggtagtactatgacaggacttcatagtaccacttcttcaacaaaataagtgtctgcagtgaaatatttgttaaaatgcacatttctcagtgaatatatttcttttaaaactgaaaaaaatagtacctaacggaaattttatcattgctttaaaatgtattttaatgaagatattaaaaaatacctttgatggattcttcaatattgtcgaactgctcaaaatgattatactgttatatgaagtctaaaatctttcatgcaacttacaagaatatttttgttgtatgcaacacagttggaaaattctagtgggaccatgtccatgcaattactgattatgtaatgctgtaaatttttgataagcatgttccaagttttcctgttctaaaaacaaaaacattaaaatcacccactgttgaagacaaaagatcattactttattaggagatattattagatatgtttagaactagttaaaaaaaaaaagtaaaagact

SEQ ID NO: 7132 - DNA, 1932 bp, Homo sapiens
gaacttgagttagaagaacctcagctctgtagtgatcttattttactgttttcccaggataaaatgcccttggtaccacatactgtatgcagagtatttatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggcgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaataaaaaaaaaaaaagtcctggaaagccagaattttgctaatatcttacatagaatcccaatgatgggaattgggagtagaaggcagagagtggtgcttggctgatggaagttaaaagttgggttaataataaactacatttatatatcagttaacagcttgctaagtgcccacatattatttgagcttcatacttgcttgctgagaaagaatggctattattatcattatcatcattaccactttccattttatagataacaaaattgaggctctgagaatttaaagagattttccccaaatcattaaacggtgacttctgaatctggatatatgacaagacctctgtccccagtccccttgctttcacctctataatatatagtagctaagctcagctttctgagaacttccctgtcttatgtcatatttgacattataggagaattgaagatgttttgtaagtacatactttgtttactacctcagtagccagtataacaaatggcactgaagttttatgctttgcttgctaaaaccagcaccatttgtgaaacaggtcttggctccgagttacccttaaatgtaactcctttattataaaatcatttgcaaagagctgcagagatcaaggaatacactcttcccacttccctaatgccaggtagtactatgacaggacttcatagtaccacttcttcaacaaaataagtgtctgcagtgaaatatttgttaaaatgcacatttctcagtgaatatatttcttttaaaactgaaaaaaatagtacctaacggaaattttatcattgctttaaaatgtattttaatgaagatattaaaaaatacctttgatgaattcttcaatattgtcaaactgctcaaaatgattatactgttatatgaagtctaaaatctttcatgcaacttacaagaatatttttgttgtatgcaacacagttggaaaattctagtgggaccatgtccatgcaattactgattatgtaatgctgtaaatttttgataagcatgttccaagttttcctgttctaaaaacaaaaacattaaaatcacccactgttgaagacaaaagatcattactttattaggagatattattagatatgtttagaactagttaaaaaaaaaagtaaaa

SEQ ID NO: 7133 - DNA, 21982 bp, Homo sapiens
gagaccatggcgagcccagggaaagacaattatcgaatgaagagctataagaacaatgctctaaaccctgaagaaatgagacgaagaagagaggaagagggcattcagctccggaagcagaagcgagagcaacaagtgagttaatgggagtattctcaaacatactattctgggaaacaagcccctatggttggcctccaccatgcaccctgacttgccctgtagaaaagtagcttactaggtgggcatggtggctcatgtctgtaatcccagcactttgggaggccaaggcaggcagatcacctgaggtcaggagttcaagaccagcctggccaacatggtgaaacttcattttctctactaaaaatacagaaattagccggacgtggtggcatgcgcctgcaatctcagctacttgggaggctgaagcaggagaattgcttgaacctgggaggcggaggttgcaggagctgagttcgtgccattgcactccagcctgggcaacaagagtgaaactccatctcaaaaaaaaaaaaaaaaaaaaaaagaaaagtagcttacttactgagtgagctactcatccagtttcctttgttgtaaataaatgttgggagctttgagaaagagaaaactgaccttatccccttttcacaagttagaccaacttagacatcatttatgtctttactgtaacattctagttctagttccttgttaccttttcttttcttttttttttctttttttttttttgagacggagtctgattctgtcacccaggctggagtgcaatggcacgatctctgctcactgcaacctctgcctcctgggttcaagcaattctcctgccttagcctcccgagtagctaggattacgggcatgtaccaccacgtccaattaactttgtatatttttggtagagactgggtttcaccatgttggccagactggtctcgaactcctgaccttgtgatctgcccagatctgcccgcctcagcctcccatagtgctgggattacaggcgtaagccaccacgcccagcctgagactataataatgcctcaccatctgcactcctacgccaccccgccaacagattcagtcacctgattattattatttatttatttatttatttatttatttatttatttattgagacaaggtctcactctgtcacccaggctggagtgcagtgagtgcagtgagtgacatgatctcagctcactgcagcctcaagctcccgggctcaagtgatccttcttcctcagcctcctgcatagctggactataggcatgtaccaccacgcccggctaatttttgtggattttttttttttttttttttttgtacagacagggttttgccatgttgcccaggctggtcttgaactcctgagctgaagtgatccacctgccctggcctcccagagtgctgggattgcaggcatgcgccactgtgcctggccaacctaacctgattttgcccacccttttgctatactatcattcctttttttcttttttttttttaagacaggatcttgccctgttgcccaggttggagtacagtggcgtgatcttggcccactgctgcctctgcctccaagtccttgaatatcttttccatgttagtaatcaatagtctcctcttctctttgtggaatacattccaggacccacagtggatgcctgaaactgcagatattactgaaccttacatatactatgttttttttcatgttttcatctttttacttaaaggaagcactttacagcttctctttggcacatttgaattgccagcatcactactcttgcactttgtggctattactaagtaaaataagggttacttgaacacaagcaattgccacctgataaccaagttggttattaagtgactaactggcagcagcgtatacagcatggaatggatgcactggacaaaggatgttcacatcctgggccagacagaacaagatagcgtgaaacttcaacactactcagaatggcatgcaatttaaaacttatgaattgttcatttctggaattttctgtgtaatattttcagaccacggttgactggataactaaaataatagaaagcaaaactgaataaggggagactaatgtataaagcttggcctcacttctcagctactctagtatatccttgtcagttatgccataatttaacattggattgttctttgttttctttggttcagagagtactcttaaccactgtctctttactttcagctttttaaacggagaaatgtggagctgattaatgaagaagctgccatgttcgatagtcttctcatggactcttatgtgagctctaccactggggtaaggcccctgcatgtgcctcaggctgacctggaaaacacctgcttctaaggacagaaattgggccgttcacatcatctaccagctttgccagtaaccatgacaagttctttcctctgtggaccctttcgtcagctttaggagtcaacaaagattcaactttgttagatatatctgaggaaacatttaagagaagccatcagttgcctcagaattaggaatcacttttcaaatgtcccaacttgaagcacctatagattaaacagaccccttctcctgagcctattatgccatcctcttgccctcagttttttagaaaacaggatgccaagcagtattatgtgctcacatctggctctaatgttggtttgcaaagtcctaaacttgttttatgttctaggagagtgtgatcacaagagagatggtggagatgctcttttctgatgattctgacctgcagttagcaaccacacagaaattccggaaactgctctccaaaggtacaaagcctggcccttgtcagagaggccttatatgatttagcctcttttctcttcactgatgtcatcaacttacacgtgccctcactcattctgctctagccctactgaccttggtgttgcttgtacaagatagacacattgctaccttcacactggatacttcctctgcctgatgtcctctattcccagatatctttgtagcaactcccttactcctatgattaaatcccaccttcaacagttttatctttttaccttgccctacatattctcctcctctccccccattatatttatcttctaacataataaaatgactcttcccactaggatataaactctctgagggcagagacttttgtttttgttccctcctgtgtcctctgtacctagaactgtgtggcacaccataggtacttaataaaaaaatttaatgtatgattggaaaaatacctcttgtttcagtatatcaaatagtcttcccaagaagagagtactggtctttcttgaaagggaaatgtgcagaccatggttgttcatcccttaggtggttctctctcccacacctttctttgcttacatttagtaagccaaagatgaacattcttaaattaggattggctttactctttaacattccagctgtattatacagttcaaagacgagtagatattgttaaaaccaccttaccagaagggagtttgggaatgtttgtaagggtggtcagaagtgtctaagaaggattgcaagctgacccccatgaagggatcagcaaaagcttctcctgtgtttttattttcccttctcccttatccagagcctagtcctccaatagatgaagttatcaacactccaagagtggtggatcggttcgtggagtttctgaagaggaatgagaattgtacattacaggtgaggcctgaagggaaggggtttgttttgtcttttaatttttgggggatacatagtaggtatatatatttatgggatacatgagatgttttgacacaggcatgcaatttgaaataagcaaatcatggagaatggggtatccatttcctcaagcatttatcctttaagttacaaacaatccaattatacactttaagttattttaaattgtgtagttattattgactatagtcaccctattgtgttaccaaatagtaggtcttattaattctttctgggtttttttgtacccattacttatccccatcccacccccagtcccccactactgggaaggggttattagatgaaagccctacttccaagaaattgcagtgggatacttctattgacatatctctcaggaagttcaaaagtaatgttaggaaacattcaggagaaaccatcagttccctcacagccagaatctcttccttaaaacaatttcaaaggaaaggcaccagactatgatagactgatcattcagttataaatcagaggctatagtccactacctgtgtgacctgaggcaaattgtttagcctctctgggtctcttgtttcagagatgggtgatgggtcaatccattggaacttgccagaactcagctgaaagggactttgagagacccatttcattctaatcctcatttcagaaatgaagaaagtgaagctcaggaaataaaagagtgacctggcaaaggatgcatgggtgttgtggtagtgcaggactaaacctgggaccctggaagcccaatgtcttattctcatctatatcacatcactgcatcttcccactctctaaagacgggaggggaaaggcttgtattttatgtgtgtgtgttttaaattcgtgggcaagaggcttgcttgtgttttgtgaggttttgttttggttttttaaattcatgggcaggaggcttactgttctgagccagctgataggcatggctgctcagtctgaaatgacctttcaatcattgcttaatctcactttcagtttgaagctgcctgggctctaacgaatattgcctctggaacctctcagcagaccaaaattgtcattgaagcaggggctgtccccatttttatagagctgcttaattcagactttgaggatgttcaggaacaggtaatgcttagatttggtgtgattctttatagtacctgtggtataataaaaaatatatttggtctttgtcctggttcttggcacagtgttaaaactcttggaatttcctgagtgataggggtgtcaagtacagatggcccctgggacttgcaactggtatctcaagttggggcagtcttgtgggactaacctgcggactctgcattaactctaggtgttagagtcagaattgaattaaatcgttggacacatggttggtatcagagaatgggtggttgatgtggaaaaaactctatacatttgttgttggaagtgccattggaaaaaagacaccacagtacccatatctgagtacccacaaatcatggagataaagatacaacttccatttctcccattgaattcttactagttggatagaattggagagtggtagtgggctcttttatagacttggtccaaggcagctacaagagtgcaactttcgccaggcgcggtggctcacgcctataatcccagcactttgggaggccgaggtgggcagatcacgaggtcaggagttcaagaccagcctgaccaacatggtgaaactccatctctactaaaaatactaaaaagttagctgggcatggtggagcttacctgtaatcccagctattcaggaggcttgagacaggagaatcacttgaacccgggaggtggaggttacagtgagcagagattgtgccactgcactccagcctgggtgacagagcgagactccgtctcaaaaaaaaaaaaaaaaaaaaatgcaactttctgattactttctccttttctgggcgatattgttttggcttctgtggctatagtacagatggcagcctgtctttccctgctgaaccaggaactcccagggataggtcattgtagaacaagtgctcagtaagaatttcaatagggaggttacctgagcttgtgtagtatatttggggccttgacatcattctcatcctggtgggtactcactttgcagttgtggctataaagtactcacaggagtaccaagctttgtgggtgacagtttcattatccccttttcaggcagtctgggcactgggaaacatagctggagatagctctgtttgccgagattacgtcttgaactgttccatccttaatcctttgttaacgtgagtaattataatcatctgtacctgggcgtctactgggtggccacgtggcaggtcatttgggggcagcatacttgattccttaagatgataggtaagtgcaaaaactataaaaatgcattctgattgccaaagtaaaagataggtatctttggagattgagaaggttgtggccgggcatggtggcttatgcctgtaatcccagcactttggtaggccagagcaggtggatcccttgagcctagagttcaaaaccagcctgggcaacatggtgaaaccccaactctacaaaaaatacaaaagttagccaggtgtggtggcaggcacctgtagactcagctacttgggaggctgaggcagggaggatcacctgagcccagggagatcaaggctacagtgagctgtgattgatcacaccactgcacttcagcctgggcaaaagagtgaaaaaaaaaaaagattgtgccacccatctgccaaaaaggatcttgttcctcacttcatggcactgcagaacctcatgttagtcatatcctcatatcctcctcattgttgagccaggggagagaggcaggactagcccacctggaaaaatccaaccttctctacaaaatgcattgatttgttatggggttttgcatacatacatcggacagctctgtcgtaaattatagatcaaagaccccgtgaagcgtcattgtatccttctcccatccttccctccgtacccttagagtaaactatgcctaaaccaaaacagatgaatgaactgttcttcagagaccacagtctcatagcctaccactgtcactttcttggacccttcacagaaaattattccatactgtgtggctaaagctctcacagtagacctatagcttttatttcttagacttttagcttttatttccagagaacaccattccttgtcctggacttgtggccagggttatgggcatgatatatcccactttagaagctttacaggcttactccagatctagccctctgtttcgtccctattatctatggtattaactagccacagctggtcctgaaatgaatactctgtatagagcctggcctcctaacctataccagctctattaacttaggtctgtgagtaggaagaaacaggctgctagagtctgagaggtctcattggatttgtctctgggttcattggcaacagtcctatgccaaggcctcagtgctcaggatctggctttgctgtttccttcagactccttaccaagtccacacgactgacgatgacacggaatgcagtctgggccctgtcaaatctctgccgagggaaaaacccacccccagagtttgcaaaggtgagagagctacttactagaccctgagtgacatcaggttccttcatatggagtttttaagtctttgggatactccttggagtctcaaatcatgggaaactgaaagaagcaattgttagtgaagtagatgatcttgtgtacctggatagtaaagtgaaaaggtagacccaaatgtttaatgtagtagcgatccctagggtctggaattacttgtgtgtgtgtattgtgggggcggtggttgcaatgttagggttcgtgatagagctgatatagtcttgttcccctgtgagtctttctcactctgcttcccacaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgtgagtggtcttagaaggggtacaggttctggctgggcacggtggcttatgcttataatcccagcactttgggatgccaaggtgggcggatcacaaggtcaggagttcgagaccagcctgaccaacatggtgaaaccccgtctctactaaaaatacaaaaattagctgggcgcagtggcaggcgcctgtaatcccagctacttgggaggctgaggcaggagaatcatttgaacctgggaggcagaggttgcagtgagccgagatcgtgccattgcactccagcctgggtgacagagcaagactccgtctcaaaggaaaaaaaagaatcccagcactttgggaggctgaggcgggtggatcacaaggtcaggagatcaagaccatcctggctaacacggtgaaaccccgtctctactaaaaatacaaaaaattagccgggcgtggtggcgggcacctgtagtcccagctactcgggaggctgaggcaggagaatggcgtgaacccgggaggcagagcttgcagtgagccgagatcgcgccactgcactctagcctgggcgacagagcgagactctgtctcaaaaaaaaaagaaaaaagaaaaaaaaagggtacaggttccttaagcttctccaggctcagactaaagagagagaatcagcagggccgaaaatggtgtgctggccttctgatcagatctccctcctctgtaggcacaatgattacaaagtggcttctcctgccctgagagccgtgggtaacatcgtcactggggatgacatccagacccaggtaagaaagaggagggtgcaggatcttagaccagctatggaagagcttgtggagagctgccagtggacaaaagcctttcctgcaaagggctgtggtcctgatgggaggcactatggtctaaggaagtaagtgtgggcttgagtgaaaagttccagctctgttattctctaaacagtcatgggaaacttggttccttcttttcttacataaattgggaacaaatcatcgtctaatgggtgaaggaaaactaagtggaataactggacttaccacctgggacattgtgagttagttaagtttgagtcatggtccctttgagatactgaaagctatggaactccacccctgcttcctagatctttaaggtctcatggatatcatggaccttggaataatcttttgtaaataacccttctggtgaaggcatagtaaacaaagttcccctgctcaaaggctagagatttgggtattctttgggttttgagtagcgagcataattctgtgggattctggacaggtttcttaacaggtgagtagtgtcactcaaacactcaaacccacatgctcattttctgggttactttgtatatgtatatgcatgtactttaaaatacaacataaaatttaccattttaaccattggcataaagtacattcacattgtttttccgttattgccactagccagctacagaaattttttatcatctcaaactgaaaccgtacacattaaacagtaactccccattctcccttcccctagtgcctagtaaccaccattctattttctgtatctgtgagtttgagtgctctaagtacctcatgtaagtggaatcatacagtgtttattctttctcgtctggtttatttcacttagcctagtatctttaaaattcgttcatgttgtagcatgcatcagaactcctttgaaaggctgaatgatattccactgtatgtatataccatattttatttatccatcaatagacatttgggttgtttccaccttttggctattgtgaataatgctgctatgaacattggtgtacaaatatttgttcaagtccccggtatatacccagagtggaattgctggatcatgttctaattttatgcctaatttttttgaggggacaccatactgttctgcacagctgctatgccatcttacattcccaccaacaatgcagcatgttccagtttccccacagccttgccaacagttgttattttccgttttttgttttttgttttttttttgataatacccaccctaatgggtgtgaagtgatatttcattgtggttttgatttgcatttttctaatgattggtaatgttgagcatcttttcatatgcttattggccatctgtgtattttttttttttttttggacacatgtctattcaagtcttttgctcatgttttaattgggttgttgagttttctggttgttcaattttaggagttcttcatatgttctggatattaatctcttatcagacacatgttttgcaaatattttctcttgttctgtggttttatcttttaactttggtgtctttaaaaaaaaaacttttaacttatttaattttttaaaattgagacagagtctgtctttgtcacccaggctagagtgcaatgatgccatctcggctcactgcaacctctgcctcctgagctcaaagcagtccttccacctcagcctcccaagtagctgggactacaggcatgcaccatcatgcctagctaattttttgaatttgtttttttttggagagacagggttttaccatgttgcccaggctactcttgaactactgggcttaagcaatcctcccaccttggcttctcaaagtgctgggattacaggcatgaagccacctcacccagaccaactttcttttcttttttaattttttttagagggtctcactatgttgccccagctggccttgaactcctgtgctgaggtgatcctactgcctcagcctcctgagtagctgggactgcaggtgcataccactgtgcccagcttactccaatgtcttgatgcacaacagtttttcattttgattaagtccagtttacctgggccaggtgcagtggctcatgcctgtaattccagcactttgggaggctgaggcaggaggatcacttgagcccagaagtttgagaccagccctgcaacatgggaagaccctgtctctacaaaaaaaaaaaatgttttttaattagcagagtgcggtggcaccctgctactcaggagtccccagctactcaggaggctgaagtagaaggattgcttgagactgggaggtcaaggctgcagtaagccatgatcatgccactgcactccagcctaggcaacaaagtgagaccctatttaaagaaaaaaaatgaagccgggcacagtggctcacacctgtaatcccaacactttgggaggccgaggcaggcagatcacctgaggtcaggagcatgagaccagcctggccaacatgatgaaaccccatctctactaaaaatagaaaaattttccgggcgtggtggtaggcgtctgtaatccaagcgtcttgggaggctgaggctggagaatcacttgaacctgggaggcggaggttgcagtgagccgagattgtgccattgcactccagcctgggcgtcagagcgagactctgtctcaaaaaaaaaaacaaaaacaacaacaacaacaacaacaacaaaaaaacataaaaaaaattaaaaacagtttaatttttcttttgtttcctgtgcttttggtgttctaggtcattcttaactgttcagccctaccttgccttctccacttgttgagcagtcccaaggagtcaatccggaaggaagcttgctggactatttcaaatattactgctggcaacagggctcaaatacaggtaaaacaggcagggaagtcaaggggcatgggaagtcataggaacttgggaggttgttggaatatttgctttcagaagaaagaatttgtttccctttaaaaataggagtcaattggccaggcacggtggctcacgcctgtagtcccagcactttgggaggccgaggtgggcagatcatgaggtcaggagtttgagaccatcctggccaacatggtgaaaccccatctgtactaaaaatacaaaaattagatgggtgtggtggcggacgcctgtaatctcagctattcgggaggctgaggcaggagaattgcttgaacccgagaggcaaaggttgcagtgagctgagatcacgccactgcactccagcctgggcaacagagcgagactccgtctcaaaaaaaaaaaaaaaaaaagaggggctgggcatggtggctcatgcttgtaatcccagcactttgggaggctgaggtgggcggatcacaaggtcaggagatcaagaccatcctggctaacgtggtgaaaccatgtctcttctaaaaatacaaaaaaaaagaaaaattagccgggcgtggtggcaggcgcctgtagtcacagctagtcgggaggctgaggcaggagaatggcgtgaacctggtaggtggagcttgcagtgagccgagatcgcgccactgcactccagcctgggtgacagagcaagactgtctcagaaaataaataaataaataaattaattggagtcagtgtgtactattggtcaaagaagctgtgtaaccaaaactgggttcttctgtagtagcctgtcacctatataggaagaacaaaagaaaactcccagaatggggaagatgtctaagtctcagctgatttggggactagatttatttatcatgctgaaatgactttctccttccatctgcctcctctcaattctctctcaggctgttatagatgcaaatatcttccctgtgttgatcgaaatccttcagaaagcagagtttcgtacaaggaaagaggcagcctgggccatcaccaatgccacatcaggaggaacccctgagcagatcaggtattacattcctttcccgttgtcttgaatgataatggatgctctccctgtttgctcatggtttacaggtgacctataaactgctcttgctcagacaggtctgccccctagtctcactgtaatagaattttactggtaaactgctacagtgtcactagaatctggaatagattccatgtaagccatgtgggaatctattccagattccagtgacactataacagtttaccagttttcccttctggagaagagaaacatgacatggacatccatcctttctctaccttttcttatccaacagagaactgaaatctatgtagttctcaattcaaatgaaggggaaccgtactatgggttactcaaaacagtttcttcagcctgaccaacataagaagactctgtctctacgaaagacaaaaattagccgggcgtggtggcatgtgcctatagtcccagctgagatgggaggatggcttgagcctggaaggtcaaggctgcagtgagctgtgattgtaccactgcactccagcctgagtgacagagccagagtctgtcacaaaaaaaaaaaaaaacaaaaaaaaacaagcaagctggtgtagtggctcatgtctgttatcccagcaccttgggaagctgaagcaggaggatcctttaaacccaggagttcaagactagcctgggcaacatagggactttgtctcatgtgtacaaaaatgtaaaaattagcaggttgtagtggcgtgtgcccgtggccacagctactcagtaggctgaagcaggaggatcacctgagcccaggaggtcacagttgtaataagctgtgattgtgccactacactccagcatttgctacagagcaaggtcctgtctcaaacaaaaaagcagcttctttgagaaattaatttgggatatgagacttgaaagaagcgaatagaaagctattttgtgtatgtgtgctctttttgagaccgcaacctctgcctcccaggttcaagcgattcttctgctttagcctcctgagtagctggggttacaggcacgtgccaccacgcccggctaattttttgtacttttagtagaaacggggtttcaccatgttagcaggctggtcttgaactcctgatgtcagatgatcctcccaccttggcctcccagagtgctgggattataggcatgagccacctggcctgtgtactcttttattttagtttacattatctgaacattagtggaaagtggtgggaatagttaagtgttttgcccttcacttgttgcctattaaggggagcacagttagtatatataaagtcttaggagaaaagagatagctgttgagttaagctttgaaggataaatatgggattgtaaaaggcctcttagacagggaaaagcataaataaaggtacaggaatcagaaacctggagacctttacaagtgtgactagaatgtattgtccttggaagggaataatgggaggcagagctagaaaggaactaggagccagattgcagagcatccaggctgggctgggcttgtggtattatggtattgttgtgccatagaatttggagttcagcgaattagggagcctgtgaaaaattttatgcagggaagtaatgtgttcagaggggtaatattgcagccaaggagacattagaggcaaggaggaggagtgtttggtagcatccacatgtgaaatgaactagaccaaccacatgtgaaatgaactagaacaatatcaacaggaaggtagagagatagagaaaggataagcggttatcaaggctcagtaagagcagtggctcacacctgtaatcccagcactttggggaggtcaaggtgggaggatcgcttgagaccaggaatttgagaccagcctggacaacataatgagactttgtctctacaaaaaataaaaaataaattagctgagaatggtggcacacacctgtagtcccagctgtttgggaggctgaggcaggaggatcacttgagcccaggaggctgcagtgagctgggatcgcaccagtgcaccccagcctgggtgacagagcaagaccctgtctcaaaaaaaaaaaaaggacttggttggggaacactctcattctctggcatggaatggggtgttgcacaattcttttttcttttcttttctttttttttttttgagacggagtctcactctgtcgcccaggctggagtgcagtggcgtaatctcggctcactgcaagctctgcctcctaggttcacaccattctcctgcctcagcctcccgagtagctgggactacaggtgcccgccaccacacctggccaattttttttttttttttgtatttttttttagtagagacggggtttcaccatgttagccaggatggtcgcgatctcttgacattgtgatccgcccacctcagcctcccaaagtgctgggatcacaggtgtgaaccaccgcgctcggcctcacaattcttaaaaataaaaaaataaattagtaagagtgggttgctgagagttcagagcacctgcccagcacttcatgtgtcctgtactagtttagcacttgcctggtctctggcccctaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggtatgtgccctctcctcaatctaggtcagaacctgagactgtaggcctccaacgtggtatacatatgttggtggtggcggagtgtgggttgggaagcatccatagcttccatgagactgatgtctgtgtcttcagaacagttaagagctcctgccctagccaagtttcaccatccacagggtttcacacgttaccatgagtataatcaggatgtgctgagtagctggggtacagctaggatttggatttggctcatcttttgagttgagagttgtctctcaccagtttcttctccttctaaggagtgataggtcagttctctttctgataggctgtacctataagagtgctggattaactcatcactcatccctgagaggctgatgatgtgcccaggtcatgcttctagtttaaagcagaatcaggactagaacctctgtaactgacattttggtctctttcctttgggattctgtagttttgagaagaaatcttaactctcccctttcaggtccaagagtgatctgatcatatgacttgtgtttgtaagcactaacatacctcagggaaggaaaaataggtaaatgtttcacctgcccatagaaaagcactcacacttccctctccttccttcttactactgtaggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaatccacatcttcagctgggcgcggtggctcatgcctgtaatcctagcactttgggaggctgaggcgggcagatcacttgaggttaggggttcaaaaccagcctgaccaacatagtaaaaccccgtccctacaaaaataaaaaaataaaaaaaataagccaggtgtggtggtgggcacctgtgatctcagctacgtgggaggctgaggcaggagaatctcttgaacctaggaggcagaggttgcagtgagccaagattgtgccagcctgggcgacagggtgaggctcttgtctcaaaaaaaaaagtccacatcttcatgaaccctcagactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttctaaa

SEQ ID NO: 7134 - DNA, 98 bp, Homo sapiens
cctatagtcccagcactttgggaggccaaggcaggtggatcacctgaggtcaggagtttgagaccagcctggccaacatggtgagaccccgtctctac

SEQ ID NO: 7135 - DNA, 110 bp, Homo sapiens
ccgccaccacgcccagctaatttttgtatttttagtagagacggggtttcacgttggccaggctggtcttgaactcttgacctcaggtgatccgcctgcctccgcctccc

SEQ ID NO: 7136 - DNA, 2841 bp, Homo sapiens
tctagttcatttccactcatatctatttctgctaatagattgacagcaacctttggtttaatgctgtgttctctagctacaccaacaagttatatattcctttccaatattaaccaagtatttattttatgttagcctatgactgagttttatctatgcttgcacatatatagaatgtaaaaatataattctccatgtttaatgtatccatataaaaatgaaaatacccattttctgcattcttaaagggttaagaaaagtaacatgtaataagcacatggaggactttagaccatttcttgtgttagaggagactttatacatttgtgaggttttctgtcttttggtccttttatgttcttagtccatttcattattgttttaatatttctaccaaggaatgaccaagaaaagagaaaggaagaaaaaaaatgtgttaatcattttcttttaatggtatgtcagcagaaggggttctgactgtaagctaatgtgcacttgtgcctgtcctctttgtcttaaactaaagttggtggtatgaatcgaaaaatgtgtattggtttaaaaagcagtttatgatatgaaacagtcttccagtttttatatcaactcctttgctttcaacagtcagttcaaagcaccatttattgatggtttactgtatgccagacactgtattttttctttacgtattaccctacttaatcctcaacacaattttatgaagtagttattgttagcctgaaactggcatttctccatccttttatggtgctgtctttgaaaagtctcagatgtgtaacatgtcctagaagtagataattatcaaaggaagactgcaactgcaactcacttccctctgagaaaaaatatccctgactagattacatatctagttccagaccagaacctggtggtattaaaagtgttttggttgactattgtataccataatgagtacctacattcccaaattgcctgcctggttgttgtacagacttaaaaatctagcctgccttgatttttacttttcagatacacatgtttaaagagatctttgctggtcacagtagctcacacctgtattcccagaactttgggaggccaaggtgggaggattgcttgagcccaggagtttgttcaagatcagcctgggtctctacttaaaaaaaaaagaaaaatttagctgggtatgttggcacgtgcctgtagtcccagctactcaagaggctgaggcaggaggatcacataagcacagaagtttgaggctgcagtgaactatgatggagccattgcactccagcctgggcagtagaggagacttgtctctctctgtatatttgtctctctctccctctctctctctgtctctcataatacatatatacatacatatatatatacacacacacacacacacatacagagagatatataaaatagatataaaaataaagatattttaaagattatttataaatatatgttttttaaaaatgtagtctattataagccaaatgtcattaggcatgtagtccatttctttctgtgttcaggcaggagttccagttctataaacattggtttatctgtttttctagcaggtgcacacatgggttctcagtgatgtgtagccggggcatagattgctctcagtctgttgcaccctgcaggggagatgtctgaggtcctccctcgcctggctgtgctggacgcacagtgcatagcagaactaactgcacagcagaaatgcctgttctgcgttcccattgatacaccaacagctaatgaagtctcttttacttttaagaaacccttatttggctttggcatatttacatggtagaggcctagaattttataaataaaattttgaagaatagaaatgtattttttcacgatttaaaaaccacctgtatggtttactctggagttgacctgttccactcatccttctccccagttcatttgtttcgtttcaattccactttcccttatagctatcttcaaagcagtgtctatgggacagcattgccaagagccctgactgggcctggcttggtaactcactcctgtaatcccacctgcccctagaagtgcagatatactagaaaatacagctgtctttgttccagtgaatatgtataaggggtgacatgccttggtggaaagcagctcagattgtgtggactcctcaatccctgctctaccaagagctctccagttccaaaactgtacactcagtggctatgttctgtgtgcctgctcccaatacagccattatgttgttcatccagatttgagaatttaagcttttcactcctctttgggtagtattatttaagtaagaacttctaggaaaatagtatgagtttggttatttttccctcggcagcaggaattttctgaatatttagcacattcagattgctccaagaacagcattgagcaatgctgtacatgtgctttctcctaaggctgtctcccctgtctactgggttctggaaagactcattgtccttcagggaagggagcatttttcctcactgccattgctgagccttttctcctgttgtatactatttagcccagcatgaagccatcgccgactgtaaggagtgatggatagaagtgtttacttggtttgtgaggccttgtctctaaagggtaacagtctgacaaggaaaacatttcaaagagccctgaccaggcctggcttggtaactcactcctgtaatcccagtactttgggaggccgaggctggagaatcatttgagcccaggggttcgagaccagcctgggcaacacggtgaaaccccactctatttaaaaaaaaaaaa

SEQ ID NO: 7137 - DNA, 758 bp, Homo sapiens
aagttattctttattgtggctctaatttggcatatttttcagacacaggttgctcttgatacatcaaatttctgctgttaaaaacttcagttattttgagtttagttaattcaggagcgggaacctaggtaagtcatctgtagagcatctttgcaccttaagagaagtttctgattagcctcaattcagtttagtagaatattagtgtggatatctggtggcaaaacctattcttggtgcaatttggcttttcgtggcctcaggcatagagctgacttggtagtggaccctctgtccacacccacccggcccttgcgcctttctagcataaagtggtgtgtcagagccactgtctccacagaaagcaccacgtttgtttcatttgacttatttgaacccgtttctcctgcctttgcctttttaaataaaaatagcaaaaattgattcaagtgaatctattagaattttctaaaatggagcccatttgtcttttcagtcttgcaagtaaagtctttaaaacaattaagcctcccaatgatttaaccgtattttcttacccccccaccctgaataatatttacaaagaaataataacgtgaatttttaaaaaccccgtccttcagttgttataaatgatagttcattcttggtaagtatatctgtaacaaaatactggggaaggacatgaggtatggtgaacacttaaaattctgccagccagcttaaatacataatctaaatttaacccacgtaacacc

SEQ ID NO: 7138 - DNA, 625 bp, Homo sapiens
aagtcacatacaggtagaccttatgacatttccagttgaaactaggcttgctttcggtacacaggtgaagacttgaggaagccagtgccagagaggacgtgcctcacccctcagctggctgaatgcgcttcattggcttacgctttgctttctgtatgctttctgtccttctgggtggtgtcgcatatatttttaaaaccacattcagtgtgatgaacacttgttggtacacttctaaggttagtcatctttccttctctgagcagatccttgagaagggcattgacagtggatgctttaaatagtgttcagtttttaccagtaataatattttttggtggatgtcatgaaaacacatgacatcgtgttgtgcccatgataaaaagtcctgactttttattgaatgaggtgtgctggtcaaagagacagacgtggctgccttctctggtaacagccagaggaaaaagttagcaattctagatgggttctacagctttaaaaaacttgttgtatccttaggtcctcataatattaaatattttctaattttaacagattttaagagtcagatatatactttgacttgaatgatgtagtgttgcttaaggaagaaaaaattataaaa

SEQ ID NO: 7139 - DNA, 2144 bp, Homo sapiens
ggaatgggccactgattcatttcgtggttaactggaatactgctttttaattgatacccagctgtatctaaatcattacaatactggacagatagtgtagtgcagtgtatttgaaatgcagtgctttgtttggcaaagatttatttaatggtttcattttctctgcaagaagaaaaaaagcagatcatcgaagctcttattatttgcactgtggcagattcacttgagttcagaagcctagggaaaaggtgggacttttgaaactagggcagtaggtaaatgtggacacaccttcgtttgtatttgattagggatctgacagcgtgcatatgtgtacaggtttgcacgtgtgcatacacacatatacaaatcatagaaaaccataggtgttctgtgagagagaaaattttgctacttaaatacagcgtgaattctcatcctgatagttgcagaaaatatttcttttaaaatggagattaatgtctaattccatataaagaagattataggaaaggtgatttaaactgtaagtagctttgttcaccaaaacgctagatttatttgaaacagtgttttatttcttttggaaggcagacaactagtttaatagtgtacatatgaaacgctaatttggcttgttaattggatgcaattaaattgaggttattttatactgcttaattgttagaaaattacatgcgttgccatgcctgtgtaatgtgaagcaaaagcgaagggtatagcaggagtgggggtgggagggacgcaagatctagtcctgtctttgcaattaactttctgtgaaaacttggaaacaagtcatcgaagctctttggacctcatttggaaatggaagagattggaacagatggctcctaaagcttcttccagctcatattctatcagtttataaattctactttgtagttgtagagaatgcaatgtcattatattctgtaattatggtattacaaggatgaactaaacacttaaaaaaatcagcacagtgccaatttagcaaatccgttagaaggaaggcaatttaggcttaaagagcactcacctgtgccaggctccatcccaggctctctctccacattacgtcacttagccctcacaaccaacctgagaagatttagttttttatcttgatgtgtatacttaaagaaacttccattcggaaaggtttttgtggggatgctttgctagtcattggtgaagcaggattccaactcagggttctttggctccgaaaatgctttgtctttttaccatttcacgcagtataagcaattgtttacacatcaaaattatttcaaatatttaaaaaaggccaaccatatttatcacttagcacaatgtttccccttagtagtatatggataaacaggtagcccacgggattaagaacctcgatttgaagtcagacagaatagggcaaattccagctccaccaccacctgggggaatttgggtatgttacttaacctccctgaggttacaaaatgaggataatacccattcaagagtcattgggaaatttttatgagaatgtttgtacccatctcaatgagcacatagtaaacgtttaatacctggtagctatgggttattattaacaaggtattagactataagaaaaacataggacaattcaaattgttgtgacagtaaaatattaaatattttcaaatggtccattaaactcttgactgaaatggtttaagaaacaatgttagaatgacatggtttcacatttaacagttaacaaatggaaatatcaattaaaatctggggtgtttctcactgagctcagccagtgctatgccaatgaagtgaactaaattctctggttctttgtggaaaatcattctgaagtttttgctctaaaaatagcttttggggcctgaattaccccttaccccactcgaacttctgtgcaagagccagaggaccagtgattactcgtggggccttgggcctacttaagagactcaacttgggtgttcacaggactgttgactttaattctaaaaaaatttattaattcaacagagatttattaagcacctgctctgggaaagggctgttctagacactggagatccatcaatagacaaaaatagtaaaaaaaaaaaaaaaaa

SEQ ID NO: 7140 - DNA, 2144 bp, Homo sapiens; identical to SEQ ID NO: 7139

SEQ ID NO: 7141 - DNA, 517 bp, Homo sapiens
aactttattaaaacttacaattgggagtagagtataaatggaagcaggattttttccaactggaaagattagagggttcttatgagaggaggtgattcttttttttactgaggatcttgaatgttaagtagaatttcactgagtaaagaagggagtcaggagctcctcatactctgacctgggatgggaggggacagggatagtaccagggcagaggaagagttgggagcctggaaaggtacgtagctccagatcttgtggtgcctcaaagacctgcagagaaagctggacatcactgaaggtttttgagcagagaggtgatgctataaagtgtgtgtttcagaaagcttatgagggtatatgggatgaatatctcggtggcaaggagacagttagattgccaaaatatcctaaagagaagtaatgaaagttgcccctactgaatgataatatgaattcttttactctgttaattgatgtgtttaaaagtaccctaaaagtaagtaacaaaagtgat

SEQ ID NO: 7142 - DNA, 517 bp, Homo sapiens; identical to SEQ ID NO: 7141

SEQ ID NO: 7143 - DNA, 17127 bp, Homo sapiens
acacggaggcgcgcacgatggcggcggaggtgctgagccgccgctgcgtgctcatgcggctactggacttctcctacgagcagtaccagaaggccctgcggcagtcggcgggcgccgtggtcatcatcctgcccagggccatggccgccgtgccccaggacgtcgtccgggtgagcgtctgccctgccccgcccggctcaggtccagagctgcggcgggagttggaggcaactgtgtgaccctaggcgggtcacttcgcctctctgagccctttggaaagtaggatggactgttcccctgctccattgatctccaaggggtgattctgtcttcagaggacgctgggtgatgaccggaggtgttcagggagggccgctccgggcgtggagtggatggaggccagggatactgctcagcaccctgcagtgcccaggacggccccgccccagacagtgatctggccccagggtccacagggctgcgcaggagaacctgcctagagtgaacaagacctggtagaatccagcagacgccctgggtgaagatacttttgcagatgagaaggggtgggtgggttgggggaagccctggttttctgtgagtgcctcatggttcatgccgccctctgagggcctgcctgccctccagggacagtcactgggccccctgctaccccctccagggacagtcactgggccccctgctacccccaccagggacagtcactgggccccctgctaccttgccacccccaccaggccagcagccccctaagtgtgtgtctgctccacagcaattcatggagatcgagccggagatgctggccatggagaccgccgtccccgtgtactttgccgtggaggacgaggccctgctgtctatctacaagcagacccaggctgcctccgcctcccagggctccgcctctgctgctgaaggtgtgctctgggctgcagggacggggcccgtgggcgtgggtgtggggaggcgtccccatcccaagggctgcggtcaccctgggctgtttctgctctcagcgtgtggcatcccttcgccggggttaacagtgggggttcctgggccccgtgtggacctgctacatcaccacctccgggctgggacctgggactctgcatttttgcagccgcctgtcccccctcccagctgctggctctgtgcacacgaaagaccagaaccacggactcaggaggagcctttccgatcctcaggggctcggggtttatgaaacacacgggcatctgttcagttctctacctgccaaggacattctcagcatcacatctcgagtgggcggcgtgggtgcgtcggcggtgtccttacggagaaggggcacacgcctttcctccagccccgtgaacgggggccctggcagcgaactcagagcaggaacccggagctctgtggtgggacctgtggtggggaaagatgggagttgccgctgtggagagtgaggagaaagaggaactggagaagccagctgaggggcttgcccggggctgtcatcagctactgggggagcagggctgagaagggaggccagagcccagggccgcagagaacaggcaggtgtgtcctggcccagccccaacaaaaacagtttggtgctgtggtttcaagctatagtaaaggaggctgaggcgggtgggtcccctgaggtcaggagttcgagaccagcctggccaacctggcgaaagcctgtctttactaaaaaaatagaaaaagttagccgggcgcggtggcaggtgcctgtaattccagcaacttgggaggctgaggcaggagaatcacttgaacccggaaggcggaggttgtggtgagctgaggtcacaccattgcactccagcctgggcaacaagagcaaatgtccatctcaaaaaaaaaaagtttcatcctacacagccagatcagtggaattccagatgcagagttggctaacactggccaggggccacctgtttttgttgataaagttttattggcactgggccacattcatttatgcacagtccacggtggctttcccagcagcagaactgaattgccgtggctgcggcagagaccatccagcctgcaaagccgaaagtgttatctgatcctttgcagaaaacgttcccaacccctggtttagattaaaagtcttgacagtggccatttttgttgtggtaatagaagagtatagttctgcagatacctaagtatcctgttagagaagaaggaaagaggagtcgtcttctttttttttttttttttcttttatgagacagagtctcactctgttgcccaggctggagtgcagtggcacaatcttagctcactgcaacctgaaggaggaatcttctacttggtggagtattatgcagctggtaaaaatgatgttgagggccaggcaaggtggctcacgcctgttgtcccagcacttacggaggctgaggcaggaggatcgattgagggcctggagtccaagattagcctgggcaatatagcaagacccttgtctctacagaaaatttaaaaaagccaggtgtggtggtgcatgcctgtagtcccagctgctcaggaggctgaggtgggaagatcacttgaacccttgaacctgggaggcagaggttgcagtgagctgagatcttgccattgcactccagcccgggtgacagtacgatactccgacttgaaaaaaaaaaaaattacagagagttcccaggagcatgcttcccccagtgatcatatctttttgttttgttttgttttgtttttttgagacggagtctcgttctgtcacccagactggagtgcagtggcacaatctcggctcactgcaagctccacctcccgggttcgcgccattctcctgcctcagcctccagagtagctgggactacaggtgcccaccaccacgcccagctaattttttgtatttttagtagagacggggtttcaccgtgttagccaggagggtctcgatctcctgacgtcgtgattcgcccgcctcggcctcccaaagtgctggtattccaggtgtgagccaccgcgcccggccgatcatatcttacatacctatgatgattgtgttttcatttttattttattctttcttattatcttttattttatttcaaaagattgtatttttaggccaggcacagtggctcattgcctgtaatcttagcactttgggagggtgagacaggaggatcgcttgatcctgggaggtagaggctgcagtgagccatgtttgcgtcactgtactccagcctgggtgacagcatgagaccctgtctcaaattaaaaaaaaagttgtgtttttaaaatgctttaaagcacagaagtgcggactcaaagttgtgtgaactcacaggcattttcgggcaggtcctggccctaagtccctaagtgaacagctgttattgagggcccgggaggaaaggatcagaatggcatggaggagaaattccccagcagaacgttccagaaaggagatgtgaataatttcgagagaaggttgtcctagggggagcacgggcatcctgtggtatcgaaatctgctggtcacgtccccacacccggctggttggctctgcccgagcccccaacctggggtgtcagtgctggggatgccccctggctggggccctggctgggccaaggctgatgcgccctctccctctccctagtactgctgcgcacggccactgccaacggcttccagatggtcaccagcggggtacagagcaaggccgtgagtgactggctgattgccagcgtggaggtgagtgccgcctgccccggagccagccccacgtccccaggggttcctgccatccgcctggctccccggctcggccgtactagaggggagccgctgatgggaaactggagtcggatcgcccccctgcctggctgaaaacctcctgtggctccgctggcagctgcaggaacccaaactcctcacatggccggggagtcgctctgtggagtgcccaggcccctgccagcccccggcccatctccttccttccatcatggacccccacacaccaagccgctgcctcccaccccagggcctttgcaccggctgcccctcccaggaagccccctccaggctgcagtgtcgccagccccctctcatcacataacctcacccgtcagcccagacgctgcgtcctcacagacccttccgagcaccccgggatatcagcagagtcaagagagggtggggagctgccggtgcggaagtagcctctcggatcatcagggcagatccagagggtgaagcctgtgtcgctgctgctgcagcactggcaggggccttaaaacccgaggaagcacccaccgactcctctagcatttccctgcgggacggcgccggtgaggggtgcagatgagtccacacagatgaggggttgcctcactgtcgggggagccctgaacaagacgtgcttgctgttttggggacccaggccttgttggggggtgcccgagtggaaaagcagcggcttaggccggggtggggaaagtgtcctggaggccccggctccccatagacaggccttggcggaggagccctggggtttgtcgatggcggctgttctgtttgttcctgttggattgtactgtgggcccgggaggcgcgtcctattcccagcgccagttagtgtgcagtgagacccggtagcctggcctgcgtcactccacagtggcacaggcgctgggctccgcatcccatggggccatgtcgattccctttcccctggctgtgccctttctcctgtgagcagagccctcttggcagctgggctttgagttcagccgttgaaggatctccaagtggaaaagcatgttgcaaaaacagcaagtagactcccacagccagacggggagtccccaggccacagccggccctctacctgcttttgtaaataaagtttttgcttgtttgtttttgttttttgagacagagtctctctctgtcacccaggctggagtgcagtggcgcgatctctgctaactgcaacctccgcctcccaggttcaggcgattgtcttgcctcggcctcccgagtagctgggattactgtcatgtgccaccacgcccagctaatcttttgtaattcttttttttttttttttgagatggagtttcgctcctgttgcctaggctggagtgcaatggtgcgatctcagctcactgcaacctccgcctcctaggttcaagcgattctcctgcctcagcctcctaagtagctgggattacaggtgcccgccaccacggccagctaatttttgtatttttggtagagacggggtttcaccatgctggccaggctggtctggaactcctgacctcaggtgatctacccgccttggcctcccaaagtgctgggattacaggcgtgagccaccgtgccgggctgtgtaaataaagttttatggcacacagccatgctgatgcatgtgcaagccgtccatggcagtttcttagttgtaacagacaccatctggtccccaaggctgaaaatatcccctctggccctttatgaaagtctgctggcccccgggctagagcagaatccgactttggtggggtaagaggcagggaggggtgcacacagaccctgaaggaacccgaatgcctggctgaggggctcagccccgttcccacaaacagttatcctcctgaggggctcagccccgttcctataaaaacttaacctcctggccgggcgcggtggctcacacctgtaatcccagcactttgggaggccgaggtgggcggatcatgagatcaggagatcaagaccatcctggctaacatgatgaaaccccgtctctactaaaaagtacaaaaaattagccggatgtggtggcgggtgcctgtagtcccaactactctggaggccgaggcaggagaatggcgtgaacccgggaggtggagcttgcagtgagccgagatcgtaccactgcactccagcctgggcgacagagtgagattccgtctcaaaaaaaaaaaaaaaaacacaaacaaaaaaaaaaaacttattctcctgctctccccgatttttaaagatttcgacctgagggccagagcaggagtgggtccctgttcccggctctacctcctccctggaggagctccctggggctcccagagtcagaggctggcacctcctgtggtcctcagtgctgaggccgatgctggcacccagcggacgggccccacgtggcccagaggggaggggtctccaagccccacacacgggtcacctgccccaggaacagccaggccattcccctgctctctatccacaggggcggctgacggggctgggcggagaggaccttcccaccatcgtcatcgtggcccactacgacgcctttggagtggcccccgtacgtatgtgtgtccccattccccccaccccacagggcttggattctggctccagtccagtgccgaggcaaagcgcctgtaggggatggcggccagggtcagcggctctccctgtgacggcctttgcccgtcatcctggtccccgcgagggcctcagggtgggtgtcgtggggctgaaacaggcccggctcttgccccggggtcgcaggttccagggcacggcggtgtctgtgtcagaggctgagcccagggagtctgagtcagggttccccgggccagcgctgggtgccgtggctccacacgaggcctcctcgaggctgtggtttgtcccagcgagcggtcatggagcacgtagcagagtccgcgaagggaaaggcgcgtgcggtgagttggggaggccagtcctggcttccaggccctctccctgtgtgtcacgtggaacacgcctcattgtcagcagtgagctgggacgacagcccaaagcactgtcaccagcgagacttccagagacccagcgcccggttcctatgggagctggttctacagcccctgctgcctggcccatgccgggattccagactccggagggaagcagggcccgtgtgtaaaccatggtgtttgcaggaacagctttggacccagagcctgtcctgtcagcgagggtcgggggccctgctgcaggttcctggtctcaggcctgcggcacaagcttggttctgctcagcgtgggttgagcgggagtggggtgggggggcatgtaccacggtgtcaaccagcaccctgcctcctcctttttttttttttttttttttttttttaattgagacagtcttgctctgtcccccaggctggagtgcagtggcacaatctcggctcactgcaacctctgcctcctgggtttaagcgattctcctgcctcagtctcccgagtagctgggaccacaggcacccgccaccacacctggctaattttttttatttttagtagagacggggtttcaccacgttagccaggatggtctcgatctcctgacctcatgatttgccctcctcagcctcccaaagtgctcggattacaggcctgagccaccgcacccagtcctgcctcctttgaacacaaatcagctgaaccaggcagagtgcggagggtctgggcagatctgctgcctggctgagtgcccgaccccttggagggccaggcccccagccttgagaatgcctggtcccgctgggcccacacaaactcaagctgctcagagcaatgcctcttgaactcctgacctcaggcaatccacccgcctcggcctcctaacctgctgggattacaggcatgagccaccgcgcccactgcctttctctgtcctcattgtcccctatgaagctttttttgttttaaatttattttatttatgtatttttttttttttttttgagacggagtctcgctctgtcaccaggctggagtgtagtggcgagatctgggctcactgcaaccttcgcctcccgggttcaagcgattttcctgcctcaacctccggagtagctgggactacaggcgcgtgccaccacacctggctcattttttgtatttttagtagagatagggtttcaccatgttggccaggatggtcttgaactccagaccttgtaatctgcccatcttggcctcccaaagtgctgggattacaggcgtgagccaccgagcccaggcaaatttattttttgagataatgatagaacataaagttcaccattttagagcgtacgagtgggttttagtacatccaaagttgtacggtctccacctctaattccagaacattccatcaccccaaaaagcagcccctccccatcagcagtcactcctggtcccctccccagccccagaaccccagcatgtgcgcatccgtcccagtgcctgtggactggcctgttggacgggtcctatgaacagatcctacactgtggacaaagtcttttggatctggcttctctcactgaggagggtgtttattgtccccctgaattcagtgccaccgaggtcccctttatatgctgtggccttgggacggtcccaagccattgcaatgtccaagaaacagtgtggccttattgagaatgctgctttagatcacaaaggtgcatccaagggcgggaagggcatgtggtcgggctgtgcaggtctctccacagccggggctcgagggtggaagggtgggtcccacagaggggaccccgcacagagaccagggctggacagatgctgccctctgtgagcgaatctggcctggccctgggctccaaattctgcatgtagcttctcccgggcgcgggccgagccgaggtggatgaggagagtcctgggcttggcggggccccgcagaccccaggccatcagtcggggattgaatacaggaggggagcgaccacagctgcccactggacgtggcagaggggctgggggacagcacagagatgaccgtggctgctgtgggcagaggtcatggggctacgggagtagggtgggggtgacggagagatgactgtggctgctgtgggcggaggtcatggggtgcgggagccgggcgggggtgactgtggccttgcctctcccgtccctgtagtggctgtcgctgggcgcggactccaacgggagcggcgtctctgtgctgctggagctggcacgcctcttctcccggctctacacctacaagcgcacgcacgccgcgtgagtgccggggtgggcagggggatgggggtgcgggggccacactgccggacagcgctgcccaccaggcacctctgcagatgtttctctggagcctcctggccccaaagtgggcctgagcccaggaattggggcgccttatttatcgagggctaagctgagccctcgcaggctctgtctcttggagtcccacagggcccagctgctgctcaccccaggaacctgctgggaatgctgtcagctgcaagtgttagagacgcccggttaagggccctggaactaggggatcccctcagccctgtgtggtcggggccggatttttcgctgggggtgggggccgtcctgggcactgcagggcgctgagcagcatccctgccccactcactccatgccaggaacacgccatagtcatgatagccacaggtgccctccgacatcacccactgtccgctgggggcagaagcacccctggttgagacccccctgggttagggaattccacgggcccccgagagactatgtcccgtgatcatctgccccgctgaggtcccaggaggctgcacacattgaaatccacaccctgagtaggaagggagagaggaggtgaatcccaggagctggggtccccctggtttatcccgtctaccccgttgggagtttatcctggtgtctggtgtgagcagggggcagacttgatttttccccagataatgaatgcaggcttcgtccccgtggccctgtggatgtcttctgtgcatgactctctcctgggtgccacccactccatcccaggagcacccccagacgtagcaaccacagatgtctccagacatgactgtgtctcctgtgcggggtggggtagaatcacctccgggtgagaccccggcccagtcacctgctcccgagatggtactgctgcagtcattgtgtcagcagctcagagaggccagggccactgtggctgagacgtttctcagccttctcacagtcacaaggcgccgggagtcatgtcctggttcaggcaggaacttggactcgaactcctggcctcaagcgatcctcctgcctcagcctcctaaagcactaggattacaggtgtgagccaccatgtccagccaaaacttgtttttttttttttaagctgcagaacctcttcccccagccccccactgatgccttttgagaagctcatgctgtcaaaaacgtgtgaacggggctggtttctgccaggcctgggggcttcttggcagctggggagaggttgggtttctggggcagagggaaactgggttggagagagtccggggcagatgtgggaagatgggggtagggggcgtgctgagcagtttccttctctgactctggtgacccttctaatagccaaggctgtgttccattagaatttttggcctgcctgggtggcttatgcctataatcccagcactttggaagcctgcggcaggtggatcacctgtcaggagttcgagacctgcctaacgtgttgaaaccctgtctctactaaaaatacaaaattagccaggtgtggtgctgcatgcctgtaatcccagctacttgggaggctcaggcaggataattgcttgaacccgggaggcagaggttgcagtgagccgagactgcaccattgcactccagcctgggcagaaagagcgaaactccgtcccaaaagaaaaaaaaaaaagaattcttcttctttaagtgaatagactttatttttttgatctcctcgtgtctgttgcctggtcggtcaccccggttcctcctgggctcagagaagcctctagagctggggtctaacgtggggtggccctgctgcctggagacactgagtgatttgcagttgtcattgggggaagctcccggtatggggtgggtgaggccagggatgccactcagcaccctgaagtgcccaggacagcctcacctcagagaaccatccagccccagtgtccacagggccgaggggtcatgccccgccctaaggggctggtcaggatttcctgctttggggagaccttcatacccttcctgggggacctgtgacctggcctggtccctcctccaccccaggcgcttgcccgtcaaagctaacactgggtcttccctcccagctacaacctcctgttctttgcgtctggaggaggcaagtttaactaccagggaaccaagcgctggctggaagacaacctggaccacacaggtgagcggccccgggtgggggtgggggtgccgcggtggtggtgccgtggggaggcacggaggcccaggggttgccatgggggcagccaggaggcacagagggagggccgggggccacttcctggtccccacccaccccgccagctctcggtgtcctgcagactccagcctgcttcaggacaatgtggccttcgtgctgtgcctggacaccgtgggccggggcagcagcctgcacctgcacgtgtccaagccgcctcgggagggcaccctgcagcacgccttcctgcgggagctggagacggtgggtgcccctttcatggatgggtccggagctctgcggagcacacacatcggggccgggttggggcatcctgtcccagggtgtccttgctgtccgcccctcaggctctgagggccacactgtgtcggggtcgggctggggtgttctgtcctggggtgtccttgctgtccaaccccggggctctgaggggcacactgcgtcagggccgggctggggtgtcctgtcccagagtgtccccttgtccctccttacccactgctcattgcccgccggggctccagcaggccttagggggaccccgggggcaggtggatttctcctcattttgcaccctcgggggttctgggaggcccctggagcatttggggaatgggctggggtggccgccatccccgcctgccctctgctaatggcgcctccggctgcaggtggccgcgcaccagttccctgaggtacggttctccatggtgcacaagcggatcaacctggcggaggacgtgctggcctgggagcacgagcgcttcgccatccgccgactgcccgccttcacgctgtcccacctggagagccaccgtgacggccagcgcagcagcatcatggacgtgcggtgagcgcggcagcacctgcccggcccctcctagggctttcctgggggctgagccactggtcgcaactgcagaggccatgagagcctggagggagcggcccccacacacaggctgcgaggaaggggccggtgcgtggccaaggccggctgcacggtcaggccgttcgcaagctcttccttactggggctagggagggcgaggccagcagcctgaggtcgtggccccatataggacccccagaccccgtcacctgttgagttaggagcaagcagctcctgcctctgggcctcttcagggccctgccacagcccgaaagtcctgcctggccccggccaccgtcttggggagcctggcccgccaccacaccccggcccttcctcgccccgcctccctctgggcactgtgtctctggcttcttatgtcctctgaccctgtgtcctgcccgtctctctgccatcatgtgagcccctgggcaggcttttgtggagcctggaactgtctggccaccccaggcacactcctggccagtcctggcaccagcaggtgggcgccgtctcctcccccagcgcccgcagtcccggcatagatccttcccgttcatccactctgctctgcggtcactgggccctcaggagtggtttgagctcagccatcggaggcctgcagaagccagtggcgggagggaggggcacatccctgggtaatcgcagtcctggaaaggatggaggtggcggtcgcccaccagccaggaaagattgccaggaaatgagggtgggtgcacggctgtcccagctgtgctgagctctctcaagaccaccaggggtcagcccaggagggccacctgggatttgcagagggtcccagaatggattcttccaccaggacggaatagtccagtttaaattctggaagagcagaaaaccgagtcagaaggaaccaaggcctcagggcgtgagccttacctgcgcacagggacgggtcagggcaaggggcctggaggtgtggggcccccagtgaatctgcatctacatgttagccaagtagttaaagctaagcttaatttttttttttttttaaagacagagtctcacggtctcctaggctggagtgctgggattacaagtgtgagagctaccttgcctggcccaaagtccacattttaaaacattgtttttgaatcgtgaaggtcccgggtggattctaagaccctgacccgtaacacgaggatcattgcagaggccctgactcgagtcatctacaacctgacagagaaggtgagccctgagccctctgtgccgccagacccagccccagccctgcccccggccccggccccacccctggccccagccccactgcaggggcctggactcagggccatcccctcctctctccgcaggggacacccccagacatgccggtgttcacagagcagatggtaagggggccaggccagtgggtgggtgggtgggcggggccaggccatgactaccaccaccgtccctacagcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcggtgaggctggggctccgcgctggccccgttcagcctggggccgagggggacctccccctactgcatctcccaccccctcacccctgggggatgccaggtggagcaaatacaaagagagggtgggatgagggccggacacggcggctgtgcctgcaatcccagtactttgggaatccgaggcaggtggatcacttgaggtcaggagttcaagaccagactggccaacatagtgaaacctcatccctactaaaaatacaaaaattaggcggatgtggcagtgggcacctgtaatcccagctacttaggaggccgggacggaagaatcgcttgaacccaggagttggagaccaacctgggcaacatagcaagaccccatctctacaaactttttaaagtttttatttatttgtctttgagatggagtcttcctctgtcacccaggctggagtgcagtggcgtgatcttgtctcactacagcctccatctcccggcttcaagtgattctcggacctcggtctcctgagtagctgggattacaggcacccgccaccatgcccggctaattttttttaatttttagtagagatggggtttcaccgtgttggccaggttggtcttgaactcttgacttcaagtgatccgcctgcctcaacctcccaaagtgctgggattgcaggtgtgagccatcgtgcccagtctccatctctacaaacccttttttaagaattagctgggcgcagtggtgccccctgagaaagtgctctctccccagggacccagagtttgtcttctacgaccagctgaagcaagtgatgaatgcgtacaggtgagtggtggccagcgggacctggagcccttcaccccctacgggttacagccgaggggactgcggcccacgggggtctaggggttcatgttactgccgcgcaccatcctcgacctcagggaccctgctttctccacagagtcaagccggccgtctttgacctgctcctggctgttggcattgctgcctacctcggcatggcctacgtggctgtccaggtgagcagtgcccaggctcaggtggggcaggggccgcccgccgggaggagctgggctgggcgtctccaagtgcatcctggcccctggctcagcctagagtcacatgacctggggctctggccccgcccacatcctcactccctcctgctgtgtccccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcattgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatcgccaccagtgtttggtctgggggctgtgagaattggattgtgacaa

SEQ ID NO: 7144 - DNA, 2454 bp, Homo sapiens
agtggtgccccctgagaaagtgctctctccccagggacccagagtttgtcttctacgaccagctgaagcaagtgatgaatgcgtacaggtgagtggtggccagcgggacctggagcccttcaccccctacgggttacagccgaggggactgcggcccacgggggtctaggggttcatgttactgccgcgcaccatcctcgacctcagggaccctgctttctccacagagtcaagccggccgtctttgacctgctcctggctgttggcattgctgcctacctcggcatggcctacgtggctgtccaggtgagcagtgcccaggctcaggtggggcaggggccgcccgccgggaggagctgggctgggcgtctccaagtgcatcctggcccctggctcagcctagagtcacatgacctggggctctggccccgcccacatcctcactccctcctgctgtgtccccagcacttcagcctcctctacaagaccgtccagaggctgctcgtgaaggccaagacacagtgacacagccacccccacagccggagcccccgccgctccacagtccctggggccgagcacgagtgagtggacactgccccgccgcgggcggccctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcattgacagcctttgcttcgtgggggcctggcagggcccctgcctccccgacccccgacccactgcaaatccccgttcccctgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggccttgtggctcctcccctcgctcctcgccctgggcctcagcttcctcatcaatagaaaggatgtgttcggggtgggggcgtcaggtgagaacgtttgctgggaaggagaggacttggggcatggcctctggggccacccttcctggaactcagagaggaaggtccgggccctcgggaagccttggacagaaccctccaccccgcagaccaggcgtcgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttgcccaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcatgatggatgcactgactgaccgtctggggctcaggctggtgtgggatgcagccggccgatgagaaaataaagccatattgaatgatcgccaccagtgtttggtctgggggctgtgagaattggattgtgacaa

SEQ ID NO: 7145 - DNA, 3658 bp, Homo sapiens
tggattctaagaccctgacccgtaacacgaggatcattgcagaggccctgactcgagtcatctacaacctgacagagaaggtgagccctgagccctctgtgccgccagacccagccccagccctgcccccggccccggccccacccctggccccagccccactgcagggcctggactcagggccatcccctcctctctccgcagggacacccccagacatgccggtgttcacagagcagatggtaagggggccaggccagtgggtgggtgggtgggcggggccaggccgtgactaccaccaccgtccctacagcagatccagcaggagcagctggactcggtgatggactggctcaccaaccagccgcgggccggcagctggtggacaaggacagcaccttcctcagcacgctggagcaccacctgagccgctacctgaaggacgtgaagcagcaccacgtcaaggctgacaagcggtgaggctggggctccgcgctgccccgttcagcctggggccgagggggactccccctactgcatctcccaccccctcacccctgggggatgccaggtggagcaaatacaaagagagggtgggatgagggccggacacgtgcgctgtgcctgcaatcccagtactttgggaatccgaggcaggtggatcacttgaggtcaggagttcaagaccagactggccaacatagtgaaacctcatccctactaaaaatacaaaaattaggcggatgtggcagtgggcacctgtaatcccagctacttaggaggccgggacggaagaatcgcttgaacccaggagttggagaccaacctgggcaacatagcaagaccccatctctacaaactttttaaagtttttatttatttgtctttgagatggagtcttcctctgtcacccaggctggagtgcagtggcgtgatcttgtctcactacagcctccatctcccggcttcaagtgattctcggacctcggtctcctgagtagctgggattacaggcacccgccaccatgcccggctaattttttttaatttttagtagagatggggtttcaccgtgttggccaggttggtcttgaactcttgacttcaagtgatccgcctgcctcaacctcccaaagtgctgggattgcaggtgtgagccatcgtgcccagtctccatctctacaaacccttttttaagaattagctgggcgcagtggtgccccctgagaaagtgctctctccccagggacccagagtttgtcttctacgaccagctgaagcaagtgatgaatgcgtacaggtgagtggtggccagcgggacctggagcccttcaccccctacgggttacagccgaggggactgcggcccacgggggtctaggggttcacgttactgccccgcaccatcctcgacctcagggaccctgctttctccacagagtcaagccggccgtctttgacctgctcctggctgttggcattgctgcctacctcggcatggcctacgtggctgtccaggtgagcagtgcccaggctcaggtggggcaggggccgcccgccgggaggagctgggctgggcgtctccaagtgcatcctggcccctgctcagcctagagtcacatgacctggggctctggccccgcccacatcctcactccctcctgctgtgtccccagcacttcagcctcctctacaagaccgtccagaggctgctcgtgaaggccaagacacagtgacacagccacccccacagccggagcccccgccgctccacagtccctggggccgagcacgagtgagtggacactgccccgcgggcggcggcctgcagggacaggggccctctccctccccggcggtggttggaacactgaattacagagcttttttctgttgctctccgagactggggggggattgtttcttcttttccttgtctttgaacttccttggaggagagcttgggagacgtcccggggccaggctacggacttgcggacgagccccccagtcctgggagccggccgccctcggtctggtgtaagcacacatgcacgattaaagaggagacgccgggaccccctgcccgatcgcgcgcggcctccgcccaccgcctcctgccgcaaggggcctggactgcaggcctgacctgctccctgctccgtgtctgtcctaggacgtcccctcccgctccccgatggtggcgtggacatggttatttatctctgctccttcttgcctggaggagggcagtgccagccctggggttctgggattccagccctcctggagccttttgttccccatgtggtctcagtgacccgtccccctgacagtgggctcggggagctgcatcacccagccttccccttctccgactgcagggtctgatgtcatcgttgacagcctttgcttcgtgggggcctgaggcccctgcctccccgacccccgacccactgcaaacccccgttcccccgcactcctcttctcccagcccatccctccggcccctgtgcctctgcggccccagcccagctcccagggccgtcacctgcttggccctggcccagctccctgccctgagtcctgagccagtgcctggtgtttcctgggctcggtactgggcccccaggccatccaggctttgccacggccagttggtcctccctggggaactgggtgcgggtggagtactgggaggcaggaggtggcccggggaggcttgtggctcctcccctcgctcctcgccctgggcctcagcttcctcatcaatagaaaggatgtgttcggggtgggggcgtcaggtgagaacgtttgctgggaaggagaggacttggggcatggcctctggggcacccttcctggaactcggagaggaaggtccgggccctcgggaagccttggacagaaccctccaccccgcagaccaggcgccgtgtgtgtgtgggagagaaggaggcccgtgttgagctcagggagaccccggtgtgtccgttctttagcaatataacctacccagtgcgtgccgagcaggcttggtggggaagggacttgagctgggcaagtcctggcctggcacccgcagccgtctcccttccgtggcccagggaggtgtttgctgtccgaaggacctgggccggcccatgggagcctggggttctgtccagataggaccagggggtctcactttggccaccagttcttcggccagcacctctgccctccagaacctgcagcctggaggggtgaggggacaaccacccctctttcctccaggttggcaggggaccctcttctcccgtctgccctgcgggttgcccgcctcctccagagacttcgcaagggcccatcaccactggcctctgggcacttgtgctgagactctgggacccaggcagctgccaccttgtcaccatgagagaatttggggagtgcttgcatgctagccagcaggctcctgtctgggtgccacggggccagcattttggagggagcttccttccttccttcctggacaggtcgtcaggatggatgcactgactgaccgtctggggctcaggctggtgtgggatgcagccggccgatgagaaaataaagccatattgaatgatcgccaccagtgtttggtctgggggctgtgagaattggattgtgacaa

SEQ ID NO: 7146 - DNA, 607 bp, Homo sapiens
gagcagagggagtgagggtggggaagggacagggcaggttgtgcagggcctggtgggccacggggaggacttgggctttgaccccagggcagctgggagccatggagggctgtgggtagaagagcgacaggccctgactcaggtgctcccaggcgccctctgacggctaccgcagggaggacagacgggagtggcgagggtttagcctaggaccgggtagaggtgactgggctggcacaagtggaggcagagaaggatgggctcatcctgttccccctccaccgctgtgttcctggagtgcagaggaggggctacagagatgcttccagaaccagtgtgtggcctggaccaagacctggactgctgggggcttcctgagcaagacccacatccctgcagtcaaagctgcctcttctcagaccagggaacttcagaaacaggcagggaacccacccccccaccagggtcccctaggaatcggcaacagagcctcaaacccagcacggggtctctgcctccccaaaacatgtggcaggagaagcttgttcaggagggagaggagggaggggatggacccagagcgaaaggcaggcagggcagggttgca

SEQ ID NO: 7147 - DNA, 606 bp, Homo sapiens
gagcagagggagtgagggtggggaagggacagggcaggttgtgcagggcctggtgggcacggggaggacttgggctttgaccccagggcagctgggagccatggagggctgtgggtagaagagcgacaggccctgactcaggtgctcccaggcgccctctgacggctactgcagggaggacagacgggagtggcgagggtttagcctaggaccgggtagaggtgactgggctggcacaagtggaggcagagaaggatgggctcatcctgttccccctccaccgctgtgttcctggagtgcagaggaggggctacagagatgcttccagaaccagtgtgtggcctggaccaagacctggactgctgggggcttcctgagcaagacccacatccctgcagtcaaagctgcctcttctcagaccagggaacttcagaaacaggcagggaacccacccccccaccagggtcccctaggaatcggcaacagagcctcaaacccagcacagggtctctgcctccccaaaacatgtggcaggagaagcttgttcaggagggagaggagggaggggatggacccagagcgaaaggcaggcagggcagggttgca

SEQ ID NO: 7148 - DNA, 9760 bp, Homo sapiens
gtttattctgaccaaagcatttattttcattccatttacataggaggtggcattgtagaaaataaaaactttctcaaagagatatgaattaaagaaaagttagagtaaggtgaatacttatttaaacatacctttagagtgagggtaagcccccttcccaacccaaaatgaactgaatgagagagaaaaagaggtccagagtagtttgtggagcgatgtttccatctctaatgccactcagctcaggagcaggcttcagacactgcctttatctttacagaaagccatgggaagggaaatgtctgaggtagagctcagcgttgggcatcatatggctaatcactcagaggtcactaatcactctcccttttcttgtttttcagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaagttggcagaaagtcctcccctttaaaattcaagcctgaaggttttgtgtgggggcctactgccccctaatgtcttctggtgatactgcagcacagtccatcaaaatagtttgtggttttgccatctgttactccttatgcccacctggagaggggctagcatctttaggtgggaccacccctggcacaacatggtctctgaggtccagatactctgagggtaggggctggctctctctgcctccctatcccctacaagagggacagggagaggtagaacattgggatctttactcagaggctcagatggacccttgattctcccaggagtcatacattgaaggtaccagagcttccattttataaaagaaagcaagcctgccgtggacctgtcagccccacgatatctgtcggcatgggccacagccaggacagacttaagggctctccaggtgccagtcaagatgcctggctcaggccatcaggagctggttagccccattccacccccagccctgcatgcagggtccagccattgtctttgggggaaacaggcagaataagtggaggatggagctggggcttgggctcctctaggtaccttctgagagctttgacaagccagaaagaagctaccaggttgagggtgctggtcttctggactcaggagagacatgttcgccgaggatatcagctggctcttacctcctggctttctctcctacaaacacacccattccttgggggcttgtaacacagtgcgaggtgggtcaccaacaggcatcagactggtgtagtcatcagcgggtagctacagaagggacacagatttagggcagagagctcagccagacccgccaggccctccggccacacaatctcacctggtaggcctggaagacgctgagcagatccttcataccagccgtgtatgggacaccctgcatgcggaccaaggctcctgactgggacaacactgaggtgggagcagaggccagggcagcagtgggtgtagtgaggtagcccacagtggtgggggagactggggggctagggtgggagagacaaggtttagtcatgcatgccacctgtggcctagaccgagacctgtttccctcctcccttgtttctgccttgtgcttaattcagttcctccctgaagccccagcctctacagagtcattttcgatctgttttgtagatggcattagccagctgccaccttactcccttgtcatctcaagggaggagttatctggtccagaaaggggatcgtgacctttccccagattgggacagggagtgggactgtgatattctcttagctgcagggtaccttgggtagtaggctgtgtagttcaggtagagttgagtggctggccctggatagtaggcaacaggggtgggggcagcaggcaccctggcagctgggagcagtgctgaagaggggtatagagctgccgtctccgtgggaatgagcgttggggtggcttggaaggtggtgtaggtaggtggtgagaggcctagagacggaagtagaaagtgcatgtgcacggagcccagcactgccctgggtggggtagccagaaaggagtccccgctatagaaggtaggggcttacaacagcctggctaccacaggcctcctcctcccctagcccctagggcactcacagggcagcttgcagggtggaggggacatgccactgcggcccaaggtgccccccatcagcactcggctcatctcctctgtggaacaggggaccacctccacgtagcgctccttcatcaccttcttatggcaacgctgagcagcagctagggctcgctctgctgatgtcatctgaatgaaggcatcgcccgatggccggccctgtgcacaccatcttgtgagcagtttgtcatgtgtaagagtgccttacccctaacacacaccccttcctatttatgtgttccccctaccaagcagtggcttcacctgctggttgagcaccatgtgtacaccgtggggccgaatgtcagctgctgcctcccccagaaagctcaggatgtcttcaatggtggccgtgtagggcaggcctcggaggcgtacacagtccctcccagtcccaggtgccagtgggaaggggatgggcagcagtggggcagtcagtgtaggaaggagtgggccggatgcatagcggttcaagacctagtaaggaaggcagcaacaggctggtcatgccaagtagggcagggacacagagggccgccctggagtaacagtacatctgggggtggggagccctgggcgctcacctgctgcacttcggctgcagtgctccggaagagttcaatgtatcgcttacccagcatgcccttgtgcctgcgcagtgcagcctgtgccagctcctcacaagcaaagagggcgaaggcatcaccagtcggccggccatcaggatggcgcacaaagagcagcccctcggtacccccagtcactgggcactctggccccaggaagccaagcacgtccgttggcccagccgagaagggcagtccccgcagccgcaggatcacttggtcttcccgtgacaagaaacgagccacctctagtgatgtgcctgtgtatgagagtcgcctgctgacttcactcatgctcctccagacactcacccatgcaggggagcaggcaggcaaggggtggtggggaagtgaaatggatcaagaaccaggggagccaggccctgtttgcagtatactcaccccctgcaatctttacaaactcctcccctgtcgctttatacacctgtgggtacagagagcagcagcccatgggtctcaggcctgactcagattggccctgctccgctcccagcccaaagccccacctcaatatagcggacgcccatgtggtgcttgtgtctctgcagcgctaggtcccgctgctcgctgtccacaaagcggatgagggcctcgccatttctgcggccctgggcgttgaggcagagtgctacaccacccctgtggagccagtgctgttagtgcctcctgggtaggcctgtccaattgggcccacccaccctgccacacccacctggccacgttgagccctttgaagaagcgagccacgtcctggtctgatgactgccacggcaacccacgagcccgtaccacagtctcactgtccaccacatcagccttgctgctgtaggggcagggcacagtgctgtcagagctattcagctgttgtcacccccagcccctgctcccacactcaccaaggccccgtctcgtatttctgctttatcacctcgggcttcgaaaacaattgacctgagaaaagatggcctgggggtcagcagggtctggtggagaggggtgtccccaccaagttctgcaaaaagtggacaattgagagagatgaagaaatgacaggccgagcacagtggctcacgcctataatcccagcactttgggaggccaaggtgggtggatcatttgaggtcaggagttccagaccagcctggccaacatggtgaaaccccatctctactaaaaatacaaaaattaggtgggcatggtggcaggcgcctataatcccagctactctggaggcttagacaggagaatcgcttgaacccggaaagtggaggttgcagtgagctgagattgtgccactgcactctagcctaggctacagagggagactgtctcaaaaaaaaaaaaaaaaaagaaatgacaaagaggattcccccgtggtctcttagagaaggtcacagtggggaggagcaataggcatttgtcatccctgagaacaggtgacaggcagtgagggaaaccttactgctgggctctttgagtagatggaggataacagctaccattgtcttgacttcccagaccccaaagtcatcctctgtggcatctgtctccagtcctaaacctatgggcagagaagtgacagtgaagacatcttagcataagcactaatcctgtttactcctgggcccaactcccctccatagacacatgctggagaccagcatacacatttgttttggcccagttcatgtgtgcacatacagattcccagtccagacatagacagacacatacccacattccaaactcatcctagcacagacacgaagacacagtacactcagggacttagcagataacgcagtcttgtatgtgtccatattacccacccacagcatgcacatactcagacacatgtacccacagtggcttctccaccctaaccctgctgggtcacagataccctgtgccatggtggccacagtgaggtccctggcagggcaggtgcttggatgctgcatatggaattctcttcggaggtcatagaaggagaagaacatgtcggggagcaccaggttctgggggcacataggattgaggatgagcgccctgcccaccctcaggacaagaggggttctgggaaccttactgaccaccccaccccacccggttttccttcaggagcataccttcctggaggcctcggggtgcaggacctgtcgcaatagctgctgcccatcagtgcagagcatgtaggggcccccgcccagcaaagccacatccccgttcaccagctgtgagaactggggatagggaatggggagagagaaacacacagattcacagctgggcaggcaggaagtgagggtaggaggaaggaggcaggctgcaaagctggttcagccagatgttcagccctatcctgcctgggaataagaggccacgcctgttgagcctagccctatgtcccttcccctcaccccccaaccctgttccagtccactgtcacctcctccaggccaaatgagggcaatcacatataaccgaagccctcaacacacacactccaggagtttggagtggggccagagcaaacacctggagtgggacaagcaggtgggaaggggcggggcaaagcaggttaaacctgtctttgaccgggtaccaccctcagacaggtgggggaggcccaggcctgcctgaggcccagaaggctcatggtcaatggcagccccgcctccaggtctgaccaaccgaggggcagagaaactccaaggacagagctccacacttggacatcaggggcagcatgagctttgacccacatcctattgaccggctggcactgagctgtttgctcatagagggggtggcactcctgaggctgcccagccctcccccagcctccatccttgctggagaagtataaacactaatcagtgacccacgaaccctccctgccaattctgtgacactttacaacttggggctgacagagcaaggcaacccagctctcctccagcaaactccccaagtgaagggccgggagcccttctggaacagacaaggaatcatcatcgtggtgcctcctcatcaggaaccacaagagttgttggaagatgaaagaacgtgagtgtataaaaaggacttacactaattacactcaagagtcagacatagaatgagcgccgtagtgaagataaggaaaagaaaacagcaatggaaaccacctcccacttcagctagggcaggaggcaccccaggcctttgcactcagcaggcagatagtcccccaggccaggccgggacagcgcccacgcctggccagccggccgggacaggcctagacgagcagtttacacctggcggcgtctacctctagggccgacaccgccctacgcctccgctccagcagctcccaagcaggccgaagacgcgggccgcaaggacaggtgacctatatgggcccctcgacccctttcgcttccggctgcggctcagggagacctgacccagcaggtctcccaaaggcgtctcggcctcgctccccgggcgggaactggggatggatcccaaagcctgcgtcccgatcccttcggtaggagtaggttcctgcaatggttgaaaagtaaggagcccaggggaatggctggcacgcgcggatgaaaggggcacgcacacgcgagagtcgctcaaagtttcaaacaagagcccagtcctgccgcctggaccggttggttgcggcacgccaggcctagcctccggccgccaatcccgcccagaaatgtcctcacgtccaggccatgccgccacccaccccggcgctcacctgctgcagcaccttgtccagcggctctgcccgcgccaggctgtcggcgctcaggccgctcgcctcgcggcactgcgtactcagtgcggccgc

SEQ ID NO: 7149 - DNA, 431 bp, Homo sapiens
ctccctgtttctccctctctacaacctgtaatctattttcgtgtctctatggattggcctgttctggacatttcatataaatggaatcatatatgaccttttattgtctggcctatttcacttagcagactgttttcaaggctcatccatgttgtagcatgtatcagaacttcattacatctcaaggctgtatattccattttatggatagagacaacttacgttatccattcatcacttggtagacatttggattgtttccactttttggctattattaataatgctgctgtgaacatttgaaagtttttcatgtggacatatgttttcacttctcttgtaaatatgcctaggagtggaattagcatagactctttagttgataaggcaaggaatgaaatgatgtgagaactaaaggttcttatttgggg

SEQ ID NO: 7150 - DNA, 354 bp, Homo sapiens
tcggcacgaaccagcgatttgtgcagcgtccccacctgtgagcggcgggggaaaccgatcagccgcgcccctcgaccccggaagctccctggggacctcaccgcctcttttccaccctacctggcggctccgcggctcaaccacttgccaaactaggaggattaagtcggtctcgtccgagcccaggtcccgtcccagcgcacccgccgtagccccgaagaggacgaccagtgatccgggccaggggcaggggtccgcggcggggtcggccgcggggtcagggcccgggggagggggcggcggcggcggcggagtcatggccgcagaggaagggggctctcggccagacacgcg

SEQ ID NO: 7151 - DNA, 1695 bp, Homo sapiens
gaagcaaacttgagtttcccatgctctgtggctgagcaagtcacttcaccattctcaggttcagtttcttcatctgtgaagtggtattataagggctgttgactgcttagggttgtctaagtgcaaatgttgctgtgggttgggcaggaatgctttaggaaatacaaaaagccatagacagaactgcactgtgatgataaaagtcatttagacactctggaagctatagagctggaaggaacttcagaaataatagtaaagaggtttcagtcttttatcttgtgaagatgcacagatgaatcgtgggcaggagcaggacacattactttggtggctcagatttttggtctctcactttaagaggcacctaaacggcaagcaaaatgccatcgctggcattggctccttctccactccactctcactcactcaagaaagcataccagaatgttagtgagagaggttattataagggtaaccttgatttcactctaatttatttttcaaaaatgcaaactcaggattctcacatggaacaaaaccctgacccaaaccaacttaagcaagagttgatatttattgactcgtgaaattaaagaatatccagcagtagaggctttagtcctggctagatccaggggatcaaatggttttgtcagaacttagactatttattcatctctaggttctacttttctttctatcgacactgtcagacagagtcttttcatgagtgataaatggctgttggcaggcttcggtttgtatccccaaagcttagcaccctctgtgaaaagagagctttcttctcccaatagtttcagtgttaagttctaggattaagactcattggactgacttggaatcactgtcccctatccttgaatcagccactgttttcagggcagtgggatatgctgactgcctaggactacatcttctctttctttctctccaggatggaagtggggatggaggtggcatcggcctcatttgaaccacatggactaagaggggctatgggagtattccccaaaggaagactgaggggcgttactagaaaatgggagaatggaagcagagtgggcaaaaccaacagatgttccctatagtaaataaaaaatttggacaattattagtgagcaagtacttataacatatatggcacatgggattgtgactcaccagtgtgttagcacaatatggtcaaaaacctctgatccaattcaacctactcatcttaacgattttatcagcatttaataagtttgttttggccatcatgtgttatagttttgtttgtggttttgacacctcattagaggtttcatcagtgtaaggagccaacctaagagctcttctcacaagtttcccaagagagaaattgcccctccaaatgtgaggagtctcactttatatagatagcatccacacttcttgcagtggaaaacaaaccttataaaatgtaatacgtttggtttcctaactttttcatgaccctggggtggtagaaggaagtgcaagttttatcacttggatttagagacaaggaaattgaaatggagagagaattgggctcacatgcaggcagcatgtctagctgcctccatcgtgtgatctgaggcaccccatgaggcctatgattactgtaaacctctaaaataaataaaaaataaaacaatctctgccactgaa

SEQ ID NO: 7152 - DNA, 1695 bp, Homo sapiens; identical to SEQ ID NO: 7151

SEQ ID NO: 7153 - DNA, 114 bp, Homo sapiens
tttttgtatttttaatagagacggggtttcaccgtgttagccaggatggtcttgatctcctgacctcgtgatccgcccgcctcagcctcccaaaatactgggattacaggcgtg

SEQ ID NO: 7154 - DNA, 114 bp, Homo sapiens
tttttggatttttaatagagacggggtttcaccgtgttagccaggatggtcttgatctcctgacctcgtgatccgcccgcctcagcctcccaaaatactgggattacaggcgtg

SEQ ID NO: 7155 - DNA, 115 bp, Homo sapiens
cacgcctgtaatcccagcactttgggaagctcaggcgggcggatcacgaggtcaggagatcgagaccatcctggctgacacggtgaaaccccgtctctactaaaaatacaaaaaa

SEQ ID NO: 7156 - DNA, 2357 bp, Homo sapiens
agtccacacagcaatctcctttcctcttcagtgagaacacctctcctttgatcaacattatttattcggcttagtttaaaattcctcttgaggagaagtttctgggactaaacatttgaaaatatttgaaataaaaaaattacctgtttttaagtgacaaaaattattaatttataagttacttaggaatgttctcaggtgcaagtaacagatgacacaaacacagcagattgaatcggcgatggtacaattttctcatgtaacataaatgcagcagctgcatttgttgggtggctcagtggccttttgggcttttccttcatggttgcaagatggcactactccaactcaagcatcatgtttgtattcaagacagaaggaaagggagacggtttgtatcagtcactctgacccttttatcagaattgcataagtgctcttagaagcagtctgcttctccctaagatctttgctcagatgttattgggcagagcttttttgtgtgtgtagtgtctaatggttgcaagggaggttgggaaaaatgattcttttttttctggcttttatagtggaagcaggcaaaagattagttgggtgtagttgttgggttagccggtcatcatgctctgcccctaagtgctcagaatactgaagactaaagatgcaatgacaaacaagatagtccttattgtttttgtttgtttgtttgttttttgtttttagatacagctataattttattacaaaactgttcttttggcattagttagttacagtgatagcaagataatgtgagtgtgcagactggctctgatggaaccactgtattccctgcttactgaaccaaacttcagctacctcatatccattacatacaagtgacctgcagttattactgctacaaatcttgacgcgtgtaccgctgagggaggagctgatgctaagggatttgattacatgttgataagactacaaaagttcgtttatgggactttttcttcctcttcccatgcaatgactttgctttagaacaatcacatggcttagagctagtctgagtagcagcagcacccaaggagcgtcagttcttgttaaaaagcaatacctgtgtgatgcatttttacgccacaggcaaagggaaggatcaccctcattttaaactcctgcagagtcccttaataaaatatcaaagcattccatcaagttcttctgggtggtgttattgctgtacatttgttggtgagtcattttctgtgctgtgtttgctttgaaaggatcttccaatttatctccaatattcctttcttatcatgtccttttctttagctaggatttcacataaccctaatgcattattaagaatgtcttccttattgacacactggttttctagcatgtcttcatagatacccacaagaaaggcaattaggtagggggaactatgacttggttgtaaatcaagtaattgatttaacagattaggatatttggaaagaccacgatcctgcaaaattcctttcaaatagttccatgaactattatgtggtactagttgaatcatttccagagtgtattggacttctctctccaatacagcacaatcattgtagccagtggtgttggaaataacaaaatatcttcggttccagacagagttatttctcacatcctctttgagaagttggtccacatactgcagctcattatcccaaagtttaaattcctgaataacccattgtcgatgctgccaggcatgataattctttgcatcctgattaagaatattatcaataaattcaggctcctgagatggatctcttagccattccactattactcgcctattgtgacaaactagatagtttttgggctgcccctcaattatttcagtgatgtagttcatttcctcatgtagatccttctgaagtgactttaagagaactctccggaaatgtcacactgtataattggctgcatttaactcaacagcatcccgggttagcttaaaacctcgttcgcttctttcttcatgctgcaggacagctcggaagtaatcaaacatctctaaatttgtcactataaatgatctggaccacgggattggggccatcattctgcggcactggatctgtatcagcccattctgttctgtccctgtacgggacataggagggcgaatccaggctcagaaacccgtcgtccatgggggacgccacggcttccccagcctctgctgccatctcttcctcgtgctgctcctggggcagcggtgggtgcggctggggcgggggctgctccagctgccggggctcaccgccttgcgcagcctccccgaccccctcggtggccgccatctc

SEQ ID NO: 7157 - DNA, 2357 bp, Homo sapiens; identical to SEQ ID NO: 7156

SEQ ID NO: 7158 - DNA, 11839 bp, Homo sapiens
gtcgactggaatacttgggagatgagatgacaggtctggtcatgaccaagacaaaaactcagcgtggcctcatggagcccatcactcacatcaggaagccccactccatccgggtggagacaggtgaggcgcagggctgtaagccagctagcatcttgtgcctggcccggaggcagggtagtgtggaagtggccagcatagctctacagtgaaacaggcccagggcctgtttctctgtggttctctggggtcttaggcaagtcccagagtcttcctgaagtccggctccctcttctttttcttcagtaaaacggtgagagagctaggaaactggagtgcagccatagagctgccgtccagtgtggagccttgagccacatgccgctggtgagcgcctggatcgtggctgccctgccttgagaagtgctgtcactgtcaactggacactggctttagtgtgaaaacaatatattttattaatcatttttatattgattacatgtcaaaatgacaatatttttgatatactgaattaaataaactatattactaaaatgagggcgggcacagtggctcatgcctataatcccagcactttgggaggctacggcggatagatcacttgaggtcagaagttcaaaaccagcctggccaacatggtgaaaccctgtctctactaaaaatgcaaaaattagctgggcatggtggtgcgcgcctagaatcccagctacttgggaggctgaggcaggagaattgcttgaatctgggaggtggaggttgcagtgagccaagatcatgccattgcactccagcctgggcaacaagagcaaaactctgtcttaaaataaataaataaataaataaataaacaaacaaacaaactatattactaaaatgaatcccacctgtttcttttttcctttttcagtgtggcatctagaaaactttcagtgacacgtgtggcttgtgcttgtggtttgcattctgtttctcttaagcagcactgctttagagcctgccaggctgcctgggttcaggtcccagctgtgtcgtgttagtgaaccccagagtggttgaacccctctggcctgtagtttcctcatctgtaaaatatgcacagggttgtgatagggctaaatgagatatgaaatgtattaagaggttctggctcattgttaagcactcaataaaaggtagctgctgttattatttttattataatccaaagatttggctatttggaagctaatttttcaggagtcttgtgtagggctgctgaggaggtataggacaggagaacgggagtctagctgccacagggaagctgtatttttagtccttcctagaaatggtgttgggataggcactctcagagcccttgagaagtgggtgagcaaggggacatggcagcagcctgtgctgagggtccttggacctcatgctaggattaccagcccagagggacgcttcataccgctacacctgggatcggagtctgtttctgatctaccgacgcaaggagctgcagagaatcatggaagagctggatttcagccagcaggttggtatggcctccatgccccagtcagaagccccttggggcgatgcctgtcttcagtcagctcatcttacctttctccatctctcggaggatattgatggcctggaggtggtgggcaaagggtggcccttctcggctgttactgtggaagactacacagtgtttgaaagaagtcagggaagctcctctgaagacacagcatacttgtgagtgcagcctgaaccctggggagagaggctgaagagttctccagcacctaccagtattaaagagcgggcttccctccctgagatcagggtgcctctagcctagcttctgtccagtggttgccacccactccttgaacccattccagcacctgtgctggctttcctattgccatctgctcctttccaataaccaactcctaatggggatttcccagacattcccttgctggtcaactgagggctctctagaccctcccactgctatgcatcttgaatgcctctggcatggagagtctgtgtatttctgtgtactgtgagtggctctggcaagagggcttaaagagtctgtgtgtttctaagaatctcccatctacagcaatgggtcaggaggaagctgcgtgggagtggagttgatcatactccattgcagggtagagctggttgtgtttctaggcttcctggtgaccgtttctgtggggttccacatggcatgactgtggcagcctaagagaaaataagtcattggcttttcttacagaggcacattggccagttcctctgatgtctccatgcctattctcggcccttctctgctgttctgtgggaagccagcttgctggatcagaggcagtaatccacaggacaaggtaaaacagcctccaccacacctgctgggagagcctccctcaggggtgcagccctgaggtgactggcagttaccagcagcctgcacagtctcctgtttgggtttttatctggtcgtgcattcagcacgtctgaaaatggtgacagcaacactgacttgagcaagaataaaatcacaaggctgcgagtgtcataagccacttggggcttatacccagcccccaagcatgtaaacaagcaaactcaagtaggtatggctctaagaaggttccaaaatattcttcagatgctaaggaatagaagtgttcattggatataaaatatattttatctggccaggcgcagaggctcacgcctgtaatcccagcactttgggaggctgacgtgggtggatcacctgacatcaggagttcaagaccagccctggccagcatggtgaaaccccatctctactaaaaatacaaaatagcagggcgtggtggtgggcacctgtaatccctgctacttggaaagctgaggcaggagaatcgcttgaacccgggaggcgggggttgcagtgagctgagatcacgccattgcactccaacctaggtgacaagagcgaaactctgtctcaaaaaaaaaaaaaaaatatatatatatatatttgttttatcttctcttcttgctattgagggtaacctcagagacaaccacgctggagtaggataccactctgtgtgacagtggccaagccctggaggcctgggacacgagacttgcagtgctaaagccagaaaagtcctgggcagaccagatgagttgttcactctaggccagggtttgcagcaaagacatttcttgtccctcctccttccagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtactcgggagaagccaccctatgtgctagctcctgtctggggctggttttgtcctccgtgagacatcaaagtttagttatggcccagctcctgtaagtttgagccctgcttccctgccttgtccctctcattccttctgtgaaatgtgtggcctgactactcatgtctgttgagagactgatggaacttgagaacctggggaggtgagccaccagggagcagaagcgttctaggggctcagttatctaggtgcacaggcctggggctaggatggccagctgtctctgtttgcctgggactttagcactcaaattcccacattccaggaaacctctcagccctgggcaaactgggatggttggccagccacctggcctgggactcagttaactgcatgtaggagcatgtaggcctggggctcagccagctcctgcatgttgaaaacctcgggtctctgtccctctcaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggaggtaagggacccaggaccatggcccctgtggacatcaggtagggtatcctggtgttcttcctggcagtgactgaagggatcatatttctcccagcctaagaggagaattggatttttagcaaacaggtaactactcttgctccacaaacacttcccagggcttgtgatttaaaagatgggtgcgctggctaggcaggcatggagcagcttgcagcaatgccatgcatggccccactgagttagaaagaaattagactgagccttaagaggcagactgtaaagtacaatgtgtggccctatgtactggtctgtgttttgttcatcgctgtctggtactacacagtggagttgcatttaagcgacaagacttcaaaaccagggagaataattaattaatacatagcagcatgagtctgcccaccgtcccactcaatcagctgacaactcgagtgagtgtgaggtgggagcttggaatctgtcgtccgcagtcagtttcacagtgtggccatttgagccgtgcatcctgggatttggtggaaagctgtgcttttttattcattgtggcccccaatcacaaggccggctccttcatgtggggctcagccagtggtgatcaaaggtaattttgacaatgtcatgcttgctttactcattgactgtacaacccatgtctcacacaaggcgcccctcccgtgtttctgtgacactcactgaagcctgatgaaggttcaccaccatcctcagaagcacccccactatgtgccctgccccttcttcctaatctggtgacatgctaactgtgtgaccaccaggccccaggcagcagcagctgtcactggaactggccctcctctggatccttttcatccatttttagggaacaaggatgtctggagagactcagaggttttcaggtcttagaacaggcgtgtgtgtgtgtgtgtgtgtgtgtgtgagagagagagagagagagagacaatggcaggaactcagaccctaggaaggcacaaagtcctgggggctccaacttcctgaaggatgcattggttttgatagcctgggctgccatcctctgccaccttcccttttgcagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccggtgaggcccagcgccagcccctgccccctcatgtgtgccctgcgtcaagggtccccaacccgcaggccgcacagcggcaggtgagcagtgggtgagccagcattactgcctgagctctgcctcctgtcagatcagcggtggcattagattctcataggagcacgaatcccattgtgaactgcgcatgcgagggatggaaattgtacactccttatgagaatctaactaatgcctgatgatctgaggtggaagtttcatcctgaaaccattccccaactccctgccatccgtggaaaaattgtcttccacgaaaccagtccctggtgccaaaaaggttggggactgctgccctaggtgacagtaatagcaaactcttttatgtgccaagctctgttctgcgcatcttccatgagtaactcacctctcttcacagcagtcctatgagatgggtactatttatttttgtttatttttttaagaaatagcgtgtcatactgtcacactccaggccagagtacagtgtcccactcatagctcattgtgacctcaaactccccggctcaggtgatcctcccacctcagcctcctaagtagctaggactacaggcatacatcaccatgctcagctaatttctctttttttttttggtagagataggatcactctatgtcatacaggccggtcttgaactcctgagttcaagtgatcttcctaccgtggcttcccaaagcactgggattgcaggcttgagccactgtgcctggcccttgtactatttatgtccttatttacattgaagaaactggggcctgcaccccagcctccccctcacatgccttcccatcctctgctgcagctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagcggaagagcatcatggaggagatcctggtggaggaaagcccagatgtggacagcaccaagagcccctgggagccggatggccttcccctgctggagtggaacctctgcttggaggacttcagaaaggtgcttccaagaccctggaaggcaatggtagagaatattcctgcctcgaaccaacaagggaggacccagcagcccctcttgctctatgggcaaagaaacaaaacctgagagcccagagaaagtgatctcttgggttatctatctatctatttatttatttatttatttatttttgagacgaagttttgctcttgttgcccaggtgggagtgcaatagcacaatctcggctcactgcaacctccacctcccaggttcaagcgattctcctgcctcagcctcccaagtagctgagattactggcatgtgccaccacacctggctaatttttttttttgatggaatcttgctgtgttgcccaggctggagtgcagtggtgcaattttggctcactgcaacctctgcctcccgggttcaagtgattctcctgcctcagccttcccaagcagctgggactacaggcatgcgccaccacatccagctagtttttgtatttttgtagagacggggtttcgctatgttggccaggctggtctcaaactcctgacctcgtgatccacccaccttggcctcccaaagtgctggtgttacaggcgtgagccaccacgccaggccaattttgtatttttagtagagacggggtttcaccatgttggtcaagctggtctcgaacacctgacctcaggtgatccgcccgcctcagcctcccaaagtgctgggattataggcgtgagccactgtgcccagctgggttacctgtttttgtctggggtgcccaagctgctatattccaggaggggggcctactctctgaccctggcaaatcttggagaaggggttcataggtacagatttctgaggggggtccctggctcccaccaaaggcacccagacagctctccatagctgcatcccctcctggttcctggtcccctgccacccatccccacatcaccatgcccttcactagaggacacagccttggtgtcctggtgcagaatggtgcccatgaccctgccaggcagtgatggtgctccctgatgagaaccacagagaggatgcgttgatgaggctcaacaaagcagccctggagctgtgccagaagccaaggccattgcagtccaacctcctgcaccagatgtggtaggtgccctgccaggagagctgccccatctccttccctttgtggcatctgcaggggtcctgggcaggcagtcctgggactccaggggtctgagcttccgttgagctcaggttgctagagcatgccgcaaacattccacgttctggaaccctgccagtgcctactgctcactggagagcagtcacagcagatcaaacaccttatcttttttttcttcccctttttgccttgttccttctcagtgagcaggggaatggaaaaaggagaagccagagggcaggaagaagacggggggcagattccaataaaagcttcatttctctgttgtcaccctcccctgtacctgtttggaacttgcttgtataggcgtggggtccttttcaaggccctcaggacaagccccaggagccttatgctggaagtctcatgcaaggttcagcccctccagtgcgactggacccaagtctggccctggcctcaagccctctgaagtaggactgaattcatgcaggcctcctaaccctagtcctgggccatttttttcttggttgccacccaaggcaagccagaaccccctccaagcacttgccctggcggggaacagtgaggatgctggctgttcaggggtgtggcatttccacagcagctcgtggcaccagggtctttgaagggagggacccaagcctctgcaggttcaaggacaaatgaggagtgatggcatttctccactgtgtcttgccctctagtttgcagctgtggcgagatgtgattgacagcctggtgggccattccatgtggctgaggtctgtgctgggcctgcctgagaaggagaccatctatttgaatgtgcctgaagagcaaggtcagatcttgtgcaaccaaccacacctctgcatagccctcctcatctctctgaatggacaagcagcagtgcctgggccagtcatactcctttggtggaagctctgctaggttgagcccatggagtaggccccttacccctttctgtccgctgccaggatgtggtacccagaagctaccttagtgaccaccttggtttagtaatcccagcaaagttaaatgacttatccatggccattcatggcatggcagagctgggaccagaacataggcaccacagtcctgtttcatgaagccacgcgcctaccagggctcaaggctattgccctttgcttttccacctcccctcaagcctcctcacgtacctgcagcatccactaggctgttgggggcctgccatattttcttccacccacctcccttagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggcatgctggggcgtggtctgggccaggtggggctggggaggggattggaggggctgcggaggtgggggctgtggaggtgggcatgtgcccaggctctcccagtgagctactgttgaggacatccttggcctacctctggagctcctgaaggctatgtgtgtctccctcccccagcaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagcctgcacagtgaggtgaagggaagcgcccagcagccattcccctgcctcccacctgccttattcattccgttcagtctgcagacaataagtgcccactccatcatggtggaagcagagctgcttcaggaagggcatcctcgtgtgtgagacaggcctcatgaataaggaatgcgcctagcatgttaggtgatgagtacgacgggagagaagatagaccaggcagggaatggaggcacagaggcctcagtgaggaggtgacaacccacaaagatttgaagggaggggaagggtggccaagtagacgtccagtaaagagtgctccaggcatggggagcaactgccataggagggaggggccagaagggagagggcagtagtggggagcaggtcataggggtgggggatggtttgcaggctattgtgaagacttgggatttttcggagtgaaatgagaagtcacgcaaggttttgaatagaaacgcaatagggtctgataggctttagaaggtggctctggccgccctttggagaacagactctaggggaacagagaggaaggaagcccttctctttcttactccccgttaggtgcatcctggcagatgcgttccttgggagaacaccatgcagggtgcattcccatcaactgtaagagtttgaaggactagagagacttcatcctaatccgttcttaagtagcaggtccttagaaattcacccaggttttccgttttgtttgttagtgttgttgtttgttttggaggggaggtccacaaagccattttcaatatgtcagtatgtctattggcgacgtcttgccttcctctaatgtggatagctggggagctgggattacatcatgtattgtggtcacactctggatctcatttgatcaaaagttccatttgccactggtgacatcactaagatatcagatggttgatggggtctagaaagtaattaaagggctctgaggacccatgggggtcaacgtcaacccttccatggctctttgatattaagaatcaacttgcagaccaggtgcggtggctcgtgcctgtaatcccagcactttgggaggccaaggtgggcagattgcctgagctcaggagttcaagaccagcctgggcaacatggtaagatcccgtttctactaaaaattcaaaaaattagccaggcatggtgacactcacctgtagtcccagctacttgggtggctgaggcacaataatcgcttgaacccgggaagtggaggttgcagtgagccgagatcacgccatttcactccagcttgggtgacaagagtgagactcttacctccaaaaaaaaagaatcaacttgctggccagtggctcacacctgtaatcctagcacgttggaaggctgaggcaggtggattgcttgagcccaggagttcgacatcagcctagacaacacagggagaccccatctctgcagaaaaaaaaaagaatcaacttgtctgggcttgtatgatccaaccccattggaggggtcagtcccagagacctttcagtctgtggatacaggaaggaaaattggcctccaggaggccagagtagaactggggctgagcccaggcccaccccaaacggctaaatgggcaccgctccatgggctccctggagttgccccttgaacaacttagctctagtatctccatatgtcaaaggtaccagcgcagggccacctccccagactggtttgaaaagtaaaactgcaaaagcaggtggattgcttgagcccaggagttcgagactagcctgggcaatgtggtgaaaccccatctctacaaaaaatagaaaaaagtagccaggtctggtggtgcacgcctgtagtcccagctacttgggaggctgagatgggagaatcacctgagccagggaagtcaaggctgcagtgagccatgatcacaccactggactccagcctgggtgacagagtgagatcctgtcaaaaaaaaaaaaaatctgcaaaaccaaaaattatttcacaagaactttgaacttgtgaaattctttcacaaacaactggtttctttcccctctccagctattctctcacagcatagttcatatataggtgcttcccacagagtaaactctgcctgtgatgttgtcccgttcttccaggtccgtgggctgctggacaccctggtgactgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactac

SEQ ID NO: 7159 - DNA, 4225 bp, Homo sapiens
ggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggaggtaagcttcctccctggccccctccctggcagtggcggcatggaaggcgggggttggtggggagcaaacagtggttctggggcttagtctcttttccaggtgcgagggagaaggctgagctgtagaggacctaaaggcttctttcctgccacccctccctccctgccgcccccaaaaagggactcagggccccctccccaaccatcctgggacttagcatctttggtggcatcttagcatctttggtggcattccccacagactccttctgcacatctctgctgtttcctcttcttcagcccctcatgcacacctctagcctcagggcagtcccccctcccccatcttctgtgctcccgggatgcagctattacagtggccagaagcttagagttcaagctcaccccctgtcccttacagcatcaagaagggcactgtcattccccactgctcaggctggatctgacttggaggcaggggctggagcccaccttagcagaggacgggaagagggtgtgggctgggctggtgggtgcacagactttacgcaaactcatgcacgtgtgactggacagatctgggttctctccatctctccgaaacccttgctggggatgagcgatctgcatttttcggtcctgacttttgggaaactctccagatccccccatcctgcaggccctgagaagagcagcccctccctactgcgcagttctccttgggaccctgtatgcaggagagagctgatactccgtgccccgtggcccatcccaccgcctgctggccctgctcccatcccctcagcttcctccctcctctgccctctcgtcatctctgaattctcaggccctgccctctctgtgcccttccctccacctgacagggtctggctcaaggtcactgcagtaattccatacccagctgcccagggctgctgctgctaccgccaccgccttatcggccgctgggtttctgttacactcccttttatttctgggcatatcgtgttcgataaaaccctttgcttgtaacactgctggcagcgctcccagctgctccctcccgcgttcccgcgttccttcctttcctcctcccttctctgcgcttgggcaggcttcttcctttcctcctcccttctctgcgcttgggcaggcttcttcctttcctcctcccttctctgtgcttgggcagcctcaccttgtcccctcaaactccagagaaggaaaatcaaggtgcctccccatgtttctggccccgcccttccccccagcccctgcaggggtgtgcagagaatgcccaccttctgtgagaaaggtccaggcagggccgctgggcccacaccgagagtcccctcccagaggctggtgcccccacacaggccaggccggagggccagggcagccaggtccaggtagggctctggtgcagtcacagtgcccgactggttctgctagttccagcggccagccggtaggggcgtgtgctgggcgggctttggtgcacattatttcccatcttgactctgccacccccagccacgggttggggaggtgaaggcaggtctgagtcactagcaagggggagggcaggagttaaacaagttgtggccgtggcattcccacagaaggcccacgacccgctggaaggaaagagatagcagacaaaaggtaggctgcgctgtgggccaggcactctccacctcgcccactcccacggtatcttattctctgggcccccaacaaaacctgccaaggcatgttttcaaagcgtggggctgctttgaactgagcccagcactggcggggctggggtggaaggagcgtggaatcgggtgcgagaggacagtctccttcagattcctgcttctggcagcctggggaccagttggggcacgggctgggatggagggtggagccgaaaggtgtttggtgggtgggggacagttcacgggtgaagtggaggctctgcaggcccagacagtgtgtgtgtgcatgcacacaccagtgctagtgtgggaggaatggtggtggtcagggaattcctcttttggtttctgaaagggcctttgggaggaccttgggcctggagttgtattcagcagatagcctggacctgtggctactggggggaattgggctggcccagctcttctccctgctggggtaccagaggtccactatgtgtccagcgttttggggctttggagaacccagactgttcctactctcagggagcttccattctagctgagaaggtgggactgagacagtaaagcaatccgatgaaataatgaccaaactgggtaacactgacaataagaattggattagtcttctggagtcctggatggtagtccaggctctgccacttacgtgccatatgatgcaggcaggtcccatcccctctctggcctcaacacttccatgtgtacgtgggggtggcatgcaggagtgttggcagtggccagaactctgaggggcagtcttcctcaaacgatacttgctctcttgccttctggcccaggtcatagcatttcttctgagccgccctcccctgacttgctggttcactcctccttactcttcccttgtgatcttggatctcagctctgtcaccacctcctctaggaagtctcccctgattttcctggcttgggtcttcctgtgcggctctgcactcccacactggactgtgattttctgtaccctctcaactgaacgtgggtggaccaaggcgtgtgttctgtgcctggcatggtgcctggctcagaaaaggcctccgggaaataggtgttgaatgcatcaaactacaaaaattaacaatatgagaaaagtgagctgaggagctaggaaggataggtcttaagctagatctcagcagaaacagaggcagtggccgagcagaagcaaggcaagcgggcattcctggaatcctgttagcgttcccccatgaggccatgcactcttaggtggggcttcctggggtcatcttggttccccatgcagcagctctgtgatctcggacaagtcacttaatattacagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggaggtaatgataatagcatctttggggtgtggctgtgaagatagatagatgagcatgcaaagctccaagtgcctgctgaattgtaagtgaaataagaacgtgtgccgctgaaggctgtccctggaggcagggacactctggccaggcctcatttagttggtcagtggctgagtgacccatgaggtaggcctctgcccctgagttcctggccctctcttcctcagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcag

SEQ ID NO: 7160 - DNA, 2149 bp, Homo sapiens
cagggatcagtctacatcctatttgctggagcagacccgccctgagtctaattgacacaccaggtgggtttatgggcttctccttcctcccaagcatcccacagccgcgttgcctattgtctttgtggcaagtcttgcccggcagcctagcttcagagcaatgtaagtggttgctgttatacccttctacccaccatgtgctggaaagaggagcatcatgactaaaaggcatgactcatgttctaatccatggcactactgatcctacttttctgcattttaaagtacaaacagctggatattgctgaagatggctcagggggtcaaggacaaatttcacaaatgtgacctcattctccaggctgcctgtttatcctggaggttgatcttggacttgggaccatttaaggttgcctatcttcaaagtgctcagcttggctttttaattctatactcctaaatctttgacagctgtgcatcaacaagctttcaaggtaactgaagcctagggcagctttctgccctctgttactggtgaatgtttttgcctgttggaaggacgttgcagctacaggcagactcccaccatccaccaacggccttattgtcaatccatagtcgtgtgctgactgcaaagtggcctgagttttttgcatatcttgtgagatcactatgggaacgcagtcattataatacagcagttcctgtcttgaggacttttgatagttttatttcttacagtttcatttcctattgatacaaaagagactcttggtaaccaaaaataaatgtaaccagaaatgtcggattctttgtttcatatatgaacatgattttgtaatgtaaattgaataagcccagatctattatgcaactatatactctcgtaacaagtgagtcacagaagcctccgtcaacactgacatattgatgaccttaagaagttagtgattacctatgatgtacaacaaacaaggctggtagctgccagcagaaactaggcataactacttctagtaagtactactactagttctaaaatttaaattaaatcagctcacaccttattttgtgctgctaccactaaaatccaagccaccatgacattatcactaacctggactactaactcatctttccgctttcactctgaccccctccattcattttccctggtgaagctagtgtcatcttataagtaaatcagatcatgtcattcatctcacaactcatctgctttccatctcaccgcaggatagaatccaaactcatcaccatggtctgtgagaccccctgtgatctggcctgcctgactctccgatctcatggcattaccactcccttccctcttgtgatgatctgtccgcaacgactttgctgtttctcatgcctggcccactatgtgcagacatgcaggttgtacaatgcataactccaagagaggcattcagtaggctgcagggtgaatgatgcccttggaagtatgtagtgtggtgaccctggtcacacgcacagctctttcctaccacaaagccttggcacttgctggcctttctgcctggacatccatctgaagattttttgcacagctggctccttcttgtcattcccttgacaaatattccaccaaacactactccataccagggaggctccataccaggcaggaccagctatatactttgcaggtcccagtgcaaaatgaaaaccagggccccttgttcaaaaagtattaagaatttcaagacggtgacagcagaacattaaactaagcatggggcccttctcagtgcggggccctgtgggacaacataggtcacacctccatcaagatggtaagggtttcacatgtattcatgaactcaattgtattttaaagtttagtagaaattgcacaattaataactggttagtgtatatttacctctgcctttggaagttaaagtttttttttttttgaactaaaaattccttaagtgtaatttcatccttgaaaagtcaaagatttgttgttttggcatattgtcaagtttttaaaatttaaaatacagttagttcaaaatatattcacagctttcattcatgagacatttataaatattgggttataaagttccacatttagtatttaactcaaaaaaaaaaaaaa

SEQ ID NO: 7161 - DNA, 2153 bp, Homo sapiens
cagggatctgtcttcctcctatttgcttgagcagacccgccctgagtctaattgacacaccaggtgggtttatgggcttctccttcctcccaagcatcccacagccacgttgcctattgtctttgtggcaagtcttgcccggcagcctagcttcagagcaatgtaagtggttgctgttatacccttctacccaccatgtgctggaaagaggagcatcatgactaaaaggcatgactcatgttctaatccatggcactactgatcctacttttctgcattttaaagtacaaacagctggatattgctgaagatggctcagggggtcaaggacaaatttcacaaatgtgacctcattctccaggctgcctgtttatcctggaggttgatcttggacttgggaccatttaaggttgcctatcttcaaagtgctcagcttggctttttaattctatactcctaaatctttgacagctgtgcatcaacaagctttcaaggtaactgaagcctagggcagctttctgccctctgttactggtgaatgtttttgcctgttggaaggacgttgcagctacaggcagactcccaccatccaccaacggccttattgtcaatccatagtcgtgtgctgactgcaaagtggcctgagttttttgcatatcttgtgagatcactatgggaacgcagtcattataatacagcagttcctgtcttgaggacttttgatagttttatttcttacagtttcatttcctattgatacaaaagagactcttggtaaccaaaaataaatgtaaccagaaatgtcggattctttgtttcatatatgaacatgattttgtaatgtaaattgaataagcccagatctattatgcaactatatactctcgtaacaagtgagtcacagaagcctccgtcaacactgacatattgatgaccttaagaagttagtgattacctatgatgtacaacaaacaaggctggtagctgccagcagaaactaggcataactacttctagtaagtactactactagttctaaaatttaaattaaatcagctcacaccttattttgtgctgctaccactaaaatccaagccaccatgacattatcactaacctggactactaactcatctttccgctttcactctgaccccctccattcattttccctggtgaagctagtgtcatcttataagtaaatcagatcatgtcattcatctcacaactcatctgctttccatctcaccgcaggatagaatccaaactcatcaccatggtctgtgagaccccctgtgatctggcctgcctgactctccgatctcatggcattaccactcccttccctcttgtgatgatctgtccgcaacgactttgctgtttctcatgcctggcccactatgtgcagacatgcaggttgtacaatgcataactccaagagaggcattcagtaggctgcagggtgaatgatgcccttggaagtatgtagtgtggtgaccctggtcacacgcacagctctttcctaccacaaagccttggcacttgctggcctttctgcctggacatccatctgaagattttttgcacagctggctccttcttgtcattcccttgacaaatattccaccaaacactactccataccagggaggctccataccaggcaggaccagctatatactttgcaggtcccagtgcaaaatgaaaaccagggccccttgttcaaaaagtattaagaatttcaagacggtgacagcagaacattaaactaagcatggggcccttctcagtgcggggccctgtgggacaacataggtcacacctccatcaagatggtaagggtttcacatgtattcatgaactcaattgtattttaaagtttagtagaaattgcacaattaataactggttagtgtatatttacctctgcctttggaagttaaagtttttttttttttgaactaaaaattccttaagtgtaatttcatccttgaaaagtcaaagatttgttgttttggcatattgtcaagtttttaaaatttaaaatacagttagttcaaaatatattcacagctttcattcatgagacatttataaatattgggttataaagttccacatttagtatttaactcaaaaaaaaaaaaaaagga

SEQ ID NO: 7162 - DNA, 2149 bp, Homo sapiens; identical to SEQ ID NO: 7160

SEQ ID NO: 7163 - DNA, 2153 bp, Homo sapiens; identical to SEQ ID NO: 7161

SEQ ID NO: 7164 - DNA, 8421 bp, Homo sapiens
acgaaagcggccaagtagagctccgtcctgacgcgccgcctcccgtgggctccggccggctaagccgcggcggacaactatgctgaaagccaagatcctcttcgtggggccttgcgaggtaagtcctggcccggcgcggcagagggagcggggagcaggcctcggggcctgggcgagcgcaggtccccacccgtctgatctgcggcttgctcccggaggcgggaacccgggcccaccgcgcccatcccgactggcgcccctgccctttccgtgaactcggtgctttcagaccttgattccaaccactgcccggaggaggtagtggaggcgagcccggtgttaatgagccccgaaggcccaaggtactgagtggcatcattggaaccatagcctaggtttcgtgactctttcttttgcccccgggatccccctaatgaatgcgtctgtgggtctggacttttgtttgagacaggttgtcgctgtgtcgtccaggctggagtgcagtggtgtgatcatagctcactgcagcctcgacttccctgggctcaagcagtcctcctgcctcagcctcctgagtacctgggactacaggcgtgcaccaccacgcccgactaaatttgttgtttttgttttgttttgtttttttgagacagagtctcgccctgtcacccaggctggagtgcagtggcatgatcttggctcagtgcaaactccgcctcccgggttcaagcgattctcctgcctcagcctcctgagtagctgagattacaggcccacgccattacccctggctaatttttgtattttttgtagaggtgtgttttcaccttgttggccaggctggtctctgctgacctcaagtgatccgccagcctcggcctcccacagtgctgggattatagggatgagccaccgcgcctggccttaatttgttaattatttgtagagacaggatcttgctatgttgcctagcacctaggctggtctccaactcttgggctcaaacagtcctcccgcctcagtctctcaaagttctgggattacaggcatgagcctttgctcgagtcctgggcgttttactatatggtcctggaaccattggctattaatgtgtgtgttgggggcgtggtagtggggatcacatctacatgtatacttcacatcatccacagaaataaagctcagatggactaaggctaaatgcgtttaaaaaaaaaaaaaaaaaaaaaaggccgggcgcggtggctcacgcctgtaatcccagcactttgggaggccgaggcaggcatatcacaaggtcaggagatcgagaccatcctggctaacacggtgaaaccccgtctctactaaaaatacaaaaaattagccgggcgtggtggcgggtgcctgtagtcccagctactcgggaggctgaggcgtgaacccgggaggtggagcttgcagtgagccaagtctgcgccactgcactccagcctgggagacagagcgagactccgtctcaaaaactaataataattaaaaaaaaaaaacccagccggatgcggaggctcacgcttctaatcccagcactttgggaggccaatgcaggtggatcacctgaggtcaggagttcgagtccagcctgagtaacatggtgaaaccccatctgtactaaaaatacaaaaattcgctgggcttggtggtgcatgcctgtaatcccagtgactcgggagtctgaggcaggagaattgcttgaatccgggaggcagaggttgcaataagccaagatcgcgccattgcactccagcctggggaacaagagcgaaactccatctaaaaaaaaaataaaataaaacctgtagaagtcttaggccaggcacagtggctaacacctgccagcactttgggaggctgaggtggggagaccacttgagctcaagcattcaagaccagcctgggcaacatagggaaaccccatctctacaagcaatacaaaaattagctgggcatggtgatgcacacctgtagtcccaggtggctcaggaggctgaggcaggaggatcactggagccctacagatcaaggctgcagtgagctatgatcacattgctgtactccagcctgggcaaccgagcaagaccttgtctcaaaaaaaaaaaaaaaaaaaagcaatgtgtattactcatataatcgagatggacaaacagctgcatgtgagattatgagacagctagccacgagtccccaggctgactttgatcctctctgtgacctaaaagaactccttggctgggcacagtggctcatccctataaacccagcactctgggaggcccaggtgtgtggatcacctgaagtcaggagttcgagaccagcccgagtaacatggtgaaaccccaatttctactacagatacaaaagtaagccgggcgtggtggcaggcgcctgtaatcccaactactctggaggctgaggcaggagaatcgtttgaacccgggggttgcagtgagcctagatcacagcctgggcaacaagagtgaaactctgtctcaaaaaataaaaataaaaactccttaatcccatgctccctggaccccagaccaggctgtgcccactgcactagagcaagacagtgaggtcgtaaccaccccagtgatctcagggtgcccatgacctatactgcaccacaccgggttccaggccacctcttggggtcatttttttggtttccttttctgcctttcagcaaagacctttatttgcactcattttcacagagtggaaaaactgttttggccaactttctgacagaatcttctgacatcactgaatacagcccaacccaaggagtgaggtgagccctgacaaatctgtgtcccagagtgtccaactggctcggcagggaggctcattcctctaatcccagtgctctgggaggtcaaagcgggaggatcgcctgaggcctgggcaatatagggagaccccgtctcaactaaaaataaaacattagccaggtgtgttggcatgtgtctgtagtctcagctacatgttaggttgaagcagaaggattgtttgaggccaggagttggaggctgcagtgagctatgatcgtgccactgcactccagcctgggtgacagagtgagaccctgtctcaaaacaaaattaataataaaacaattttaaaagactgcccagccatcacccacttcctacttttgttgctgttggcattccaaaagtgtaatgcagcctcattattggtgctgctactgttcgtcttttttttttgggatggagtctcgtcctgtcgctgaggctggagtgtggtggcacgatctcagctcactgcaatctccgcctcccaggttcaagcgattctcctgccttagcctccccagtagctgagatcacaggtgcacaccatcatgcccagctaattcttttatttttagtgtagcaagggtttcaccatgttggccaggctggtctcgaactcctgacctcaagtgatctgcccgccttggcctcccagactgctgagattacaggcgtgagccactgcacccagcctactgctcttctttttccttttaggatcctagaatttgagaacccgcatgttaccagcaacaacaaaggcacgggctgtgaattcgagctatgggactgtggtggcgatgctaagtatgtttcctttaaagaaagtcacttcatcaaatggtttaaaaatcagctgcccaagccaggggcggtggctcacacctgtaattccagcactttgggaggccaaggtgggtggctcacctgaggagaagagttcaagagcagcctggccaacatggcgaaactccgtctctactaaaaatacaaaaaattagccaggcttggtggcaggcacatgtaatcccagttgggaggctgaggcaggagaactgcttgaacctggaggcggaggttgcagtgaaccctggaggttcaagcggaggttgcttgaacccgggaggcagaagttgcagtgagctgagatcgcaccattgtactccagcctgggcgacagagctggacttctagctcaaaaaacaaaacaaaacaaaaaaatcagctgcccaccaggcaccatgaagttgggcctagtatgtttcctggcacgtatgaggagcttgataaatgatttgctgacatgcattgctttatacactttagtgattaggttatgatgcagttagaagtcatcaaccttggccaggcgcagtggctgacgcctgtaatcccagtactttgggaggctgaggcaggcagatcacctcaggtcaggagttcaagaccagccggcccaacatgatgaaacctcattttaaaaaaaaaaaaaataggggccaggcaccatggctcacacctgtaatccattgctttgggagatcaccagagctcaggagtttgagaccagcctggccaacatagcgaaaccctgtctctactaaaaatacaaaacttagcccagtacggtggtgtgtaccagtaatcaggagactgaggcacgagaatcgcttgaacctgggaggtggacattgcggtgagccaagatcgtgctacggcactcaagcctgggcgacagagccagactcttgtctccaaaaataataataataataataatttttttttaatgaagaaatcatccacctttacaaaaaataaaattgacctgatgtggtcctagctactcaggaagctgaggcagaaggatcacttgggcccacattggaggctgcagtgagctatgatcccacaactgcacttcagcctgggagacagagcaagaccctgtctcttaaaaaaaaaaagtcatcccccaactttttttaaaattttttttatttttttgagacagagtctcgctctgtcacccacgctggagtgcagtggcacgatctcagctcactgcaagctctgcctcctgggttcacgccattctcctgcctcagcctcccgagtagctgggactataggtgcccacaaccacactcccctaacttttttgtatttttagtagagacggggtttcaccgtgttagccaggattgtctcgatctcctgacctcgtgatcgcccgcctcggcctcccaaagtgctgggattacaggtgtgagccaccacgcccagccgtcatagaccaacttttaatactaagatattctttttaaagtccacagttagaaaccagaatgacctaactttccctgttgttccttttcttcctcgcaggtttgagtcctgctggccggccctgatgaaggatgctcatggagtggtgatcgtcttcaatgctgacatcccaagccaccggaaggaaatggagatgtggtattcctgctttgtccaacagccgtccttacaggacacacagtgtatgctaattgcacaccacaaaccaggctctggagatgataaaggaagcctgtctttgtgtaaggaaactggaatttctcttcctcttttgtcttgaatgttttggacacctacatattgtcccatgtcctagaaaccagcagctctgtccagttactgagcacctactgtaccctaggcaattgttaccctctccatgtgagtccactacgtctctactaaaaatacaaaaattagccaggcatgatggcaggcgcctgtactcccagctactcagggggctaaggcaggagaattgcttgagcccaggaggcggagattgcagtgagttgagatctcaccactacactccagtttgtgtgacagggcgagacaccatctcaaaaaaaaaaaaaaaaaaagagaaaagaccgggtgcggtggctcagacctgtaatcccaacactttgggaggccaaggtgtgcggatcacttgaggtcgggagttctagaccaacctggccaacacggtgaaaccccatctctactaaaaatacaaaaattagccaggggtggtggtgcatacctgtaatcccagctactcaggaggctgaggcaagagaatcacttgtacctgggaggtagaggttgcagtgagctgagattgtgccattgcactccagcctggacaacaagagtgaaactctgtttcaaaaaaaaaaagagcagaatacagagtgggaaaatccttgtagctattcttgggtacaactaggggggcactctttctgaaagaacttttctggagaaaaacctccaattcacataacacacatcccagaggtgacacagtcatcctgaaaaagaactcacaaaatattcagaaacaaaatgagaataatagagaatctattcctttctggtttaagaacagaagacctggaaagtggtttgtaaggttttcatcctgtcgccagggggcagtatagcaaacccattctctgttctctggtgtcaagaagacaacttgatctgtgaacttcagaaagttaaatttcttctagaagtttcattgggagctataaagggcccttcatggaaactctttgcctaattaaccttatcttcattttcaagcgccacccttgaacaagctgaagctggtgcactcaaacctggaagatgaccctgaggagatccggatggaattcataaagtatttaaaaagcataatcaactccatgtctgagagcagagacagggaggagatgtcaattatgacctagccagccttcacctgggactgccacatccccagtgaaatcagcatgtttctcggtgcagatctgaaatcacatccagctcctgatgttttcttctccctctgactgcagaggaagtgttcctacctgcaggaaggcacctgtcacacagggcgttcactcagaccatctgtgctctgccctgagttcagttgagaaaatcctattatcaaatttggatttcctggccccagaacttcccaaagacctgtaaaatggagggatttaccacctcacatatgtccagttaaacagtttgtggacttgtaaccgtcgcagcccaatgatacaacagtagtttaatcacgtgtattggcttgaatgtgattttcattccttgattcacccaacaaataccgactggctgagcacctgctgtgtgtgcactgctgttctagctgctgaccatagacagcataaatgaaaaagacagaaattcccaccttcgtggaactctccattttcctaaatgttaggttggtgcaaaactaatcgtggtttttgccatttttaatttttaatggcaaaagccactattacttttgcaccaacctaataggccgattcagaaacttgagtgcaatgtcttggatatgcaaaaaagaaaatcaaaacgcattcttcattctctataagagttctaggcggggcgtggtggctcacacttgtaatcccagcactttgggaggccaaggtgggcggatcatgaggtcaggagatcgagaccatcctgaccaacgtggtgaaaccccatctctactaaaaatagaaaaatcagctgggtgtggtgccgcgtgcctgtaatcccagctacttgggaggctgaggcataagaattgtttgagcccgggagacagaggttgcagtgagccaagattgcgccactgtactccagcttgggcaacagagcaagactccatctcaaaaaaaaaagagttctagcccaggagcggtggctcacacttgtaatcccagcactttgggatgctaaggcaggcggatcacttgaggccaggagttcaagaccagcctggccaacatggcaaaatcccatctctactaaaaatacaaaaattcacagggtgtgttggcacacgcctgtaataccagctactcaggtggctgaggcataagaattgcttgagcctgggaggcagagattgcactgagccgagatcgcgccactatactccagcctgggcaacagacatcctgtctcaaataaattaaattacattaaatgtttaagaagaagtctaaataagtttcatatgctgccctccctcagataatgagggaacctggggtacttaaaatgccaaatgaacgtatacttgatccttattcatagattttgtatttgagaatttgcctactcactaaaatatgtttgtaacccccaaatcaatactgtggcactttctcagttattcgcagacacacagagacaaaaaatttgaagtgcctggctgggcgtggtggctcacgcctgtaatcccagcactttgggaggccgaggcaggcggatcacaaggtccagagatcgagaccatcctggccaacatggtgaaaccccgtctctactaaaaatacaaaaattagctgggcatggtggggcatgcctgtagtcccagctactcagaagggtgaggcagaattgcctgaacccgcgaggcggagactgcagtgagccgagatcgcaccactgcactccagcctggtgacagagc

SEQ ID NO: 7165 - DNA, 367 bp, Homo sapiens
caggagaatcgcttgaacctgggaggcggaggttgcagtaagccgagattgtgccattgcactccagcctgggcaacaagagcaaaactccatctcaaaaaaaagaaaaaagtgccgagtggagtggctcacacctgtaatcccagcactttgggaggccaaggcaggtaaatcacaaggtcaggagttcgagaccagcctgtccaacatggtgaaaccccgactctactaaaaacacaaaaaattagctgggcctggtggcgggtacctgtaatcccagctactcaggaagctgagggaggagaatcacttgaacccaggaggcagaggttgcagtgagccaagatcgcgccactgctctccagcc

SEQ ID NO: 7166 - DNA, 8421 bp, Homo sapiens; identical to SEQ ID NO: 7164

SEQ ID NO: 7167 - DNA, 367 bp, Homo sapiens; identical to SEQ ID NO: 7165

SEQ ID NO: 7168 - DNA, 2894 bp, Homo sapiens
aagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagccaaacaggcatttaggtcaggtcatttgtaggcagtttctcttctcacaaaagatgtacttaagcaggctgatcgctgttccttgagcaaggcgcttactctcctccgctcaggcccccaaggcctgccctttccctcgcacacaggccccacccccacagttccacgccccccccccaaggccacaccctccctccctagagcagcagcgaggatccatcatcagaatcacagtgctctccagacctcctctctaaactgcttcattgacctaagtcactctcttcaatcccacacccatggacattcttgtcaactcaataccatagcactttgcataggcaaaatacttttcaggcctttttaaaaaattcattacagcaaacagctggggaaggacatgcagtcctcccccagctctgtcaatgactatgaccttggccaaagcacttcactgctctgggctgcagcttccagcactgaatcagaggccacacagcccaaagattagcttcatgtccattatagcattgagggagcagagatacccatacacagaagcaccttggcatagagcacccaggcatcgacctcttccaggagaactgattctgtggatggatgtgatttcaggagattgtgcagtgccagcatcagtgcataaagggtcctgtatgtcctttggctgcaaatcacccacttccctgtgtttcagtgggagaatttcctctcccacctcctcacatcctcttttgccaggctggatgctgtcgtctctgtacacaaatactttctgcattcccccctccacaccatcctagcgaggcaccagcacacctaatcacagcaaagcccagatccccccatcagttgcttttactcagtgttttcaaataggagtaaaggcccttgcaatttttaattaacaagcaaggcccaagggaacacatgtcctcaaaagtttttctgatccctcgccttgcacacctggcatgcatcaggcacatctgtcctacagctggcagagacagatgcctcggttctttgtcattcagattgcatttgacctcttctcatctatttatttctttatacatccagacttcatcacatgaagcctattggggttaagtttgtaagtgtttaattgtgcaaattgccaccctgtgtacctcctccatgtctgtctgcgtgttttccaccaaagaatgcaaagcagacttccaggtgtttaaattctgttcactcaacaatgccagatgaatggaagagggaacacactgagatgacttagactctggtccaccaaccagacccttggaaaggaatactaaaatcattacaaggtatggattttaaatggatgaaacttcaaattatcttatttggatagaagtctatattctagcctcatttgcatgaagtcagatagccagaagaaattccattgctggttttcacgaaattcacttgtcttttgctaataaacacatggccctttcccagattattctctagccaagccccacctttgttacgttgaaatccctcatttattttcttctcaaaatgcccattatccaaatgcagaacctctgcatctccaagccagttatgctgaatttgtcaaacttagacacccttgacaactgcactcctactgtaggctcctgtgcatactgtcgtcttctgtgggggatggagaggttagtgtgatgaggtggtgtctgcccaggaggtttctttcaaacatcatggcctcccatccaatcaacatcatcaaattacatgtgtaatcaaggctctgtgccatgggggaaatgaatcatttagctaggccaggatctagtgaaagccacagagtttaaaaccatgaaagaagttgaaggcagcattcctcagctctgtgacttgtgaccctatttgaagtttcaggatttgggtgtcacaaaggattgtccctaatccttggccctggggtcttccgagtgagctggtttaatactctgagaatgagcagggagatccagagaatgaatccctgaccgcatcacctaaactgtcttccaaacatgagacaaagctgactgttcacactgattgcccagcacataccgtcttgccagtttcttcttttctcccagtctcctgttcatccattctgttctcccttggggtgggaatctatgatggaggttactggggaaacagctcagcagatttttggagaccaaaccaaaggtctcactaggaaatttatctgttttaaaacattgcttccttcctggctctgctaaattgaatgctcattgtttgttgttgttgttttttaattctaatgttcaaatcactgcgtgctgtatgaatctagaaagccttaatttactaccaagaaataaagcaatatgttcgtaatca

SEQ ID NO: 7169 - DNA, 6547 bp, Homo sapiens
ggtctgtgggttctggcaccacctgagcccactgggcatctggtcatccctggcacctctcctttggagccaccttgtccctggctagacagtcacattttccagtgccgttttggaaagatgttgcctttggagaaggcgtttgcctcccccaggagctccccagccccgccggatctgcccacgccggggtcagcagccggagtccagcaggaagaacccgagaccatccctgagaggacccctgctgacctggagttctcccgcctgcgtttccgggaatttgtctaccaggaggctgccgggccccaccagaccctggcccggctgcatgagctgtgccgccagtggctgatgcctgaggcgcgctccaaggagcagatgctggagctgctggtgctggagcagttcctgggcatcctggcctgataagtccggcctgggtgtggcacagtacctgagagctgcagaagcagcctcctggtggagggcctcgctgatgtcctggaagagccaggtgggctgtcacagaggagaagcatggctcagaggagatggggaggggatcctggaaggccccagtgccagccatggcttgcctgagatagttaagttccccacactgctgaggcagctccttggtcctcgggccaggacagatgcctgggctcctgccttctagatgtaaggaagccagaggaatgagggaaagggaccagcctcttttatttacttatttatttatttatttatttttgagacggagtctcagtctgtcactaggctggagcgcagtggcgcaatctcagctcactgcaacctccacctcctgggttcaagcaattctcctgcctcagcctcccaagtagctgggattacaggcgcctgccacgatgcccagctaatgtttgtatttttagtaaagacagggtttcaccatgttggccaggatggtatcaatctcctgacctcgtgatctgcccgccttggtctccccaagtgctgggattacagttgtgagccaccacacccagcccagcctcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggcctcgatctcctgacctcgtgatccgcccgcctcggcctcccaaagtgctgggattacaggcgtgagccaccgcgcccggcccccagcctcttaacagtaaatattctgggtactttgcaggctggaggtctcctggtccaagatgaggtgcaggatgggtagtgatgtggccctggagcctgcaggtccctgtggtttaactgtgtgattgttgttggcacgtgtcctgacctcttggggtcacaggtccctccactgttgacagggatgctgctgggctcccctgcgggctcatcctcaattcttagcgatggagtgtacgagaggcacatggaccctctgctgctaccaggcgagctcgcgagccccagccaggcccttggagctggggagatcccggcaccttctgagacacgtgagtgcccagctagcctggcagcctctgctgggccttaggtggggtgttgggcagaggcctgtggttgggagagggcagaagggcagccagggagtcaggggctccatggtccatgctatcattgggacttcctcctgtagtttctctgaatgttagacattgtttattaaattagtcttcagagattatgcagatcatccatacttaccacaaatagtgaagaaacatcaatacataaagaaaagaatctcccaacccccgaccatgaaccctctgaaaataaagggtctcaagtgtcctgatgcacgtcccctcatgtctccctgcacatcacacatgcataatcagggcctggggtcgggctctgtgtgtgtggtgtgctgtgtctgagtgcttgctgttcgaggggtgggtcccccaggctgtggttgggtctggttctttagttgcccagcatcgcgtgctcagcccatccccatcctagaggtgggctctctgccccttggagtgaagctgccctgacacctcctgacttgtgtgcccatatgtgaggctctgggcactgtgggtggactcctcaggaccactgggcaagtggtgtgtgagttcgacatttcacataaaatagaaacttccatgtggttttccagaagttttgtggctgttcattaccagcacggaaggtgcccactggcctggatacagcccagcactatgtggtgttgctttttaggatttccacgaaggccaggcacagtgcctcatgcctgtaatcgcagcactttgggaagccaaggcgggcagatcacttgagcccgggcattcgagaccagcctgggcaacatagggagaccccatctctacaaaaaatacaaaaattagccgggtccgcacttttagtcccagctacttgggaggctgaggtgggaggattgcttgagtccaggaggtggaggttgcagtgagccaagatcatgccactgcactccagcctaggtgacagagcaagaccctgtctttaaaaaacaaacaaaccaaaaaaaaaaaagatttccatgaatccagtggacttgaatgggcatctctggggccacccaagccctgtggccaccgcgctgctttgtaaatcagggaaaggtgtagtgtccgttgagccttgggtgctgctgtcacagaagcacactggggcctgtgtgggaggcagcgggggctccttgacccttgagggcacctggccacagggagctcattgcctcagctctgcctctccttctccccagcctggctttctccggaccccctgtttctggaacagaggagggtcagagaagcaaagaccgaagaggacggccctgccaacaccgagcaggtgggtgggcacgagcaggtgggtgaggggccttggcctcagcttagaggcatccccctccccatcaccagtgctcagcagagggctgtggccccaaacgtccacagcgctgaggcccagaacccaccctggtgggagcgtgagggcggaatctttgtggtgcgaagggggctgcctcctgcagtgcacctgggttagagtccctggccagggctggctcctagcctgctcctgtggctgtggggctgcggcgggtcctcccttctctagggcaggtgggaggtctcagccacgactaatgtttcagaagctgaagtcctttccagaggaccctcagcacctgggggagtggggccacctggaccctgccgaggagaacctgaagagctaccggaagctgctcctgtggggtgagagtcgcctgcctcggggtcacgccccactccccatccccttccgcaggggttggtgcaggagactgtgaccccagggactttggctgggacactgtgatgtcttacaggatttgaacttgcacgtgttggagcttgaatttattcgctgaagcccccaccctttctgatctaaacatctgagttctgcccaggccctgcctgtaggactgaagcctcggaatttggaaaggcctcctggccccaaggcgcccacattgccaccctccttgccagatacagggcctcacctgcatggcctgatcaagggtctcctcttttgtagacgttcttgccccagaaaccctccttttagggaggccccccgactcagactcctgagcaatttttgtcaatgtctttctttagctttgctttctctgagtcctgcctccgcctgccccgttgcccttccagcctcgccttcttctttgctccactgtccaggggcctaacagggaggtggccttggtgggggtcccagtacagagaagaggaggtgggctgcagcctgccctggctggcccacgacacacaacacccatcagccactctgtgttgatgccttttatttctttggtttttaaccccactcagggtatcagctttcccagcctgacgctgcctccaggctggacactgaggaactccggttggtggaaagagatccacaaggaagcagcctcccaggtgaggttgggttgaattggtgttagggccgggtggggtttgctttttcttcagaggctgagggggcccctcccagcgccatcagccccagcaaagacctcagcattgactgcttcaccattctcccaccaccgtgtctgagtgaggcaggaatccagttacgtccatggtctcttgctgcatgacagaccaccccaagacttggtcggtggaaacggcagtggtgttagttgccaggatctgtgtatgactggtcccgggggtggccgttctgccccattggaggctctgtgccagcacaccaacaagaacacctagaggcggacttgggctggagggccctgggtgcctgtcgccagggggcttgtcgctggggggtttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtggggctgtccttcctgtcctgtcggtggcctccgttgttggaggcctccaggtcccacatctgcagcagcaggcgcggggcatgcgctgcagggctgcctgggagggacagcgctgcttccaaacagccgtgagccccgcggggatccagagcccggagccctgtgcgctgttccggcagctgaggctcggctgggtcctcctctccctggccctgggcggggcgctcacgctagggctctgaccttgttccagaaggcgggaggcggcaggagagcgctgggtgcgcctgcgaggaggccgcccccgcgggggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataaggtg

SEQ ID NO: 7170 - DNA, 1487 bp, Homo sapiens
ggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataaggtg

SEQ ID NO: 7171 - DNA, 1487 bp, Homo sapiens
ggtgctgcctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgagcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagcaaaggagactaaactccttgggctacataaggtg

SEQ ID NO: 7172 - DNA, 575 bp, Homo sapiens
aagaaaaaaaaattatttactaacagtcgattgtcctgtgttggtgttgctgttgcttatatattggtttgcactctgctccatacagtgattcagggatccaggccccatctctgttgtagctctgctcttcactgtacccttggagcatgtagggaaggccgaacctgttcacctgggagatgacacacatcacttctactcacaaatccttggagagaaatgatcccatggctccagtcacttgaaagggcctgtgaactgtcacctggagtgcctgtctccgcaacagttacaagcttagttcccctcttagcctatccatcttaagccccaagctgagtgtggttctggtaagaaaaaggctaaaatggtctgggcacggtggctcacgcctgtaatcccagcactttgagaggcagaggcaggtggatcacctgaggtcaggagttcaaaagcagcctggccaacatggggaaactccatctctactaaaaatacaaaaaatgagccaggcgtggtggcaggcacctgtgatttcagctactcaggaggctgaggcaggggaatcgctt

SEQ ID NO: 7173 - DNA, 577 bp, Homo sapiens
aaagaaaaaaaaatttttactaacagtcgattgtcctgtgttggtgttgctgttgcttatatattggtttgcactctgctccatacagtgattcagggatccaggccccatctctgttgtagctctgctcttcactgtacccttggagcatgtagggaaggccgaacctgttcacctgggagatgacacacatcacttctactcacaaatccttggagagaaatgatcccatggctccagtcacttgaaagggcctgtgaactgtcacctggagtgcctgtctccgcaacagttacaagcttagttcccctcttagcctatccatcttaagccccaagctgagtgtggttctggtaagaaaaagggtgaagatggtctgggcacggtggctcacgccctgtaatcccagcactttgagaggcagaggcaggtggatcacctgaggtcaggagttcaaaagcagcctggccaacatggggaaactccatctctactaaaaatacaaaaaatgagccaggcgtggtggcaggcacctgtgatttcagctactcaggaggctgaggcaggggaatcgctt

SEQ ID NO: 7174 - DNA, 859 bp, Homo sapiens
tgtgttgatgccttttatttctttggtttttaaccccactcagggtatcagctttcccagcctgacgctgcctccaggctggacactgaggaactccggttggtggaaagagatccacaaggaagcagcctcccaggtgaggttgggttgaattggtgttagggccgggtggggtttgctttttcttcagaggctgagggggcccctcccagcgccatcagccccagcaaagacctcagcattgactgcttcaccattctcccaccaccgtgtctgagtgaggcaggaatccagttacgtccatggtctcttgctgcatgacagaccaccccaagacttggtcggtggaaacggcagtggtgttagttgccaggatctgtgtatgactggtcccgggggtggccgttctgccccattggaggctctgtgccagcacaccaacaagaacacctagaggcggacttgggctggagggccctgggtgcctgtcgccagggggcttgtcgctggggggtttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtggggctgtccttcctgtcctgtcggtggcctccgttgttggaggcctccaggtcccacatctgcagcagcaggcgcggggcatgcgctgcagggctgcctgggagggacagcgctgcttccaaacagccgtgagccccgcggggatccagagcccggagccctgtgcgctgttccggcagctg

SEQ ID NO: 7175 - DNA, 575 bp, Homo sapiens; identical to SEQ ID NO: 7172

SEQ ID NO: 7176 - DNA, 582 bp, Homo sapiens
ctgactgagccagaatcagtaacgtccatgtctctgctggcatgacagaccactccaagacttgctcgtggaaacggcagtgtgttagttgccaggatctgtgtatgactggtcccgggggtgcccgttctgccccattggaggctctgtgccagcacaccaacaagaacaccttagagccggacttgggctggagggcccctgggtgcctgtcgccagggggcttgtcgctgggggttttggccttagctattgaccccactctcttcgctggcagccgggcccctccctccaggagggtgcgctctgagcaggctctccttgcatcgtgcatcttgtggccaagctagtggccaggtggagacctccaaaggcgcggtttccagaacccgggctcagtgggctgtccttcctgtcctgtcggtggcctccgttgttggaggcctccaggtcccacatctgcagcagcaggcgtggggcatgcgctgcagggctgcctgggagggacagcgctgcttccaaacagccgtgagccccgcggggatccagagcccggagccctgtgcgctgttccggcagctg

SEQ ID NO: 7177 - DNA, 3207 bp, Homo sapiens
aaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctcttcagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagcccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtggaggagtataggatggactcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctggtgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcaga

SEQ ID NO: 7178 - DNA, 3206 bp, Homo sapiens
aaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctcttcagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtggaggagtataggatggactcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctggtgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcaga

SEQ ID NO: 7179 - DNA, 3207 bp, Homo sapiens
aaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctcttcagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccctcgcttatggccatcttaaaactggagaggcagagaactacttatgagtctgtagaacacgtgttgtcttccatggcctgtttctcctgctgtctgggtgagtgagcctgcaacgcaatgcccatgagagtaaatgcctcctgacctaccctggtcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtggaggagtataggatggactcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctggtgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcaga

SEQ ID NO: 7180 - DNA, 863 bp, Homo sapiens
aactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatacaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctccgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattctta

SEQ ID NO: 7181 - DNA, 4428 bp, Homo sapiens
caatgtatgatttctgggacaattaagctttatttttcatatatatatatattttcatatatatatatacatacatatataaaggaaacaatttgcaaatttacacacctgacaaaaccatatatacacacatatgtatgcatacacacagacagacacacacacccgaagctctagccaggcccgttttccatccctaagtaccattctctcatttgggcccttctagggttggggccctgagcttggtttgtagaagtttggtgctaatataaccatagctttaatccccatgaaggacagtgtagacctcatctttgtctgctccccgctgcctttcagttttacgtgatccatcaagagggctatgggagccaagtgaacacggcggattgaggctaattcacctgaactcaaaaacagtgcccagcttcctcaccgcaggcacgcatcttttctttttttttcctcgagacggagtctcgctgtgttgcccaggctggagtgcagtggcacggtctcggctcactgcaagctccacctcctggattcataccattctcctgcttcagccttccgagtagctagggactataggtgccaaccactacgcctagctaattatatattgtatattagtagagacagggtttcaccgtgttagccaggatggtctcgtcctgactattgtgatccgcccgcctcggcctcccaaagtgctgggataacaggcgtagagccaccacacctggccccggcacgtatctttcaaggaatagacaccagttcctggcttctgaccaaagaaaaaatgtcacaggagactttgaagaggcagacaggagggtggtggcagcaacactgcagctgcttctggatgctgctggggtgctctccggagcgggtgtgaacagcgcacttcaacatgagcaggcgcctggctccggtgtgtcctcacttcagtggtgcacctggatggtggaagccagcctttggggcaggaaaccagctcagagaggctacccagctcagctgctggcaggagccaggtatttacagccataatgtgtgtaagaaaaaacacgttcttacaagaaactctcctacccgctcgggagactggggctccttgcttgggatgagcttcactcaacgtggagatggtggtggactggtccctgaaaagcgggccttgcaggccaaagtgaggtcctcaggtcctaacccagtggccctctgaaagggggtgtgcaggcgaggggagcaggaggcttctctctagtccctttggaggctttggctgagagaagagtgagcagggagctgggaatggtccaggcagggaagggagctgaagtgattcggggctaatgcctcagatcgatgtatttctctccctaaaagtgggtagaggagaagaggggaacacggagacggtgctgagttgaaggtgtgagcaccgagaggaaggagagatggaagcagaagccgatgaatttggtgggcagcgttggggaggaagctaggatgggcatggcaggccagggaaggagggcggcccccgtctgactgcactggtgaaatggccacacccagagccacgggcattggtcaggaaaaggtgatgggacagggtctttctcagtcttcctccaagctccctcagccacttgcttggccctgccatctgtgagtagtgttaagaaggcaagatggggcctgctccctatctctgacaaagagggatgaaggatagagagaaccgttagtccctactgcccccggtccctgaggatgtggcaggctctggccacaggaaccgcctcctacctggtctcccggagccctcttgtcaccgctgctgccctgcaggaggcccatctcttctgggagcttatctgacttaacttcaactacaagttcgctcttacgagacgggggcagcgtgctgggaggagggagggaggtgagaggttggtatctcagggccacaggaagagaagggcccgctgtgaaggatgtggaatggatgagggctccttgctccagggccagcccagggcagggaagcaggtcatgagaccatgtggctgatggaagctgggcagtgggtagtggagcaggcagcaccctgacccagggccccactcctgctgtcaaggggcaggcgggcgctgggcaggcagcaggctgggtggcaaaacgggcgggggcggaggggccggtgttgggcttacatctcctgcttccctgagcgcctgcacggcagcttgcccttcttatagaggaaatagaggacagcgcccagcaccgccaggaccaggatgcacacaatcacagccacgatgaccacgcccccggctctccggctccggcagctttctctctgcgccacaaagacactcctcgtcactccctgccccaggccacttcgtcaccatcgttgccccagccagtccagggccgacaagatggggctgctactcacctttctggacagggctctctggggagggacagggcagaaaggatgccctggcacagccctgttctcttgccaggcctggcttacctgtggaggtgctgttggctctggtatgaggactggcagtggaagtgctgaggccagtggttgtgttggagtctggtgtgagggtggttaaattgactaggaggcagagggaggggtgttaggagaagcgcaagttactgcccgtgcctgggcctgcccctgccatcccctgcagggatgcagccctcacccagctccaggaagaggatgctggtgtttttgcccaggtcgttggaggccgtgcattcaacacctgtctccaacagctccggggtcacgaggacattcagggtgctcaggactcgctgtggatcttggtcttgttcacttgcctgcgaggaaaggaaggaggcagctcaggggatggggaggatctctggtcctggccacaaagcgcaggcagggattaggagagtgtggcagatgagacacccgctcaccgtgccgttgacgttccaggagatggtgggccgggggtgccctgacgcttcacaagacagattcaacaccatattctctttcacccacaccttcctctccttgaatgccatccaaggggggccttggggaggtagggagaggtgaggtggcaagcccagctagcctgcctccccctccgcaccagagctccccagggcagcaggtggctttttgtcaaagagcttaaaaaccaccccacttggggtgacctggtctctaccccagagggagggcctcaccaaaaatggccacgttgaccagctgtgtgcggttcaggccgggtatgctgggcacagacgccacgcagcgatagccgcctcctgcctcccgtttcaggtcatgcaactgaagcacaggccccctttccagcacctggcctgtctgggatgagagatgggtcagagggtctgggaaagagcacattcttgtcacccgccagccccacccaccccatcagccccttgccccagacccgcctgggtacctcttctctcagcctctggaactcgagctcctggctactctctgctcacaggtcaggtgaggctgctgccttcctgtctctcaggggctgcgggactcactcggacgtcagacacatctgggggtacagcaatcatgtcacccagggcagggtggggccagttccctattgccccagcctggtccccctgtcctgggtccccagcccctcacagttcaccagtagttcctgtggttcactcagcagcgatatcatggtgtccaagtccaggccctgacattcatagcgcccactgtgttccttccgggcaggctccagcaccaggaccccgttgtcgttggttgtctcttcctctgcctccctggtgctggggttctagggaggattggggaggtgagcagagtgcacctcccgccactccacctgggtctctgcttgcatccccacctgcacccagcacaaagcccccacacctgcttgctgatgctgaagtgtggtggagggttgccatcagccaaacacctgatttccacgcggtccccttccttcagcattcccacgggctccacttccagccacactttttctgtcgggtctgcataggcaaagggggtagctcttggcccatgagtcaacctgggctgataagggggagccagcaggagtttccagcagccccagccccagtaagcagagagtcaggttagtactcacagaaaacagggacggtgacttccctggactccttcatgtggttcccactgggcagccggtagttgagctcacagtaaaactgggcatctttgtcttctttaaccagctgtgccttcagaatactctgcaaggtgtacaaaccactcgactccacagtctgggacgactgaatgtggac

SEQ ID NO: 7182 - DNA, 863 bp, Homo sapiens; identical to SEQ ID NO: 7180

SEQ ID NO: 7183 - DNA, 3439 bp, Homo sapiens
caatgtatgatttctgggacaattaagctttatttttcatatatatatatattttcatatatatatatacatacatatataaaggaaacaatttgcaaatttacacacctgacaaaaccatatatacacacatatgtatgcatacacacagacagacacacacacccgaagctctagccaggcccgttttccatccctaagtaccattctctcatttgggcccttctagggttggggccctgagcttggtttgtagaagtttggtgctaatataaccatagctttaatccccatgaaggacagtgtagacctcatctttgtctgctccccgctgcctttcagttttacgtgatccatcaagagggctatgggagccaagtgaacacggcggattgaggctaattcacctgaactcaaaaacagtgcccagcttcctcaccgcaggcacgcatcttttctttttttttcctcgagacggagtctcgctgtgttgcccaggctggagtgcagtggcacggtctcggctcactgcaagctccacctcctggattcataccattctcctgcttcagccttccgagtagctgggactataggtgccaaccactacgcctagctaatttttttttgtatttttagtagagacagggtttcaccgtgttagccaggatggtctcgtcctgactttgtgatccgcccgcctcggcctcccaaagtgctgggattacaggcgtgagccaccacacctggccccggcacgtatcttttaaggaatgacaccagttcctggcttctgaccaaagaaaaaatgtcacaggagactttgaagaggcagacaggagggtggtggcagcaacactgcagctgcttctggatgctgctggggtgctctccggagcgggtgtgaacagcgcacttcaacatgagcaggcgcctggctccggtgtgtcctcacttcagtggtgcacctggatggtggaagccagcctttggggcaggaaaccagctcagagaggctacccagctcagctgctggcaggagccaggtatttacagccataatgtgtgtaaagaaaaaacacgttctacaagaaactctcctacccgctcgggagactggggctccttgcttgggatgagcttcactcaacgtggagatggtggtggactggtacctgaaaagcgggccttgcagggccaagtgaggtcctcaggtcctaacccagtggccctctgaaagggggtgtgcaggcgaggggagcaggaggcttctctctagtccctttggaggctttggctgagagaagagtgagcagggagctgggaatggtccaggcaggaagggagctgaagtgattcggggctaatgcctcagatcgatgtatttctctccctaaaagtgggtagaggagaagaggggaacacggagacggtgctgagttgaaggtgtgagcaccgagaggaaggagagatggaagcagaagccgatgaatttggtgggcagcgttggggaggaagctaggatgggcatggcaggccagggaaggagggcggcccccgtctgactgcactggtgaaatggccacacccagagccacgggcattggtcaggaaaaggtgatgggacagggtctttctcagtcttcctccaagctccctcagccacttgcttggccctgccatctgtgagtagtgttaagaaggcaagatggggcctgctccctatctctgacaaagagggatgaaggatagagagaaccgttagtccctactgcccccggtccctgaggatgtggcaggctctggccacaggaaccgcctcctacctggtctcccggagccctcttgtcaccgctgctgccctgcaggaggcccatctcttctgggagcttatctgacttaacttcaactacaagttcgctcttacgagacgggggcagcgtgctgggaggagggagggaggtgagaggttggtatctcagggccacaggaagagaagggcccgctgtgaaggatgtggaatggatgagggctccttgctccagggccagcccagggcagggaagcaggtcatgagaccatgtggctgatggaagctgggcagtgggtagtggagcaggcagcaccctgacccagggccccactcctgctgtcaaggggcaggcgggcgctgggcaggcagcaggctgggtggcaaaacgggcgggggcggaggggccggtgttgggcttacatctcctgcttccctgagcgcctgcacggcagcttgcccttcttatagaggaaatagaggacagcgcccagcaccgccaggaccaggatgcacacaatcacagccacgatgaccacgccccggctctccggctccggcagctttctctctgcgccacaaagacactcctcgtcactccctgccccaggccacttcgtcaccatcgttgccccagccagtccagggccgacaagatggggctgctactcacctttctggacagggctctctggggagggacagggcagaaaggatgccctggcacagccctgttctcttgccaggcctggcttacctgtggaggtgctgttggctctggtatgaggactggcagtggaagtgctgaggccagtggttgtgttggagtctggtgtgagggtggttaaattgactaggaggcagagggaggggtgttaggagaagcgcaagttactgcccgtgcctgggcctgcccctgccatcccctgcagggatgcagccctcacccagctccaggaagaggatgctggtgtttttgcccaggtcgttggaggccgtgcattcaacacctgtctccaacagctccggggtcacgaggacattcagggtgctcaggactcgctgtggatcttggtcttgttcacttgcctgcgaggaaaggaaggaggcagctcaggggatggggaggatctctggtcctggccacaaagcgcaggcagggattaggagagtgtggcagatgagacacccgctcaccgtgccgttgacgttccaggagatggtgggccgggggtgccctgacgcttcacaagacagattcaacaccatattctctttcacccacaccttcctctccttgaatgccatccaaggggggccttggggaggtagggagaggtgaggtggcaagcccagctagcctgcctccccctccgcaccagagctccccagggcagcaggtggctttttgtcaaagagcttaaaaaccaccccacttggggtgacctggtctctacccagagggagggcctcaccaaaaatggccacgttgaccagctgtgtgcggttcaggccgggtatgctgggcacagacgccacgcagcgatagccgcctcctgcctcccgtttcaggtcatgcaactgaagcacaggccccctttccagcacctggcctgtctgggatgagag

SEQ ID NO: 7184 - DNA, 2668 bp, Homo sapiens
caatgtatgatttctgggacaattaagctttatttttcatatatatatatattttcatatatatatatacatacatatataaaggaaacaatttgcaaatttacacacctgacaaaaccatatatacacacatatgtatgcatacacacagacagacacacacacccgaagctctagccaggcccgttttccatccctaagtaccattctctcatttgggcccttctagggttggggccctgagcttggtttgtagaagtttggtgctaatataaccatagctttaatccccatgaaggacagtgtagacctcatctttgtctgctccccgctgcctttcagttttacgtgatccatcaagagggctatgggagccaagtgaacacggcggattgaggctaattcacctgaactcaaaaacagtgcccagcttcctcaccgcaggcacgcatcttttctttttttttcctcgagacggagtctcgctgtgttgcccaggctggagtgcagtggcacggtctcggctcactgcaagctccacctcctggattcataccattctcctgcttcagccttccgagtagctgggactataggtgccaaccactacgcctagctaatttttttttgtatttttagtagagacagggtttcaccgtgttagccaggatggtctcgtcctgactttgtgatccgcccgcctcggcctcccaaagtgctgggattacaggcgtgagccaccacacctggccccggcacgtatcttttaaggaatgacaccagttcctggcttctgaccaaagaaaaaatgtcacaggagactttgaagaggcagacaggagggtggtggcagcaacactgcagctgcttctggatgctgctggggtgctctccggagcgggtgtgaacagcgcacttcaacatgagcaggcgcctggctccggtgtgtcctcacttcagtggtgcacctggatggtggaagccagcctttggggcaggaaaccagctcagagaggctacccagctcagctgctggcaggagccaggtatttacagccataatgtgtgtaaagaaaaaacacgttctacaagaaactctcctacccgctcgggagactggggctccttgcttgggatgagcttcactcaacgtggagatggtggtggactggtccctgaaaagcgggccttgcagggccaagtgaggtcctcaggtcctaacccagtggccctctgaaagggggtgtgcaggcgaggggagcaggaggcttctctctagtccctttggaggctttggctgagagaagagtgagcagggagctgggaatggtccaggcagggaagggagctgaagtgattcggggctaatgcctcagatcgatgtatttctctccctaaaagtgggtagaggagaagaggggaacacggagacggtgctgagttgaaggtgtgagcaccgagaggaaggagagatggaagcagaagccgatgaatttggtgggcagcgttggggaggaagctaggatgggcatggcaggccagggaaggagggcggcccccgtctgactgcactggtgaaatggccacacccagagccacgggcattggtcaggaaaaggtgatgggacagggtctttctcagtcttcctccaagctccctcagccacttgcttggccctgccatctgtgagtagtgttaagaaggcaagatggggcctgctccctatctctgacaaagagggatgaaggatagagagaaccgttagtccctactgcccccggtccctgaggatgtggcaggctctggccacaggaaccgcctcctacctggtctcccggagccctcttgtcaccgctgctgccctgcaggaggcccatctcttctgggagcttatctgacttaacttcaactacaagttcgctcttacgagacgggggcagcgtgctgggaggagggagggaggtgagaggttggtatctcagggccacaggaagagaagggcccgctgtgaaggatgtggaatggatgagggctccttgctccagggccagcccagggcagggaagcaggtcatgagaccatgtggctgatggaagctgggcagtgggtagtggagcaggcagcaccctgacccagggccccactcctgctgtcaaggggcaggcgggcgctgggcaggcagcaggctgggtggcaaaacgggcgggggcggaggggccggtgttgggcttacatctcctgcttccctgagcgcctgcacggcagcttgcccttcttatagaggaaatagaggacagcgcccagcaccgccaggaccaggatgcacacaatcacagccacgatgaccacgccccggctctccggctccggcagctttctctctgcgccacaaagacactcctcgtcactccctgccccaggccacttcgtcaccatcgttgccccagccagtccagggccgacaagatggggctgctactcacctttctggacagggctctctggggagggacagggcagaaaggatgccctggcacagccctgttctcttgccaggcctggcttacctgtggaggtgctgttggctctggtatgaggactggcagtggaagtgctgaggccagtggttgtgttggagtctggtgtgagggtggttaaattgactag

SEQ ID NO: 7185 - DNA, 863 bp, Homo sapiens; identical to SEQ ID NO: 7180

SEQ ID NO: 7186 - DNA, 1292 bp, Homo sapiens
tgcagctggaggccaattatcgtaaacgaattagtgcaggaaccagaataccaaataccatgtgttctcacttaccttacccctaaaagttagatgcccttcctccatactcccacagtaccctctatatttttacgagtcattatattcctctttactttgtgagccccttaaaagcagagaccgggtctgttttactcactggtatgtcactacagtgccaggctcattgtttgcattcaggtggttgttgaatgaacaaactcaaatgtaactgcctatttacttgtctgtctttcctcaacaggctgtatgttccttggtggatggatctgtggtttattaagctttgtttcttttagcatttagcactcagcatgaagacctagcacacagaagtttattgaataaattaaatttgtcaggattaataattaatctttaaaatacagtatatagcattgaagaatatatagaaagtattctcaagatacagagagacatgggttgctcaggattattcctttgtgtttcacttataggaaagatctcatactacagactacaaatgccaaatgacctactgtgctcataccacccttaacctagaaataaaatagaaacaattcctaaagaaacagtcttaaaaataaccagctaaaattttatcaacaacaacaaaaaagtagttggggtttctgctcattaaattagtttgtatgggtaagcaccacctaagtttcttgattcatggcatgtgttcttaaaccaatttactatccactaaaaataaatggtgatcattatataaaaagcagttgtatttcttgacactagcaatgaaccatctgaaaatgaaattaagaacacaattccacttacagtagcatcaaaaagaataaaatatttagaaataaattaaaccaaagaagtgtaagacatgtacactgaaaactaaaaaacacagttaaaagaatggaaagatagcctatgttcatggattggaagactgaatattgctcagatggcagtactccccaaattgatctacagattcaatgcaattcctatcaaaattccatcttcctctttgtagaaatggacaactggtcctaaaattcatatggaaacttaagggaccccaaataatgaacaaatgttggaaaagaagaacaaagttcatgggttcacactttgacttcaaaatttactacataatcaagacagtgtggtatggtctgtcataggacagacatatagaccagtggaataaaattgagtccagaaataaa

SEQ ID NO: 7187 - DNA, 1292 bp, Homo sapiens
tgcagctggaggccaattatcgtaaacgaattagtgcaggaaccagaataccaaataccatgtgttctcacttaccttacccctaaaagttagatgcccttcctccatactcccacagtaccctctatatttttacgagtcattatattcctctttactttgtgagccccttaaaagcagagaccgggtctgttttactcactggtatgtcactacagtgccaggctcattgtttgcattcaggtggttgttgaatgaacaaactcaaatgtaactgcctatttacttgtctgtctttcctcaacaggctgtatgttccttggtggatggatctgtggtttattaagctttgtttcttttagcatttagcactcagcatgaagacctagcacacagaagtttattgaataaattaaatttgtcaggattaataattaatctttaaaatacagtatatagcattgaagaatatatagaaagtattctcaagatacagagagacatgggttgctcaggattattcctttgtgtttcacttataggaaagatctcatactacagactacaaatgccaaatgacctactgtgctcataccacccttaacctagaaataaaatagaaacaattcctaaagaaacagtcttaaaaataaccagctaaaattttatcaacaacaacaaaaaagtagttggggtttctgctcattaaattagtttgtatgggtaagcaccacctaagtttcttgattcatggcatgtgttcttaaaccaatttactatccactaaaaataaatggtgatcaatatataaaaagcagttgtatttcttgacactagcaatgaaccatctgaaaatgaaattaagaacacaattccacttacagtagcatcaaaaagaataaaatatttagaaataaattaaaccaaagaagtgtaagacatgtacactgaaaactaaaaaacacagttaaaagaatggaaagatagcctatgttcatggattggaagactgaatattgctcagatggcagtactccccaaattgatctacagattcaatgcaattcctatcaaaattccatcttcctctttgtagaaatggacaactggtcctaaaattcatatggaaacttaagggaccccaaataatgaacaaatgttggaaaagaagaacaaagttcatgggttcacactttgacttcaaaatttactacataatcaagacagtgtggtatggtctgtcataggacagacatatagaccagtggaataaaattgagtccagaaataaa

SEQ ID NO: 7188 - DNA, 184 bp, Homo sapiens
gctcatgcctgtaatcccagcactttgggaggccgaggcaggcagagcacgaggtcgggagatcaagaccatcctggctaacacggtgaaacctgtctctactaaaaatacaaaaaattagccaggtgtggtggtgggcacctgtagtcccagctactcgggaggctgaggcaggagaatcgct

SEQ ID NO: 7189 - DNA, 7932 bp, Homo sapiens
acttgcaaactaaggggaatgagcttccttctgaatgtttatgaaggagaggccactgtggtaatgttaaaattaatacacttgttgtatttaggagctaaaagtctcagatgctaaatgaggactgatttgctttttatttgatcatatacctatacatgtgcaaaaaaaattaactacttgttttatagtttctttggggaaaaatagtttaaaattcttatcagttttaagaaaagttattttccagccatagttcaatagctcacaaatgtaactgttactaaaaaaataagtaataaatagccaaaaactggtggccaaagatccagtaaaaaacatcctctttcactcataaatcaacgaaatagtcatgaagcacttctatgcctataaaaatagattcagcaagtctttaaaatatttttgctagaattcacattaatcttcccagagaatactcttatttatactgttgaaacatacataactaaaattgggaatttgtttagaagatatatataactaaaactgagaatttgtttagaagatgtcttatgatttgcatatatgtaaaataaacaaccatgtgttccaaacagttatcccattttgacatccaactgtatggaaaacttacttataatttaatcttaaacatatatgatgcttcaattttcaaagtgctttcatttgataaagcatttatttgataaagcaagggtatgtaacaaaaatattcactatgtaacaaaaatagtaatttccctaatttgtgtttcatttgaaaaatatgattttgatattaaatgcagggtagtgattcataaatagttttttaaaggctgtttggtttagaaaatgtcatttaatgtactctattaataaaattacaggctgtgtcattctagtcatgtctaacagctggtgacacctggagctagccaggaaaatgtctagtgaaacagatgggcttagccccaggccttgaatggaacaattcagatgctgtccaaccctcccaggtgatgggaatttcaaaaggagattaactcctcagtattaaaataccttgccctgttcccattattcccatctagaaaaagcatgctagaaagtaacaacaaaactttgactttaatagttataaattattatgaaaattatcagttagttgaactcggataactcctcactccttttcattcctagaggatagacagtgaagtgcaactacagcccgcaaatgaaaatgaataatattaatccagcccctcaaggcaggcgagtagctgctggtttgtaatcttgaattaaagtttttttatacacaggtttttcggtagacaaattcagggacattttagcagaggaaaaaaaataagcaaaatagtcgagatatcattgttttacaaaaataaatcccattttgcctacagcaatttttttgtttgttttggtatatcattcatggttcttcaaaggtaaaatcacttaagtcctaactgctttccttcagtgtatgttgttaggccattggaatttaccacaaactgctatttcttgtaattctctatcgaatggctccacaatttctattcaaattcgatctaggatggcttcttttcataatatcctgagtgaatagtaaacataggaaaaggaaccagtataaaaatataccagtatgaaaaataaaaaccagtataaaaaagttattttttaatggcaaagtcagtactaaccaagagtattctttagtgtttagagatagccaaaggttgaatttaagtttcagtccttatgccagagaaatatattctctcaaaatattttttgaaaatcctctgcttgtctatggaatgctttcaaataaacctctttcccccgtctccctcccactccagtcatctgtcttagagctattggaatcctggatcattgtgggaaatgaaaggtaagtaagtacatgcctatgatttgttgttggtaagtgtggcgtggggtccaaggaatggttcgtttaaaaataaggcagaccacgtaacttttttttttttgagacggagtctccctctgttgcccaggctggagtgcaatggcgcgatctcggctcactgcaacctctgcctcacgagtacaagcaattctcctgcctcagccttccgagtagctggaactataggtgtgccaccacactcggttaattttgtatttttagtagagatggggtttcatcatggccaggctggtcttgaactcctgacctcgtgatccacctgcctcagcctcccaaagtgctgggattacaggcatgagccaccgtgcctggccgatcacataacttctttttttttaatttaattttattttattattattatactttaagttttagggtacatgtgcacaatgtgcaggttagttacatatgtatacatgtgccatgctggtgtgctgcacccattaactcgtcatttagcattaggtgtatctcctaatgctatccctcccccctccccccaccccacaacagtcccgagtgtgatgttccccttcctgtgtccatgtgttctcattgttcaattcccacctatgagtgagaacatgcagtgtttggtttttgtccttgtgatagtttactgagaatgatgatttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgcgctcacataacttctaacaatatttaccacattggacttgaaaaattataccttgctttatataagtactgtagtaagcttgaaaacacaataatacagtatacaaataaggttttaaaataattccttttctactttagttatataattattaatagatagttttaaatttccaagaatcattaagtatacatttttaaaaaatatttaattttctattcttttctgttgtgaatggttttgttccttgggcatatagggatcttgctcattataacagactatgagattgttgtatttttctcttaaagtactgtagataactcaatagagctgtgtgttacaattaaccagtagaacataatatctaagtcttattcaatatatttgggttcaaattacactgttagcatttcaaatagtgccaattctgttgactcactgcagaaattcctagaaggaaatataaaaacagacaaatgagaactatgcaaaatatcaaaagccatcattataatatcaactttttctgggatttcttttcataatttcctttgttctaattacctccatgttggagtcatgttggggtcaacatgaaagccattataaaaatcaaacactattccagtgtttgatgctttctttgtatgcagtacattccaaggaatggaaggaatcacagcagtcaaccttggtgtaggcaataaggggtgcattgtttacagataatttaaaaacaacaaaacctatgaaaactcagcctgcttttatcagcagcaatgacagtgataaaatacttctccttatcgggcagaggctccccagtaccctacccttggtgtacttctgccaacataagctcaaaagtactacatgcccaatgcttttgagatgcttattgcaaatggatctcattctcacctttatattttcaatttctgaaaatataaatgtagaagaatatattaccagtgttaatcaaggcagcctataatctgttacaactttaaatgtttaaaatatacataatgaatttttttaaaaagtccagtgaagttgagagaggaattgtggacataagtaactttctacctgaactttcaaatactgataccccagtgctttaaagtcacgagtaggtgcctaaggaaataagtgaaagatcaaaatatgtcatacttgcatttaatgtatgagaatttgttttgaccacagaaccgaactcccactaaggatttcactccctgatagtcattccaaaacttagtataagacttttatttttttctatataaggaatttagtctcaaataagcattcctcactttactggcctagactgaacaaggcaatggctagtggcaatctagtccacaattaatgaagatcatatttttgctgactccttggaccctgggttcatgaagatatgaagaattgaggcaacgacaaaaaaatacattaacaaaaagaaagcaaacattaaagcacaaaagcaccttcatcaatgttctcaccacctgtggttcccaacataaagaattttccatttctgttagctataacactctagagttaggaaagtaactagtactttacaaatatttttcctttcaaatgctttattacagttaagaggaaaaaagaacataatgaacgaaaaaaagaaaaccacaaacattttatatacatgcaaaaaggcaataaagtgacaaaatgtttagaaaaagcatgtgaaaaagtaaaatcattattagtatatgtaaaaaaataattttacttgccttgggtaggtgtctaatttttttctttcctttgtgagaacaccgactaaactagaatgaccagaggttcatttccagaatatattattcacgacgttatttatatgtgtgtttgcatatgtggcatgaaatgtcatatatataaaggatatatgtttaaccaaaaggaagaaaaacaccatacctttgttatttagaaatcaactcacaattgcatagtcaaacctaatcattgttgttttgatataaattttcttgctttattagtgagttggctttgaggaaatgtgtatttccacaggtaaaacaagtatgtgttaatttcttgagcaagtaggattccagtatcagaatacattcttaaatgaattattcctaaataacgcatagcacattacttaatcttataaggaacttattattaggatcttcattaataaatatttatttataaatattgctgtgcttgctaagggcactgacctttggccattatatatatctatatctatgtatatatacaagtgtatctatatatacattatagctatataatgatatatcatgatataaaatatgatatgaaataatataaagtgaaataatgtaaaatgtataacctatatctatatacaagtatatatataatactatatatatacaagtgtttatatacaagtatatataatggtaaaaggtcagtgccttcaacaaagcacagcaataatatatttaaataaatatgtatttattaacaaagatcctaattataagttccttgtaagattatgtgctatgccttagttagaaataattaatttacacatacttgttttacttatggaaatacaaacacatttccttatatacttgtatatgtacaagtgtatatacatatatatatatgaaatatatataataatggcaaaaggtcagtgcatttatacatatttataatgtgtatgttttacctttggtttgtatgatttatatttatatataaatgtacataaatttataaaaatggaagactagctggaaaccagaatctgacttcaaacagttcctggtaaaaataaaatttcccagttaagtttgtaaattagttttttgaaatttagaaaatagtatctcattggaccaatatttataaattgtttcattcccaggtaagtccacagaaatctatttaatttaaataaattttagtaccatgcttaagagatattttcctttttataagtttgttttgttttggtttgtttcctaaaggaactggtttttagcaaggagaccaagaaactctactccctaggggctagcaatgagagaaaggaagccttaagtctttgagcacagggtgacagtttgggtcctatgtgagatgatcaaatccacagcaacagaggaaaggacaaaaggaaaaggtctgtagcagcactacatcagaaaaaaatggattcagcaaggaagtgggtgactctgagtaagcatccatgtcaggatggttttgctacagcccccaacaaaacattaattagtttaagaaactcaacttcggtttacaagtgttttggaaaagtaacaaagaacaacataagtaacaaaataattcctcaggtcattacaatggatgtttcctataactgaaaaatatggttaaaaagtacaaactacatttggtgtgcaaactgtttagttcttaattccaaactaaattgtacattatatagtaaaattttgaccagaaaaacttggagattttagtaaaaatttcattgacatatttacagccccagtgtagtttggccggtgtgcaaagcctgactaaggaggttatagaaaaaaatatcagacttaagcccatcaaatcattaaagatgctttggcaagacttcaagctttacagacatactccatgtgaccagagatgtcataaccagtgttctttctcttgaaatgttagaatgctttagttttattctataatttccgtgttccatggaacagcattcatttctcccagttttagtaacataatgagagatatattgagtgtatagagcaggaaagacatgaaaacttatattgcataatattagcaaacataaaagatagcattataaatttttaaaaatccaaaaaaattccagaaacagaacagtgagcatgtttaaaaagtcaggactgaccgtttctgtgagttctgaggactgtaaatgagcctcaatccataaagctgagaggttgtcttagcccacatatgcagcaggtgactccctctgacaaaagcaagatttagctggatcttttaaaaaaaaaatatacttgtatttgagaataacaataatatagttatattgtaacatacttttatgatgtacatttatattatataataatacatacttgatagatattttagtctattactagttttaatcttcaaatatgcctggaaaaacatttaagcgtatttataaatatttaaatgttatcaagtattggaaaacatgtttgattactatgggaatataaactaaaactccccaaatatatatagaagatgtacacatctatagcatataaaagaattagggattccttcctccccttcttcctttattctgaggaaagaggtagtgaacttgagctttagtttttaacaggttagaaaaaggaatctttttacatatctactaaaagttctattattcaatgtctaagtttttaagtcccttggtttcctagatacttcgatggaatcagcagccattgatccaatgccaactccaagactggaacgtcgcaatgatagttccaaggcggaaatttgacgtaattcttttcgacacagttttacaggtgtgacaccatgaagtcgtcccacatttcccacaacctgaatttgggatgacagtcgactgtgagattttgtaaactgattatcatctgtttctgttttattctcattacctaacatatgcccactggggggtgctaaagaactatgaattggaggtaattctgggatatcttcccagagcttttgaggatttggctgtgttcttaagctgcttgctgaactgtccatttctctttctcttccacttaatttcatactttcaggtctggatgcccattttaattcttctgaaagcatgcctcctccttctggcttcaggactccatctccagcctcttgatctaaaaataatccccaaaccaaaaaattagatactatttcctcaaaattaggtattttaatcaaaacatcttaacataaatacattattatcacccaatatg

SEQ ID NO: 7190 - DNA, 835 bp, Homo sapiens
ggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaattctta

SEQ ID NO: 7191 - DNA, 9151 bp, Homo sapiens
ttccggctctttctcctgcagcaagacttttatttaggtgtcgggactgctctgccacagctgcccacctggggcgcgtccctgctggccgccccgtcacggcccgaaccagctggggatgccgccccgccgcgggtcgctgctctgccacagctgcccacctggggcgcgtccctgctggccaccccgtcacagcccgaaccagctggggacgccgccccgccgcgggtcgctgctctgcctctgctgcctctcctcctcgagcatgctgtagaggtcgtcggcagtgctgccttcagggctctcgtctttctcgggaaacagatctgggaacgtgaaggtctgtccatgggcctaagggggagaacaaaggctccagccagagctgcaaagactcctcagcagaggggtctgtgggggagcctcatgctttctggcagcccctttctgccggcgccggattcaactgctcagaggtacctccctgggcctcctggggcagcgtccctgcctggaatgtaagcacccccacggccaccggcccccggctgtcacgctgcagcagaggccacagctccaggacagggccgctttccccaccattgtctctttagggcctggtgtctgcccccgccctgggtgcacccatttactagcacggggccacctggttggtggggggcagaaacaaggcatggaaaaacatgacacaaatcacgtctggtaccatgctgaacctgtccatccaaaatgcctcaggctctactcacattaaagctccccctcctcccagcccagagcctggcaattaaagtgaacatcacgtacgaagaaacatgcacgtgcggcagctgataaatcaggaccggctctgccaattaactggtcttacatcttctgctgagagttcagaatatgtccgtgtcagccaagccccagcccaggccacagcatgtggctcgggttcacgagaaggaggggatactgctccttggggacctaagcaaatacaagaagccatcttaacttgctaatgattactaagtgctccaaagctaagaggcagaaagagcagaccagaggagagggaagagaagagggaggaggagtgaggatggcacccgaatctggaaccctttagtgagtaaaatcagtcaggtacacttggctcttgcagaccctttgtgtgtaaataaatctggatgtgggcaggcagccaagtatgatctgaaacaggcccagatcccaccctgcgagggaggtgtatgcaccctgatccctggcgcagagcgcaggggctggcggggagagtggcactgcgtgcgccgtagccggcctgcaggaggattgccttacacagctctgaactttgcgtcttttaaaataccaaggggcagtcgtttacacgtgaggctgactgcccagaatgggagattcaccttgactatatggaggtgattctgctagttttccgaggcaaggggaacccaaaatgacagtttaaagcacaaacatggccatttgtcacagcttcgggaagaaatggggaaaggtgctgagagaaaatccgtttcttacaggagacaaacaccgtttggggatgccaagcatggtttcccaggggcttcccctttctagaagagttcaccttgtacctaaaaaaaaaaagcccttgatccttccaaaaaggagagagacagctgatcggggtaaagaacaggaatggagaaaaatgtcccaatgacaagtaaacaaggcagccctgccttcaggaatcccagggcgccctgggggctgccgcctgcctggacctggaggccggagccccgagcacggagctcggcccagctggcggcagcggtttgttctggagttgcctctcatgtcgtgcgcccttcattcctgcgcgcccttcattcctgcgctgctcagcatccacacaagcctcggggcagcgggcagtcaatggtctttttgttgtgtgggtcactgaggcgctgctttcagctcccaggactttgggccaaggagatgcttatcaggttgtcggagaaagaaatgtgggactcccgccacgtgggacagggcctttccacagcggccaactccaaataacgtggataattttatctttccaatgctccctccctgggctttgcaattagcagtgattctaagccctggcgcagggcccagggggacacgctgagcaaggtctcagcagacacgagacaggaaagggccttgagagtcccctctgcgggcagacagggaccaacggccacggcccatttctaggctgtgcaaagatgtgctggagttcaggaaggggggtgaggacccgttacaaattttcattctggaacaggaggatccatgcccaactgggacccttcaggctcccagttgccctgccctgtctctggctgcctggacttcacagagggagaacaacacgcgggcggcagctgcagacaccggatcccggagctgctgggttcagttttcatgggaggtggggcccagaggaagaacgcaagggctcggatgacttgaatgccacttgtaaccgtagctgcctctgaagtgcccgtggcggtgccggcacacgggatgtccacccacatgccatgacaaagacagatgggcccgactgacactgagcacacagaggcctttatgaggccaacggctgctctccccacctggattggctgatttcatgcacagcaaatatcaggccaaattattccgggggcccctgtttagaacaacaaatgtgactgtttttcagaaaagctgccatgctaacttggcctttttcacaaactgcctccttagccccacaacaggccggctggcccaggaggcggtttccaccatcgtgtgactgccatctagtggcagggcccgccggctcggcctccagggaccatttacaccggaacacaaccccatccccacccagtaaggccagccccaggggcagagtggggaggcccaggaggtggccggggcaggctgtggacatcttggcccagagagaaagtgcctctgggtttgcctgggactcaaaatgaagagcccaaagaaaggctttgaaactgtgggtctcactcctgacaagtctgggtttcagaaactgaaggcccaggcaacgtggggtgagggttcttcctccccagagccccccaggatacgtaagaaagcacctgctcagaagcagcctgctgagccctaacaagtacgtgggacctgctaccctgcaatgcaggacatgggcctcagccaacagcctggccagccagacctgccttggcaccaaagacctttgccctcaggggcctcacactctgcctccgaggctgaaacccagccaaggacaggctctccagaggccggggcctcccatgctctgacaccctggtgtgcgttggagttgaaacccactaggcctgtgatggctgcctttgcccacagagaattcaaacttcaaaatcacaaaacggccggacgctgagacgtgccccatgtgccccagtgctcacgtgctcccagcgccaccactaacacccccaaggccgtgacggagcatgaccttatgtggagcctgcctctgcgctgaggccctgagatccggcctcacgggggctccctgggccccagcgcagcgtctccggcacaaacatccccaaggacacagttgcgaggagcccctcggaggccccgctggggctggccagctcacacgcaccagctgcacgtaggcgaccttgtagtccggcttcttgatcctcacgtttctgtgatctcttctcttgttagagcctgccggaagggagtgaaaaaaaaatcagaactttaaaaaaatcagaactttaaaaaattacatcctcagaggtcaatgccactaaaacgaacctctgctctcttaaaaatgtaaatatgtttttaaaaactcaaaaaggcgatttctcagggaaatgggcactgtaatcaaacgagccagcacagcaggctcccaggctcctcccttctcccaacagaggccagcaggttctcaacaaaggagcggacgtggcaccagccagggcacacgacaggggcttatggaacagacagcgctttgctccccagcctcagccactgcagtcccacctcgggggctgacggcaggagtcagggctcagaatggaccccgggccagcccagttgaattccaatccctgctctggcacgtaagcaccgtgtgaccctgacaagtcaccctgtgcctcagtttcccatgagccacgtcagaccaagacccccatgcagtagctgaggctgtggctcggcgaggtgggcatgtggcacagatgggcacgacaccaacaggagaacctcccatgggcactcaccatgctgcacccgtgtccgcacagcagccacgggcacgttatagatgccctcgaggtaattcctgaggtccacccttgtcattctggaggcgaaggagaaagaaaacggcatcttaaccaggctaaaagccaaaaatactgtcccagatgcacaagcacccgaggctgagaggccgacagaccaagacccacagggggcagggaggagggctgggtacatcagcggcactagtggggccaggcagccccagcaacaccagtgctgctggctgcaagactccctactctgggcacaccagcatggggtggcagtggcacagaccccacagagtgggagcactgcccaaccaacccctggcctgctccacagccccacatggctccctgctccgggcaagtgcctgtgagaggaggtgacagtctctgcacgctcctggctggcaggtgccccacctcgtctgccccggggcccagtggccgcatcagggttaggcctgctctgcggctgatgggactgatgaggttctaggaagtaccttctggaaaggcctgcctggcattcggtgcgttaactgcaagttccctctactgcagaacctcacggtcactgtcaactcagcttctgggcccctgcaggctgcacaggcctgaccttcgcccccaggggagctcacgctgctgccccgcctggctcgcgtcaaccctgagctggggacctgtgaacttaaacactgcagagcagcaccccagttttgctcgtagggactgtgcatttctctgaaggtcaagcaggctcttctgagcggttctgtacatcacggcctgctcccaacccagcctctcagggcgcctctcctaaaaagaagctgcaagaactcaacagaagacgcgagcacagaggtccaaattttaaggcttccagtgaagccgtccccgggtggagggcggcgtgcagcctgcctgccgggctccacacctacagggactccatcaatacttgccgggcagggccgcctgaggtgccttcccagcaggaagaggctagcacgtgagcagagttgttttaactcaggacccaggcccccctgagggcactctcccaacccagcgggaaaacttccgggctcactccacggggatccccccgagggtgctccccaaccccagccggaatcctcccggactcactccatggggatccggaactgcacggtgtcctcgggctgggccacaccgggccgcaccagctgaatgaagaagttggttcggaacacccgaagttgtgggccacccagccggtacagggggtacctgtacagaagagattgggtccatgtcacacacttaggccaaggcagcccgacacaccaaccctgcagacctccgagtgtccactcacaacagggtgggcagaaaagggggtagctaacactgcggatccctgagtgtccactcccaacagtggtgggcgggaaacagggtagctaaccctgcagacccccgcgtgtccactcacaacaggggtgggcgggaaacggggtagctatcagcaggtcaccacccaaggacacagaggtccccacagcccctttctcacatgggcctgccaaggtggacggccagtccctagcatcgacttaaggagcatgcgctgttgacccccaaggtcagactttagaaaaggccaatggacaaaaatcagaaccccgcagacagcattcccccaataagctgatggcaaggctcaaagacgtgtgttggggcactgatacccctgggagagcagaccccacgcggccggcccactctcctgctgctcgggtgaagtggagctgcagagaaccacacaccatgggacagaaaaggccagctccgcactctcccggtggcagcagggcctagctcctcggtatggagaacgcaggctaaccaggcttaggctcctggaagacggtgctgccaagactctgattcagtacactaaatgtgagttgagtgcaccacaccccagcactccactaaaagccagcagaggcagatggagaggtgccaagtggccaccgcaaactagaccagcacgctgcctgggctggggggccaggtgacgatcgtgcagaatctctagccagttggtttcgtgcattctcccacgttcagctgggtggacaggcagcaccgtcctaccgtcccccacccccgttcccgcccctgccactgccggcacaccctggctctatctgggcctcagagctggggggaggaggggcacaggagaaactcaggcctgctgggtctcgggggatgtggggtctgagagcctaggtgcaggtcttggtggacggggagcacaggggctcttgaggggtctctggtggccttatctgaggcactgcacatggccctggccttgggagcacccagcaccaagttaagaggggctccgtgaggccaacgctgccccaggcttcacatgaatttcacgctggcctctgcctgtctagggaagatgaggaggaagtgagggtcagaggccttgggtggggtgttcctgaagggccaacagtggtaggcagcactgagcctctgggcccgagggcctggcaggggccaggagctgctgggacctctcagaggcaaggcgcctgtaacaaagcccgatcactaatcatgtccaccccaggcctcctgatgaccacactgacacatggcagcctggtggccgggccagtggggctgagtcttcactcacccaaccccagcagagcctcctcttgggcatggccttggcctttccaagcctcagagtgcagccttcaggggtgggccccagtgagaggccgagaagaaagggtgggctctggaggtggaggggcctgacttgttttacccacaggttcaggctagccatggccacccgaggggctcacacattccctctggtgaccagctgtgggactgcaggagtggagacaaagtttggggactcccagtaaacagtagaaaagagggttcaacagctcccaggccattaattttcgagtctccaggcttggggcctgaagggcacactttgctaagggtctgaagggccatgtgtgggcttgagatgagaggctggcaggggttgggccaggacgattcactgtccttgttcccacaggccgagcctctccaggctggagcgccagctgcctgtgcatggagcctgcagatctggaacaatctgcactgtcgacacccagggccccaggacagggctctaaggcctctcttttgttctcgaacccttgtgggcccaccagccctcagttccctcagtcccactctccccagggagcaccccaagcactccgcatgggatttcacaagcacctccacggtaacctatctcaagtagaactctgcactaacttcttcctcaaaacacaaaaacttggctcactgccaccagcctgcctccccacggccccacgagtgactcacccaggatcccaccctctcggcacccccaccccagctgcatccagtccacagcaagtccagtcagcgctccctgcaaaggctccctggcaacaggagtgtgtgcactgctgggcgagcgggccccgctgcctccaaggcaaccacacctgatccgtttccaggggcccaccacccttggcccttcaggaacaccccacccgggtcctctgaccctcacttcctcctcattctccagggacaggcgaagggccagcgtggaattcacgtgaggctcagggcagtgttggcctcactcagaccttttcttccttggtgctgggtgttccccaaggtcagggccacgcgcagcaccggtcccaggtgtctgctgaaggaagcctcctccactgggggtcccacctgccaccctcccctctctccccagctatgtgcaggggcctccaaagccacaccctggccccttgaccgtccctctccagaaacactgattactgttctccaaaacccacccgggagcccacatctactgattacgcctgagtcattcgttcaccaagaaatatgcagggcttcctgcttcaatttggggagggcgaagtggtgcaggacagcgccccgatggccccctgggaatccagagaacatgcagagtgggcgtggggggtctgggctgagcagaaccgggcctcccgccctgcctgccccaaagccctgagggctgcggtcagctgccctttcccactcaaacccaatctggattcccagctcctctgcctcaggccgcgcccgcgctgcggtgggggccgcccgggcctccccgcctggacccaacagccgacgtggcccccgccccgtgacgatcagaaacgtctccaaacagctccctcggccctggctgcgggaccagccccgggcctgaccccgggccaccctcccactccccacgcgggggcaccgtggcctccatgggtttggctcggaccctctgtccccagcccggccacgcccgccccctggggttgccctaaacctggcggggggctcctccgccacccgcctcgcgtgtctcaaggcatgacagggggtcccggagaaccctgcctcgcccgggccaggaggcggcccagggacgcccaccccgctccccggagtccgcgcgccctgtggggtccgtctgcttgtgacactaaggggcgccccgcgacgggggggtgacgacccctactcacaccacattccgcgccatggcggccacgcgcgcttccggg

SEQ ID NO: 7192 - DNA, 9273 bp, Homo sapiens
ttccggctctttctcctgcagcaagacttttatttaggtgtcgggactgctctgccacagctgcccacctggggcgcgtccctgctggccgccccgtcacggcccgaaccagctggggatgccgccccgccgcgggtcgctgctctgccacagctgcccacctgggggcgcgtccctgctggccaccccgtcacagcccgaaccagctggggacgccgccccgccgcgggtcgctgctctgcctctgctgcctctcctcctcgagcatgctgtagaggtcgtcggcagcgctgccttcagggctctcgtctttctcgggaaacagatctgggaacgtgaaggtctgtccatgggcctaagggggagaacaaaggctccagccagagctgcaaagactcctcagcagaggggtctgtgggggagcctcatgctttctggcagcccctttctgccggcgccggattcaactgctcagaggtacctccctgggcctcctggggcagcgtccctgcctggaatgtaagcacccccacggccaccggcccccggctgtcacgctgcagcagaggccacagctccaggacagggccgctttccccaccattgtctctttagggcctggtgtctgcccccgccctgggtgcacccatttactagcacggggccacctggttggtggggggcagaaacaaggcatggaaaaacatgacacaaatcacgtctggtaccatgctgaacctgtccatccaaaatgcctcaggctctactcacattaaagctccccctcctcccagcccagagcctggcaattaaagtgaacatcacgtacgaagaaacatgcacgtgcggcagttgataaatcaggaccggctctgccaattaactggtcttacatcttctgctgagagttcagaatatgtccgtgtcagccaagccccagcccaggccacagcatgtggctcgggttcacgagaaggaggggatactgctccttggggacctaagcaaatacaagaagccatcttaacttgctaatgattactaagtgctccaaagctaagaggcagaaagagcagaccagaggagagggaagagaagagggaggaggagtgaggatggcacccgaatctggaaccctttagtgagtaaaatcagtcaggtacacttggctcttgcagaccctttgtgtgtaaataaatctggatgtgggcaggcagccaagtatgatctgaaacaggcccagatcccaccctgcgagggaggtgtatgcaccctgatccctggcgcagagcgcaggggctggcggggagagtggcactgcgtgcgccgtagccggcctgcaggaggattgccttacacagctctgaactttgcgtcttttaaaataccaaggggcagtcgtttacacgtgaggctgactgcccagaatgggagattcaccttgactatatggaggtgattctgctagttttccgaggcaaggggaacccaaaatgacagtttaaagcacaaacatggccatttgtcacagcttcgggaagaaatggggaaaggtgctgagagaaaatccgtttcttacaggagacaaacaccgtttggggatgccaagcatggtttcccaggggcttcccctttctagaagagttcaccttgtacctaaaaaaaaaaagcccttgatccttccaaaaaggagagagacagctgatcggggtaaagaacaggaatggagaaaaatgtcccaatgacaagtaaacaaggcagccctgccttcaggaatcccagggcgccctgggggctgccgcctgcctggacctggaggccggagccccgagcacggagctcggcccagctggcggcagcggtttgttctggagttgcctctcatgtcgtgcgcccttcattcctgcgcgcccttcattcccgcgctgctcagcatccacacaagcctcggggcagcgggcagtcaatggtctttttgttgtgtgggtcactgaggcgctgctttcagctcccaggactttgggccaaggagatgcttatcaggttgtcggagaaagaaatgtgggactcccgccacgtgggacagggcctttccacagcggccaactccaaataacgtggataattttacctttccaatgctccctccctgggctttgcaattagcagtgattctaagccctggcgcagggcccagggggacacgctgagcaaggtctcagcagacacgagacaggaaagggccttgagagtcccctctgcgggcagacagggaccaacggccacggcccatttctaggctgtgcaaagatgtgctggagttcaggaaggggggtgaggacccgttacaaattttcattctggaacaggaggatccatgcccaactgggacccttcaggctcccagttgccctgccctgtctctggctgcctggacttcacagagggagaacaacacgcgggcagcagctgcagacaccggatcccggagctgctgggttcagttttcatgggaggtggggcccagaggaagaacgcaagggctcggatgacttgaatgccacttgtagccgtagctgcttttgaagtgcccgtggcggtgccggcacacgggatgtccacccacatgccatgacaaagacagatgggcccgactgacactgagcacacagaggcctttatgaggccaacggctgctctccccacctggattggctgatttcatgcacagcaaatatcaggccaaattattccgggggcccctgtttagaacaacaaatgtgactgtttttcagaaaagctgccatgctaacttggcctttttcacaaactgcctccttagccccacaacaggccggctggcccaggaggcggtttccaccatcgtgtgactgccatctagtggcagggcccgccggctcggcctccagggaccatttacaccggaagacaaccccatccccacccagtaaggccagccccaggggcagagtggggaggcccaggaggcggccggggcaggctgtggacatcttggcccagagagaaagtgcctctgggtttgcctgggactcaaaatgaagagcccaaagaaaggctttgaaactgtgggtctcactcctgacaagtctgggtttcagaaactgaaggcccaggcaacgtggggtgagggttcttcctccccagagccccccaggatacgtaagaaagcacctgctcagaagcagcctgctgagccctaacaagtacgtgggacctgctaccctgcaatgcaggacatgggcctcagccaacagcccggccagccagacctgccttggcaccaaagacctttgccctcaggggcctcacactctgcctccgaggctgaaacccagccaaggacaggctctccagaggccggggcctcccatgctctgacaccctggtgtgcgttggagttgaaacccactaggcctgtgatggctgcctttgcccacagagaattcaaacttcaaaatcacaaaacggccggacgctgagacgtgccccatgtgccccagtgctcacgtgctcccagcgccaccactaacacccccaaggccgtgacggagcatgaccttatgtggagcctgcctctgcgctgaggccctgagatccggcctcacgggggctccctgggccccagcgcagcgtctccggcacaaacatccccaaggacacagttgcgaggagcccctcggaggccccgctggggctggccagctcacacgcaccagctgcacgtaggcgaccttgtagtccggcttcttgatcctcacgtttctgtgatctcttctcttgttagagcctgccggaagggagtgaaaaaaaaatcagaactttaaaaaaatcagaactttaaaaaattacatcctcagaggtcaatgccactaaaacgaacctctgctctcttaaaaatgtaaatatgtttttaaaaactcaaaaaggcgatttctcagggaaatgggcactgtaatcaaacgagccagcacagcaggctcccaggctcctcccttctcccaacagaggccagcaggttctcaacaaaggagcggacgtggcaccagccagggcacacgacaggggcttatggaacagacagcgctttgctccccagcctcagccactgcagtcccacctcgggggctgacggcaggagtcagggctcagaatggaccccgggccagcccagttgaattccaatccctgctctggcacgtaagcaccgtgtgaccctgacaagtcaccctgtgcctcagtttcccatgagccacgtcagaccaagacccccatgcagtagctgaggctgtggctcggcgaggtgggcatgtggcacagatgggcacgacaccaacaggagaacctcccatgggcactcaccatgctgcacccgtgtccgcacagcagccacgggcacgttatagatgccctcgaggtaattcctgaggtccacccttgtcattctggaggcgaaggagaaagaaaacggcatcttaaccaggctaaaagccaaaaatactgtcccagatgcacaagcacccgaggctgagaggccgacagaccaagacccacagggggcagggaggagggctgggtacatcagcggcactagtgaggccaggcagccccagcaacaccagtgctgctggctgcaagactccctactctgggcacaccagcatggggtggcagtggcacagaccccacagagtgggagcactgcccaaccaacccctggcctgctccacagccccacatggctccctgctccgggcaagtgcctgtgagaggaggtgacagtctctgcacgctcctggctggcaggtgccccacctcgtctgccccggggcccagtggccgcatcagggttaggcctgctctgcggctgatgggactgatgcggttctaggaagtaccttctggaaaggcctgcctggcattcggtgcgttaactgcagagttccctctactgcagaacctcacggtcactgtcaactcagcttctgggcccctgcaggctgcacaggcctgaccttcgcccccaggggagctcacgctgctgccccgcctggctcgcatcaaccctgagctggggacctgtgaacttaaacactgcagagcagcaccccagttttgctcgtagggactgtgcatttctctgaaggtcaagcaggctcttctgagcggttctgtacatcacggcctgctcccaacccagcctctcagggcgcctctcctaaaaagaagctgcaagaactcaacagaagacgcgagcacagaggtccaaattttaaggcttccagtgaagccgtccccgggtggagggcggcgtgcagcctgcctgccgggctccacacctacaggcactccatcaatacttgccgggcagggccgcctgaggtgccttcccagcaggaagaggctagcacgtgagcagagttgttttaactcaggacccaggcccccctgagggcactctcccaacccagcgggaaaacttccgggctcactccacggggatccccccgagggtgctccccaaccccagccggaatcctcccggactcactccatggggatccggaactgcacggtgtcctcgggctgggccacaccgggccgcaccagctgaatgaagaagttggttcggaacacccgaagttgtgggccacccagccggtacagggggtacctgtacagaagagattgggtccatgtcacacacttaggccaaggcagcccgacacaccaaccctgcagacctccgagtgtccactcacaacagggtgggcagaaaagggggtagctaacactgcggatccctgagtgtccactcccaacagtggtgggcgggaaacggggtagctaaccctgcagacccccgcgtgtccactcccaacagtggtgggcgggaaacagggtagctaaccctgcagacccccgcgtgtccactcacaacaggggtgggcgggaaacagggtagctaaccctgcagacccccgcgtgtccactcacaacaggggtgggcgggaaacggggtagctatcagcaggtcaccacccaaggacacagaggtccccacagcccctttctcacatgggcctgccaaggtggacggccagtccctagcatcgacttaaggagcatgcgctgttgacccccaaggtcagactttagaaaaggccaatggacaaaaatcagaaccccgcagacagcattcccccaataagctgatggcaaggctcaaagacgtgtgttggggcactgatacccctgggagagcagaccccacgcggccggcccactctcctgctgctcgggtgaagtggagctgcagagaaccacacaccatgggacagaaaaggccagctccgcactctcccggtggcagcagggcctagctcctcggtatggagaacgcaggctaaccaggcttaggctcctggaagacggtgctgccaagactctgattcagtacactaaatgtgagttgagtgcaccacaccccagcactccactaaaagccagcagaggcagatggagaggtgccaagtggccaccgcaaactagaccagcacgctgcctgggctggggggccaggtgacgatcgtgcagaatctctagccagttggtttcgtgcattctcccacgttcagctgggtggacaggcagcaccgtcctaccgtcccccacccccgttcccgcccctgccactgccggcacaccctggctctatctgggcctcagagctggggggaggaggggcacaggagaaactcaggcctgctgggtctcgggggatgtggggtctgagagcctaggtgcaggtcttggtggacggggagcacaggggctcttgaggggtctctggtggccttatctgaggcactgcacatggccctggccttgggagcacccagcaccaagttaagaggggctccgtgaggccaacgctgccccaggcttcacatgaatttcacgctggcctctgcctgtctagggaagatgaggaggaagtgagggtcagaggccttgggtggggtgttcctgaagggccaacagtggtaggcagcactgagcctctgggcctgagggcctggcaggggccaggagctgctgggacctctcagaggcaaggcgcctgtaacaaagcccgatcactaatcatgtccaccccaggcctcctgatgaccacactgacacatggcagcctggtggccgggccagtggggctgagtcttcactcacccaaccccagcagagcctcctcttgggcatggccttggcctttccaagcctcagagtgcagccttcaggggtgggccccagtgagaggccgagaagaaagggtgggctctggaggtggaggggcctgacttgttttacccacaggttcaggctagccatggccacccgaggggctcacacattccctctggtgaccagctgtgggactgcaggagtggagacaaagtttggggactcccagtaaacagtagaaaagagggttcaacagctcccaggccattaattttcgagtctccaggcttggggcctgaagggcacactttgctaagggtctgaagggccatgtgtgggcttgagatgagaggctggcaggggttgggccaggacgattcactgtccttgttcccacaggccgagcctctccaggctggagcgccagctgcctgtgcatggagcctgcagatctggaacaatctgcactgtcgacacccagggccccaggacagggctctaaggcctctcttttgttctcgaacccttgtgggcccaccagccctcagttccctcagtcccactctccccagggagcaccccaagcactccgcatgggatttcacaagcacctccacggtaacctatctcaagtagaactctgcactaacttcttcctcaaaacacaaaaacctggctcactgccaccagcctgcctccccacggccccacgagtgactcacccaggatcccaccctctcggcacccccaccccagctgcatccagtccacagcaagtccagtcagcgctccctgcaaaggctccctggcaacaggagtgtgtgcactgctgggcgagcgggccccgctgcctccaaggcaaccacacctgatccgtttccaggggcccaccacccttggcccttcaggaacaccccacccgggtcctctgaccctcacttcctcctcattctccagggacaggcgaagggccagcgtggaattcacgtgaggctcagggcagtgttggcctcactcagaccttttcttccttggtgctgggtgttccccaaggtcagggccacgcgcagcaccggtcccaggtgtctgctgaaggaagcctcctccactgggggtcccacctgccaccctcccctctctccccagctatgtgcaggggcctccaaagccacaccctggccccttgaccgtccctctccagaaacactgattactgttctccaaaacccacccgggagcccacatctactgattacgcctgagtcattcgttcaccaagaaatatgcagggcttcctgcttcaatttggggagggcgaagtggtgcaggacagcgccccgatggccccctgggaatccagagaacatgcagagtgggcgtggggggtctgggctgagcagaaccgggcctcccgccctgcctgccccaaagccctgagggctgcggtcagctgccctttcccactcaaacccaatctggattcccagctcctctgcctcaggccgcgcccgcgctgcggtgggggccgcccgggcctccccgcctggacccaacagccgacgtggcccccgccccgtgacgatcagaaacgtctccaaacagctccctcggccctggctgcgggaccagccccgggcctgaccccgggccaccctcccactccccacgcgggggcaccgtggcctccatgggtttggctcggaccctctgtccccagcccggccacgcccgccccctggggttgccctaaacctggcggggggctcctccgccacccgcctcgcgtgtctcaaggcatgacagggggtcccggagaaccctgcctcgcccgggccaggaggcggcccagggacgcccaccccgctccccggagtccgcgcgccctgtggggtccgtctgcttgtgacactaaggggcgccccgcgacgggggggtgacgacccctactcacaccacattccgcgccatggcggccacgcgcgcttccggggt

SEQ ID NO: 7193 - DNA, 14886 bp, Homo sapiens; identical to SEQ ID NO: 6351

SEQ ID NO: 7194 - DNA, 32681 bp, Homo sapiens; identical to SEQ ID NO: 6349

SEQ ID NO: 7195 - DNA, 14698 bp, Homo sapiens
aaagagtggaatggagtcactggaaaaggcatccaaggcgagcaggtctttcccgtccttggacccgctgcgtttgtgcttgtgtttcctccgaaaaaaggaccggcgtgcagccgctgacagcgtctttgtggcgctattgtcatctttgacttcagacatgctgagcctcctggagaattcttggtccatcctgtggcacaggggacaatgctgggcagggccatcgagaccctgctgccctgcccttcctgcccttcctggtgagaaaagcaaaggtgggccagacactgggctccccccacactccttggcaggtctcaaggctacatctcctcccacgcccctgggaaccctcggtacatgctgcgggggtgacacaaacaccagcaccagggcaagctctcagagcaggcgattttttctactacagcatattcagctcggtgtcaaaaggaactgctaggacagccttcaattggtgacatgacgagttacgcttcctgccatagaagggaaatgatgcagggatgcaggctgcctcgaaaacatgctcagtgacaggagccagatgaaaggccacactatgcaatcccaaccacacagaagtccagacagggagacccatgggtatcaaaagtaaagtagtggctgcctagggctgagggctgggtgggaggacagtgggataaggggctgacagctaatgggtctggggtttgtttgaggtgacggaaatgctctaaaattaactgtagtggcggctgcacacacctatcaatatgttgaaaaccactgaatggtacactttgagggagcggcaaggcacgagtatctccataaatccatttttctaaaacacgttatgccttctgacccatcactgtgctctatacagcactgactcacactaggagcagctttttagaccagcacttttggcaaaatgtagagagcagaagctaagataagaagcagaatccctcctccagcagccctggccccagccccctcccatgggacagctccatggctggtggccctcggcgacccctgccccaccccaccccaggcccggagaacacttacacatatttgctgggaatctgcccgcgctggatcttctgggcattctcgtccagctgccaagccatccaggacccgaacgtgccctggggtaaggtgtcatccacgtagaggatgtcgtccttcttaaagctcaactcttgctccacatctgccagccggtcgtacagggccctggaccacagcacagaaggaacacgatcaggcggctctggccaccaaggacgaaccaggtgccttctgtggccaggcccctaaggctgccattctgctttgggctgtctccaaacttgatcaggaatcgccgagggtggtgattctcaaagtggggagccctgtgttttacataaaggggcaaagactgcctttgctcccctaacactgagggcgcatccccatcaaagaactcaccaagatctgaggccataacttccctttccaggtggcctttcccagttgcctccctcctcgaagcccaggcccggcccctggttcctacagactggaatctctctaggatggaaatatgtcatcttctaccctagagacagggagttgtaccgcatcagtgttctcatgctttctgcgatcttggatcttaggaaatgtgaagaaagctctgagctcctcctagaaagcctgctgccatccctaaatgcccacagcatttcatacagtagtaagggcactgaagatgcctggaagtccacacacactgcagagggatctgcaaacctggcttgggggacaccagaaaaagaggagcacagcacacaggaaaacggggcttgactgcctccaaattctctaggtcttaagccctaaagagggggcccagctggttctttaagccctaaagggttgttctaagtcacaatcatctcaacataaataagcgtgcagattgagtgtcaaggaatgatgatcatggccccagccttggggggcaagaaacagagagccattcaccaggaaaagagtctccagtgaaagcctctcctctggttccaaatctcccaccgattccccagccactggtacctgatgtagaagctgtcaccaggcaggcccttggccttcgtgaactcctcagggcggtactgcaccttcaggcggacgccatccctgggcttcagcatctccacatagacttcctccactgtcttgttccgcacgtccaggctgccatactgccagggatgggggtggatgcatcagaaggcagaagccagggggcagcttgggcacccgagaggggccagtgctgaccatacggcagaatttcaacatccctccttaactgagactctggctacctcccctctgcaggaaggactgagtcttcatggtctccccagtctccaggtcctgtgcatgctccctggacaccaggtcctctgccaagtggctgccctgcccttgacagcttatccaggaaaaaccctgttctggtgactggcaagtctgggcttttcagaatagggaccttcctcttgctgatgttgcctgtgcttttatttatttattttctgaaacagggtctccctctgtcacacagactgagtgcagtggtgcaatcacagctcacagtagcctatacctcttaggctcaagtgatcctcccacctcagcctccagaatagctgggacaacaggcacactccaccacacctggctaatttttttgttttgttttctgtaaagacagggtctcactatgttgcccaggccggtcttgaactcttgggctcaactaattctcccaccttggcctcctaaaattcacaggtgtgagccaccaaacccagcccaacttgtgcctttatattctcacaaaccatctcccccatgaggcaggagaccacagagaaagaccatcctctctcatcagaacagagtcctgcagctacatcacctgagggcgagcaccccctgatgcccagggcctgagccaaggctctgccctcaggttccctcaatggcctgcctggcttcacagggacctcctcagaagggcttggcaggattctgggtttacagggattaaaaatcaaccctggccaggcacagtggctcacgcctgtaatccctgtactttgggaggccaaggcgggtggatcacctgaggtcaggagtttgagaccagcctggccaacatgatgaaaccccgtctctacaaaaaatacaaaaataaattagctgggcgtgttggcgcatgcctgtaatctcagctactcaggaggctgaggcaggagaatcgcttgaacctgggaggcggaggttgtggtgagttgagattgcaccactgcactccagcctgggcaacaagggcaaaactctgtctcaaaaaaaaaaaaaatcaatcctgaggctggacacggtagctcatgcctataatcacagcagtttggaaggccgaggcgggcagatcacttgaggtcaggagtttgagaccagcctgggcaacatggtgaaactggtctctactgaaaatataaaaattagccgggtatcgtggcacatgcctgtagtcccagctactcggaaggctgaggcaggagaatcgcttgaacctgggaagtgaaggttgcagtgagctgagattgtgccagtgcactccagcctgggcgacagagcaagactctgcctcaacaacaacaacaaaagtcagccctgactggctcaccagatgagaggctgtactcctccgtctttggtgccacctgagatggcagcaagcccactgtgcaggtagatggaggcctggcctgctcagcagctcagaactcacctccaggatgaggtcccctggcacgaggccgtcaggacccttggcaggactgtcatcctccacctcggccacaaacaccccatgcaggttcccaccacacaagtgcaccccaagctccagctgggactttttgatgaagacaacgcgtggctccagggtcttcttgttggcatctcccgcaatcctttcaggaaaaaaacaaagttcctcaactgtgcacaaagaggaggcacaaaaagacaaagcagtggccaatgccctaaccgctttctgcctgcttcttggggtctcagaaccacagggagctgagaggtggcctctagttctactggctcggcgttcgggacaggatgctaaggtgcactggagatgaaggcaagaccccaggtccaaagccagttagcgggggcagtcaaaaccgtaaatcagtgcccctgctcccaggcccggctatcaatctcatgccttaaagatcaggatggcctccctcccatgtggatcacactcattttcctaacttagtacttcctaaggaaaggtaaagttggcctcactgtccagagcacagcaatgtattcagcaaatgtctacgaagaagcttctatagaccagcaactgctaacttgtgaagaggggccccttgccatcaaggcacttacaatcaaggaagggaagctgaaagtaagctgctgaacacatggagggagtgagatgggacagcgatggaaacagatacagggggcttcaggggagatgccagcccgggaggaaaaccttgcagcaggtaagttccaatgtgacagactctggtatagagaatgcagagctggcctcattctgtgagatgctgcccagggcttggtgaaggcctctcagtgctggagacacagctcctccaggacggcagagtgatcatgtcacaccatggcctggatggccctccctgcagccccaggccaggctggacgctgtgcagctcccatggagctccttcctcctcctgaactctgctgctccctcggcctggacttctctttatgcccactcttggctcttgcctgtcctgaacattttaatccagctgccacctcccctgccacactccagtgatcttcctgcctgctctgcggcggccggcagtgccctcccagcaccctgactctgctgcacgtgcccggcactggtctgccacctcattgggggaagcactgctgtgggtggccagagcccagggcctggccgggtgatgactgtgggaatgtgtccaaagacagactcagaaagcgagtgaacaagaaaaggagaagagaaagagaagatgcaggggaaaaaacaagtcaatagaaaacaggagaaaaagagaaaggaaaagagagagtagggaaggaaaaaaggaatgccgtgctcccggcccaactcctgaagacctggtgtgcggcctgcagcacatgaggccagctgcccagtgcccacgccacttggagaatgtgctcagccccacccagccgaagcggacacagggaaggctcacagcaacgtctgctgacctggagctgctctgcttggctgggggggtgctaggcccctcgtcctgctccatcagtgggtcgatgacagatggatgctccggggtggtggtgccactgccctggagagtggagtgggtaccggcagggtccaggtgtgagctggaggcggaggacaggagggataaggagcagtacgaagccacccagagccacccccactcctgtggcaactagatctgagctataaatggggaccaggtcacatagccctgcaccctgtgccctgagcagagcagacacattagaagcctggacccatgacatccacctgtcctctcccctccacctgtcctcagctcaggggccctctccaaaggcatctgacctcaggaagctgtgagcatcctgtctcttttcctctgcctgtgcatcccatctctcctgctgagcttgtggcgcagcactgcagggcatgcctccccttcttttctgcccttcaacccacagctcaggggcagatacagacaggtgtacagcatctgctcctggacagggagccaaacactttgagtgagaatccacccccggggccacaactcctggctaccatgggcccctgctggtcagggggaccacagccatctgtttccacaccccatttcaggaggagacagcctctctatatatgccccttttccaaaatccagggctggtcaactctctctttagcagcagtaggatccccagaacttacggctggcaccctgggtctccctaaaatgagcagagtgctgctgcacccacctctccacccccagcccagacggccctgggaggcccgcactcacctggaccgggagtggctgctgagctggtgcacgtgggggttgtactgggccaggatggtgatggtatcacactgctgcccgatgatgagccgcgcctgctgctccgtggcgctccgcaggtttatgccgttgaactggggaaacaccaggatgggctcagtgggggggtcggggctgtggacagggaggaggccctggggacttgggagcagtgctgttccctaggaggaggagagggggaagaagtgcaggtttccatgggcgccatgcaggagggcagctccctctcacctccagtaactgatccccatactcgaggccagcctggtgagcgatgctccccacggtcaccttggagacgtagatgccgcccttctctccactcacgatggagatgcccagcggctctgagcccttctgcaccttcacgtggcgtggctcctccacataaggcctaaggaaaagtcaaaagtttcggggactcagggtcaaacaaaagggttggggagagcctgagctctctgatcaggcatatgatctgacagtgcagaaagggccccgagcctggatgctcccattgtgacacagctacatggggacatggtgggcccacccctgtgtgacaaacgatcacattcccacagcctcacgcaacacgagcacagcacacgcagacacgcaaccacccaggccaaagacacagagaacggtccgtgtgaactataaacactgatacatgtggattttcattacaggagaggagctgccccacaatatgcaattacaaactctggggggtcttgagatgccctccgaggaaaagagatggctcctgggatgacattccatcctaagggggcaacagaaaataatccagttttatgtttactggctacacagagtgatgcaaactggtcacggaaattaagctgctgcagacccaagcctttgtaaagggagaaggctgggagcaaggctgcagccatgcacttgctgccctggggctgtacagtgcacccaagggcgccggggcaggggctcggcagggagcctctgggcaggccaactgcatggtggaagacctgggcctggtggccacgggcagcctcagaagagatctgtggtggcagagacatctggaaggtgacaaaggttagaaagaagataagggacgctcagaggagaaagacaatcagagacacctggaacataacagaaaagacagtcaagtgatgcggagcctcccgttgggacttcacgccactcagggcttcattcctccaaggtatggacacctgagattttcctcgcaggataaaaccatatagccaaaggctgagggggccagtccaggtcccctctacagcacatggtcaggatagattctagcggggaggcacctaaaccaccccaccccggccacctggaggcagagcagcttcccacttggcagtctcagcctgtggccctatgccccagccctcttgggaaggggaaattaaaattcttcttgagttgtccctgctctctcccaccctccaaagtgttcccacttcccaaacttgcccactctggaaatcctcccttgaccctccagctcagacagatccaccccagactacacccacagtcccttccaattcaacacggattacagccccgtgctgttgagagctgcagagccctcagcacacagccacccctacatcaccctcctgccccagccttagatgatgaaacagaggcccagagcagaaagaggtccacctccgtacaacacgtgtatcacaataaaggagcaagcaactaagtcacagcaatagccacccaacagaacaatgatctgaaccaggttcccaggttccagtgacatgcaaagacgtaagggacacaccacggggtggggaggcccgatcggcatcatttcacttatatttatctgcatctgcaaacaaaagtatgtgtggatttatgcacaaggaggcttcttatgtaggacattaccaagtgttaacaatggtgtctccagttgaggggatctgagctaatcttttttttctttctttttttttggaggcagattcttgctctgtcacccagggtggagtgcagtggcatgatctcagcttgctgcaattccacctcctgggttccaatgattctcctgcctcagcctctcaagtagctgggattacaggtgtacaccatcacgcccagctaatttttgtatttttagtagagacagggtttcaccatgttggccaggctggtctcgaacccctgacctcaggtgatatgcccgtctcagccacccaaagtgctgggattacaggcataggctaccgcgcccagccagagataatctttactttatagtcttctgaatgatttgaattgtttgtaatatgcatagaagttttctctaaacaacagctgcttctcaaaagaggtttataaagtatacttaaactattaaaaatagctaaaaacataatattaagggagatttgattatgtacataaataataaagcatgtttatatatatatatatatatatatatatatatatatatatatatatccaaagggtaatggcaattgaatctcttgttgaagaaataatctgtgacttttttcttctttctacttttctgttttttattttttgagacagagtctcgctctgtcacccaggctggagtgcagtggcgcaatctcagctcactgcaacctccgcctcccgggttcaagcaattctcctgcctcagcctcctgagtagcagggactacaggtgcctgccaccgtgcctggctaatttttgtatttttagtagagacggggtttcaccatgttggccaggttggtcttgaactcctgacctccagtgatccacctgcctcggcctccttacaggtgtgaaccacagcactcggccttctttctacttttctatgtctctgattttccataacaagtataaaatactgtacttcagaatctgggaaacggggccatttttaaaaagaaagctgttgctcagtcaggtcacacatgtcaaatttcatctccaatcggatcctaaccaccgtgagggcaggagtcactcacatttttctccctcctggagcaggtcctggctctccgtgccctgtggggagctaagggaatgcttggcagtgggtggcaaggccttttccacaactgaagaacccacttcacttggggaaggtcccgtcctctctgtggccagggccggggctgagtaaaacaggccagcatgctcctgcgcgtgccacatggtaagagctccgtcagcatttcttccgagttacacccgattcccctacgggggccaggcctctgtgttttgctgtccttccgttacccctcaggttctctggttggttgccttttaagttcagattttcaagtcaaatataagattttctctggctgggcacggtggctcacgtctgtaatcccaacactgtgggaggccgaggcgggtggatcacctgaggtcaggagttcaagacaagcttgaccaacatggtgaaaccctatctctactaaaaatacaaaaattagccaggcgtggtggtgggcgcctgtaatctcagctactcaggaggctgaggcacaagaatcgccttgaacttgggaggcagagattgcagtgagccaagattgcaccactgtactccagcctgggcgaaaagagcaaaactctgtctcaaaaaaaaatatgttttcttaacatagggcccacccctgctgaggctcacagctacagaggcctcagctttctggactcaaatgaaagagagtatctgtgtttcttttggtgattaaataaaagtaagtttatcagagctctttaagatctacaatctagacagaagctgttaaatataaacacaatctagtaagttccatctaggggaacaacagagagggatgtgtgtgcacagtgcgcgggggtgacggattccatggaggaggtgcctctggacagacagcaagcctacagtcaacctgaaacctaagatggacctacattctaaaatgaaccagtaccagtaaaaagctaggctgcacatttatgctttcttcctgtgtatattttatttcacaacagaaagcttcgaatgagagggaaaaagcaaagggtaagaatgagtcccggtgccagccgctaaccacgtggccacaggtctgtcactccaacgtctggatccagtttcctcaactgtgaaacagggataacaataataacgacactggcagggtccctgtaaggatctcgtgacttagccacacgtaaagtgcttgaacaagggcccaggaaggtgtaaatggtgccatgatggcacgatcaccgtcaggtcatttccagcatcatctactgtgagccctcttggctccctgccttgccatccacacacgccccacctccctgcatccagtgccccatggcacttactggtgacaccagcaaatgctgggacactcaagctactcctgctgcttctactaagccccttccctgcagagcccaggcccgctgccgggatgcacactgtccactggtttacccactccaccgatgaccggccatgctcacctgtcctttctccgctccccgagggacgcggggttgacagcgattctgggcaatgtggaggctgaggtctgggactggctacaagaggacagggtgtcgatgttcaggggtgactgtggaggagtgctgcattcagaatgtgacactgaacctgcagagaggagcgggtaatgccggtgtgaactcccatctcacttccccaacagccaagaccaagaggcaggtgcgatccagacacacagctctatccccactgcatcgcatagtctggagctcagatgctaggctctgcattgccccctaccccccacaccaccaggcctactgctgggctcagtgaatttttactgactgactgagatgactatgaagttctcagctaagcccagagactccaccatgaggagtcagaccgcaggaaaagcaggagagatgggaatgtcgagaagtccttacctctctcggagcccacgacactccgcggatatcttggtgttgatgggattttaatgcgttccgccttgaactgcaagttactcgaagaacctattgttccataagggaacaaaacttcaggcctcatggttaaacaccaccctgtccttcctctccaccaggctaccagtcaggataataaatgcaaagctgggccctgctgtttattcccaagggagccttgatatggaacagtcaagaaaagcagacgtttaacatttatctcaatgaactgtgcaggcccagactgctccagaacaggagcgcacaagtctcacttccagccacggaacagcagcctaagagacacggcagctgctccatcttttctccccagcgccagagttccccaagatctccatgggctacctttgtccgactctcctctggggttcactttccatacaaaaatgtatgaagagccatacaaaacagtccagaatgaggccaacaacctcagggacacagagcaaggctcctagctgaggggtcacctgaatggccataaggcccccacagaaagcggaaggcgaaagcaatggctctgacagcagcatgggcatggctggcccatgaaggaagcagcccttcccagtagagaaatgagctcagtcccaggaggtgacaggagctcgtgtggggagcccacccgcagatctggacattaggatgcaggcagagatgaaaagcttggcaccctctgcagcacaaagtccaagtggtgcagttacccaggcgggcgctggagggcagtgagttggacccatgggtggctctcatctcggagtagtcgctgcaggtcctgtggctcaggtccaggctcaggcgtccctggtgctggacactgcgtaaaaacaagaggtgaggagttcgggaggagaaccaggaacagatgtggccactggggagaaacacacagaccaggcaagggttcccaagcgggcagaagggaggcccaggagccactgattatcagccgaggatagcaggctgccctcagccactcccggaggtggcatccactaagagccttcaggaagtagaaagggccacacacatggggcggtcagtatcatacccactccagccatagggtcaggattaggctcactaggaagaagtgataaaaaacagaggttttgcaacctgggtgggcctggggagggggaacctgtcctcccaggaagtgggtaaggagagacaaggcacagaggactttggggaggggacctatgtgcctcactcgggacagcgtgcctaagaaaatgaagggcagagcagggatcgcccacatcaggctgccctgagaccaggcctcaacagcatctttttccagctatgtaatgaggtgacatctcttccctgcttaaactctacagtggtctccactgtccttagaataaaatccaaactcttcatcacggctgcaggtcccacagggtttgtgccctgtgacctcaaacctcttcttgactcgctgcccctttgccaagctcccacgactgtgcctgggtgccctggccttggcaccgatggcccttctccctggaggctccagcccaggtcttgtgcagctggcctctttcatccttctggtcacagcagcatcccctctgccacagggcccttcctgaccacccactctaacttgccaccctcttccaagttacagcccagcctgtcaccctgtttgactgccttcatagcctcttggcaccatctgatatcacttcgttcatttttttttttgtctgcctcccacatttgaaaaaccaaacgacatgagctagaagctaatttgtttagttcagcaatgtatcctcttataattaggatagaccaaggcatgtagtaggtgctcaaaaaatatctgtcaaatgaatgaataagagtggcttggagccagcccaccctcttatgaagtaccagtttcctcatcttcaagacagaaacagtaataggacttagcccatgaggttgctgttgattcggtgaaatgatattcataaaggtctgagcacagtggctgggacataagcactcaaacatcagctgctatcactatcgtgtccttccagtaccttttgaaaccttgtgctgatgaattcagaaagcagccctaaggctccctttccctgtgctgctctagccagtcccctcccaggcaggcaaggaagcttctccaccaatgagcctctttatgcactcatggttccatgtccaggcaggcttgggcagctggggtacagagaagcgtagggtgccttcacatacctgggatgcaaaccctgggggccagcatctcgggccgcaggtggagagctgcaggggccgaccctgtgactgcgcacagtgtagatggggttccgcaggatggagctcacagtggtgctgggggtcaaactccggggaacagtacctagaaatgggcttggtgagaaaagacgccccaaaggacccagccagcccaggacttacacaagcctttcccctgtatcccaggacgcagccgcagtcttttgggaaaaggacttgggagatgagttttaaccaccaattcacaatgtggctgtggctcctggcctgtctccatttgtaaaaaggggggaagtctctttcatgcttcctatttcccaggttgctatggggagaaagcatgttgacaagctaagacatgtcatggctataagacaaaccatcccagacaggacagcatttcccagttctctggacctcagggctgaaaacacatggcagctctctgaaatgctgcctcccctctccctggagactaggcatcccgagtttacaccgaccctcagccccagcccctggctggctgactcacccacagacggcctgctagggtatagcggggggttgctgtgccggctggaatgcccaggcgagtaaggtgcccactcctggagctccggggagagttctccactggccgggacacacttctgttcctgcagatgcaagggcaagagtgtctgctagaaagagtggagtgtggccaggcgcagtggctcacacctataatcccagcactctgggaggccgaggcgggcagatcacctaaggtcaggagttcaagaccaccctggccaacatggcgaaatcccgtctctaccaaaaatacaaaaattagctgggcatggtagtgggtgcctgtaatcccagctacttgggaggctgaggcaggagaatcgcttgaactcgggaggcagaagttgcagtgagccaagactgcaccactgtactccagcctgggtgacagagtgagactccatcttaggggaaaaaaaaaaaaaaaaac

SEQ ID NO: 7196 - DNA, 355 bp, Homo sapiens
ctatacctccaggaactgagcaggaatcactactggagcaagcttcggccgaaaactgggagcagattttggccggcgacgcttctgccccagctcatccaccttctgggaggtgaggtcctcatcacaggatttcttggccggcaggtgggaggagtccccatctccttcagggtagtagctggaagcaatgcggaccctggccttgcgagggggtgatgcgtgcatgggctccccggggtccacgtcagggggcagggcgctcgggggactagtggatggggagctgcccaccagagtggcttctgactcggagctagtctccagcctgtgctggaacttaatggagtcgctc

SEQ ID NO: 7197 - DNA, 1305 bp, Homo sapiens
caattaattgccagccttggttcacactgatgagtgtgctcattggagagactcagcatgcaaaagaaaagactcatcaatttgcagttatttaatttcacgaactgccggatggtggagtcagtagcagcggctgggccgcaacatggcgcctcccacctagacttccggtcaggaaacttccaccttcctccgatttacgtgggcctgcatgagcctacttctcttcttattctagtgccagtggcctctggagtcttggtccttcttactggaagtagccctcctctcctgttacagaggcaataattctccagccttccggtcgccgccaaagcctcctgcctaatcacttcctgtattgtctccctgcggctctttgcacagaccttgggctctgtcgtctctggattcttactgatctcttcctcttctcccaaccgccttgtcatgtctctttgagctatgtcaggaggaacggaagggcactttcttactacttttgttagccaaacggacaaactgtcccctcccctttgttgtaaccacacattcaaggcttccttcagtccagccccatctcccttttcgttgcctccctttcactactccaaatgagcttgccatactttaaacgggtcttgtactttcttatcccttctctggaatgtcatttctactgaagaaaatcctactcttccctcaagacccttctttaatcccctcttgccatggaaacttgagattttcattgaggagctaagttggaaaatataaactagagctgagtctctaccctggcactattgacatttggggccagattattcttggttggggagactgttctgtgcactgtaggatgtggagcagcctcccaggcctctacctgccaaaagcacactcccctttccccaagtggtgacaaccaactgtttccagacattgccagatgtcctgaggtgggagtgagggtgaacagaattgcctcccagctgggggctgctggactaatcaacaagaagtggcaaggactgcaggcaaattgcctcagcacttagatttagcactgcaaggccacttcgacaggtggtagtgatttgtgcgtctcatttcctattcttgattgtgacaaggttctggaggatggagacagctacccctgccacagttcccacaggctatgttgtacatagggcttcatatttaacatgtgagtgaatgaaacacatgagcccgagtgctcttcaggacggcaaggcctacatcaagatggtaaaccttcagttcttaaaaaaaaaaaaa

SEQ ID NO: 7198 - DNA, 285 bp, Homo sapiens
gaaatatcaaacatctgaggagcttataattagttaagcatttacgtgtattaatatatcgtcatgtggacagttgagaggggagaaggcactagacaaatttaaaattgttagaaaccattggcaactgatattcagagcctaagttaaaagcaggatatgtctcaggagcaaatcttttgtgtaaatcctggtatttttactgcagacctttaaaatgacagacgcgggtgagtaaaaattacttctggaaatggatatgattaattaattcaattaattaat

SEQ ID NO: 7199 - DNA, 274 bp, Homo sapiens
tttgtggttcaagcagtttgtgaaagatttgaaagctgcatacatttggggtcaccccaaaaagtcagccctgggccacgagcagtggcagaggaagcagttacagagaattaacagagttacataaaatttactcactttgtaggcaaatatttctaaccttggctccctttcttaaagatctatttccccagctttgttccccagctcaaaagcatttcccaacacgtggatctgctaccactggatctgccaaagcagaatcctctttttt

SEQ ID NO: 7200 - DNA, 8159 bp, Homo sapiens
  misc_feature (7325)..(7325): n equals a,t,g, or c
gctttcccctgcctgcctgtctctagtttctctcacatccctttttttttttcttttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgtatcaagtggaggcggaggaggaggcggaggagggtggcaccatgggccgggcggtgccctccatgcccgggggagtgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacgcctgaggcccccaaacggaaatgggccgaggatggtggggatgccccttcacccagcaatacgccctgggccaggcaagagaaccaggaggcagagcgggagggtggcatgagctgcagctgcagcagtggcagtggtgaggccagtgctgggctgatggaggagcgctgcccgtactgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccaccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggtaaggctaggtgggggcctctttggaggggctttgcagcaccctggtttgcagcattcagtgctctgagcacagtgggtttggagacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttcttttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaacgagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctggcgtgagggaaggaaaggggtgctgcccgctgcgcggagtgcttggccctggactgcattgtgccctgggtccccactgtggcatctgcatcgaggacagtctcctgggggtggtactgggtggctgcctgttgcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcacgggcagtgttgtgccctgcaggcgtgaggctgagctcctgatgtcctctgcctcctcctgcagatcccatcttgggttctgcttctgtgtggctttcctctcaggctggagctggctcagggaccagggctcccccggggccaaggcctgtttcctccccaccccagctggaacttgttctacttccctctccctcccgttacttgatagctgagccagagccggcccctccctgggcttggctcctgtgcgggcgggatcagtggcctccctggctcagcatcttcaccccaggttggctgtcgtcctcgtcagggggagaccagaagggctgagtggcccagatgggacactgctctgagcctcaatttgctgatccacggaatacgaaaaccaggttacatccccagtgagtctggcagtttggggaggggagagtaggagaagatctcttgtgttttggtgcctctggtgcccaccttctatgtggttggggacagggccccagcgaggattggggaaggggcgtgtttggacttttttagccctaggtgaccttgattgtcctagggaagtaaggacaggccaggctggactgagaacataggggaggagccctcccctccccagtgagacagcaactccaggctttcccgcttttagatgggccccatctggactctctcctgtactccagagtaaggctgtggggtgctcaggtgggctgcagcagttgccgtggggacatggatcaccagtgtggctagagccagtagaaacgtgcttcttagtcgttctgagtggagctcctgtgtcatccttccttcccccaactccctggttggggacaggtgctccgttgacctgtaggtgggagagagttgactcccactggcagcaagggctaccagaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggccctggtcccacctgtccctcccctaggtgggaggcttggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactcagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagacgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttggcgtgnatgccaccccatccccctcatcagcctcttgttaaatcccacactcatttttcttcatctctgcccaccttccttagcccactctcctgggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctgggttgtcacctggacagggggcagccgtggaggcaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctga

SEQ ID NO: 7201 - DNA, 13327 bp, Homo sapiens
gctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggtaaggctaggtgggggcctctttggaggggctttgcagcaccctggtttgcagcattcagtgctctgagcacagtgggtttggagacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttcttttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaacgagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctgggctgagggaaggaaaggggtgctgcccgctgggccgagtgcttggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcacgggcagtgttgtgccctgcaggcgtgaggctgagctcctgatgtcctctgcctcctcctgcagatcccatcttgggttctgcttctgtgtggctttcctctcaggctggagctggctcagggaccaggggctcccccggggccaaggcctgtttcctccccaccccagctggaacttgttctacttccctctccctcccgttacttgatagctgagccagagccggcccctccctgggcttggctcctgtgcgggcgggatcagtggcctccctggctcagcatcttcaccccaggttggctgtcgtcctcgtcagggggagaccagaagggctgagtggcccagatgggacactgctctgagcctcaatttgctgatccacggaatacgaaaaccaggttacatccccagtgagtctggcagtttggggaggggagagtaggagaagatctcttgtgttttggtgcctctggtgcccactttctatgtggttggggacagggccccagcgaggattggggaaggggcgtgtttggacttttttagccctaggtgaccttgattgtcctagggaagtaaggacaggccaggctggactgagaacataggggaggagccctcccctccccagtgagacagcaactccaggctttcccgcttttagatgggccccatctggactctctcctgtactccagagtaaggctgtggggtgctcaggtgggctgcagcagttgccgtggggacatggatcaccagtgtggctagagccagtagaaacgtgcttcttagtcgttctgagtggagctcctgtgtcatccttccttcccccaactccctggttggggacaggtgctccgttgacctgtaggtgggagagagttgactcccactggcagcaagggctaccagaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatcttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtctgcggagggtgaggaattgaagcagtcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagacgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttccctggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctgactccatctgcaatttagggcctttattgaccgaggagggtatggaggtttgagggccagtgagcccaccatagtggagcctgacctcagcaggccactggctggagctggaagtctggggggacactgcccaggccagtgcactgcaggtgaggttgatggtgccagggcgtaccacagggagcaggcagaacctctgtaaggtggccgtaaggaataggaagatacccgagtgggccaggcctgtgcccaggcacatctgctttgccgggtacacaggtgcacagtgagcaccaggtaccccagagccagtccaggctggtccccttcctcctctgcctgcacctgaggcaaagggcatgaaagcatcattgccctggaacttgcccttgtccaggaagttggtagggttgaagcagtctgggtctttgaattgagtggggtcccggtgtgcagtcacaagcaggggaatcacaaaagtgccctggggatacatgcaacttgggttacctgcgggcttggtgagcacctgcaccacctccatccaagacgctttttaaaagcccaagggaataggccgggcaagtagctcacgcctgtaatcccagcactctgggaggctgaggacagatcacttgaggtcagaagttcgagaccagcctggccaacatggcgaaacctgtctctactaaaaatacaaaaattagccaggcgtggtggtgggtgcctgtaataccaggtactcaggaggctgaggcaggacaatcgcttgaacccaggaagtggaggttgcagtgagccaagatcatgccactgcattctagcctgaatgacagagccagactccgtctcaaacaacaacaacaaaaagcctaagggaaggcagagctgccttcctgctccaggggtaactgattgtgttttggtctgcacagcgcacacctgctgattctggctgatctcatgcacccgggtcccgcacgggatccccagactcagtgggtacctttgggcagacagtggctgtgcaggtgggtgtcgagggtgagggtgcgcggcagcccaggggcaccacgctgatgaagcactggatctcgagcagcactgcgttggcgtagggcaggcacacgcgatagtccaggcttggggcgggcctccaccctaccacagggtccagctcctgcaccttggctcaggccgggggaggctgtgagctgcgcacttccaggaccctccagccatccccagactgcagcctcccattctgggtctctccgggttgcacacctgccacctctaggtacttaagcagaatgaggagcccatagcacagggtggtgctcgtggtttcggtgacgccaaaaaaaaaatgcgtcgtcattaccgacgtctactcctggaaatggctctccgggtcctgctgttactgtgggcagaggagatgtgctgccgcgtgccaggcacctgttggtgggcggcatggatagagtttagagagctgggacccatgccttacccatctggtcaagcaatcaatgaaatcgcggggctccgctggctgccgcatctgccagtgtcgttgaatttgctcagagatgacccgcagctccgaaaagtttcggaagattcggtggtgcgggcccgggagccagtccatgagggacaggcaaatgtacatctggagagacagggtctgtctcaacatgggccctgcacaaggccactaggccttagtttccctacagggagattggactaggactttgatactggatgttctagaactcttccaggaatctgtcccattctaatgatccattgtaggtaggtctgtgtactcgggatttggcataaggctggacgcaccaaggaaagattgtggccggccctctcacctcgccccatctggaactaatgatgcagaagttgtcactgaagaggttcaggagcctcaggaactccgggtccccatagcgatagcggttcccgaagacaagaacagataacattggatacagcattatccagtagccgcacggggtcaaacggggctcctgggggtaggaacaggacggtggtcataacgcgtggtcctgcccccagccagccccatgggcttactggctttcttccacccaaataccttccagtggccccgtcttggcagtgcaagggactctcccacaccaggcccttccgctctcccggccaggccgaagcaatggtggcttgaaattcgtctagcagacaagccgcctcctccaggacgcgcgcctcgacggtccgcgtacccaacccgaacttcttaagcgctccaagtgcaaaattgcgcagtgtccaccagcacggccggttagaaaacaagattcctgtggtggggacgggaaaggaggcgggccggggagccggccacgccctatccaggaagcgccgggtcactggctacatccctttaggggcctccgactcctgcggccggcttcgttccctttgcttctttaccagacctccaagtgccctatccacacattggccccgcctttgctgggctccatccctgacctaggctggctctcgggctttgactcttaggctcttttctcctgttggctgcaggatgaacctccattctaaccttacgctttagcgccgccccgccctctctcggccgtttgcacctcattagctggagtctctattaggccccgcccccatttgcccgcctctaccatttacccgcccagcctggagcgtccgggccggcaagtccagcgccggggcctcactgtttccgcgtgtgaagcgttcgaagactgccatggacccgcggccagagaccgcatccgcctgtagcactaacgcgtcccgcagcgctgcgtagccgcacagccccaccgcagggcgcgggcccagccgcactgtgaacacccggccccagcggccggagagctacgggtagccggtgctcagcgggtgcccatagggttcctcatcggagccattgcccccagctccctcttccttcagacccaggagtcctcgtctcagaccctcattcctcaggcccaggaattcaaatccccagctccttcctccctgagatccaggagtccaggcccccacttccttcttcccttaggacctggaagtccagcttcccagcctcctgcaccctcagagtcgtctcctgggccctcagtactcagcctgcccaccctgaaccagaacagaccccctgctcccctcttcccacaacctgatttcctgctctgggctccttcgttacgacccagtgtcccggccccaggctctccactccctattctcctttcctagtactcagcagtccggagcactcatccttcctgtccttcctcaggatcatagagtacaaaccctcagctgtcttcattcaggaggagttctagtccccagccccaccttcacgaatccagaattccgttcccccattcctgtcgggaatggagtgcgcggtccaggcctccggactgcagctgcaagttccccagcaatgggagcggcctgggccggggaggtagggacccccgcatctgagcgcggcacccaccctacccccaccacgccggcgccagcaccagaagccacaacagcagcgcagcgatacccgcgacatgcctgcaattctccacgcctgcaccccttcacctctatttgatttccaaggggtcttaggggtggagcggggcggagacccgatgtgggaggagtgggcgtctccgggctgctcattccgtggattccccaacccgacgtctccaccccgcccccagccctagtggagctgtgccctggctccccctggctttttttgtgtgtctgcctcagcctgtcttacttagcaactttcgtgcaccagcattttcatggcaacacacctggacaacaggtgcaccctcctgagcccctagcacctttgagtccaatttacttggcctgtaagtgtgtattcctcaatctccgggccacctctgggtcccctgaacgctgtaccctgtacctctgattcctaaatacacaccgactctcaaatacaccacttctgttttttttttttcccttcttagagtttcactcttgttgcccaggctggagtgcagcagtgggatctcggctcactgcaacctccacctcccaggttcaagattctcctgtttcagcctcctgagtagctgggattacaggcatgcaccactaggcctggctaatttttgtatttttagtagagacggagtttcaccgtgttggccaggcagatctcaagctactgacctcaggtgatccgcctgcctcggcctcccgaggtgttgagactacaggccactgcgcctggctcaaatacacttctaaagacacccctggcattcctgtgctctgtgcctgtgattcctaggagctcacacctgagcccttgtcacttccattactcttaggaccctgtgtactatgcttgttccccagatctgccttcaatttccctggcttctgggtgtccatcagtctggcacttctgtgcctctccttagttcttcagggtgcctttctgcatgttgatccccttgtacctccatattatgtcctgccctgaatctaccatctctatccccaaggcactggctcccagatgcccccaaatgttctgtgcccatgctgctgaaccccctggtatccagtcccccaagtccctgtctgaggccaggccatgacgacagacaaacttatccctcattctctcatctatcccccccaacccccatcctagggcatgggctagagggggcagactctggcctggatgggccagggctgcggtggtgggagcagtgaggttggggctgtatttggaacagactgttcaggaatgtggtccaccctcctgcctgtccctgcttggccaaatccagccttcctccaagtgcctggcacagggcccagacctggggagatggtgggcggggggtggactgtgcagagcctaggactggcattgtctctgggagggtctctgtgtatctttgtttcatctctcagtcttgcttgctccctccctccaataaaaaagaaaaaaaaaaaaaaagaaaaaaaaaaaaaaaaaaaaaaaaaaaaaaaaaaaaaagaaca

SEQ ID NO: 7202 - DNA, 8165 bp, Homo sapiens
gctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggtaaggctaggtgggggcctctttggaggggctttgcagcaccctggtttgcagcattcagtgctctgagcacagtgggtttggagacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttctttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaacgagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctgggctgagggaaggaaaggggtgctgcccgctgggccgagtgcttggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcacgggcagtgttgtgccctgcaggcgtgaggctgagctcctgatgtcctctgcctcctcctgcagatcccatcttgggttctgcttctgtgtggctttcctctcaggctggagctggctcagggaccagggctcccccggggccaaggcctgtttcctccccaccccagctggaacttgttctacttccctctccctcccgttacttgatagctgagccagagccggcccctccctgggcttggctcctgtgcgggcgggatcagtggcctccctggctcagcatcttcaccccaggttggctgtcgtcctcgtcagggggagaccagaagggctgagtggcccagatgggacactgctctgagcctcaatttgctgatccacggaatacgaaaaccaggttacatccccagtgagtctggcagtttggggaggggagagtaggagaagatctcttgtgttttggtgcctctggtgcccactttctatgtggttggggacagggccccagcgaggattggggaaggggcgtgtttggacttttttagccctaggtgaccttgattgtcctagggaagtaaggacaggccaggctggactgagaacataggggaggagccctcccctccccagtgagacagcaactccaggctttcccgcttttagatgggccccatctggactctctcctgtactccagagtaaggctgtggggtgctcaggtgggctgcagcagttgccgtggggacatggatcaccagtgtggctagagccagtagaaacgtgcttcttagtcgttctgagtggagctcctgtgtcatccttccttcccccaactccctggttggggacaggtgctccgttgacctgtaggtgggagagagttgactcccactggcagcaagggctaccagaggggaccccagggagagtccagcttgcttggtttgctccttgaagagcagcttggaggtgggacagtcacaggcttctgactggggtgtgtgtgtagtgggggtggggctcttggcaggcagattgtcaccaatagcctttaagtctttggtctcctggccctggtcccacctgtccctcccctaggtgggaggggtggagagcaagtttcctgaggccttcccctgtgagggcaggaagtagatactttccttggggccagaggatgctttcacccccaaggtgtgtatatgtgggggaagggtggggccctaaagagcaggttcctgtttctgtgtgagtcccatgtgcttggtgggaggcgctgtgtgagaatgtacagggcaggaggaaacatagcagggctggggtgcagaggaggcccagagcagtgcactccagtctgcaggtactgcactgggcactggggagaccaacctggccccaggggcttccctgtggctgccttccagggcagtactaggtaaacaggtgcctgtgctgatgccatgttgctaggagtggaacggacaatcagccggagtactcaaggtgacccttggtctctgaatcctgaataacaaagagggtcagaaggaagagtgtcccaggccagtgctgaggccttgtggtggcgatgagctcagcctgttgaggcatggagcagagtgatgggagaggcacatgaggttgggggcctttgaggctgtggttgggaatttgtattttctcaggatggagtgaagacctggagaggaggggctctggctgctgtgtggggatgaattgtgggaagagggtgcagcactggaccccttccctgccacccatccacgtgcatcatcagtgtaatctctgattggattcctaattggggaggtcttgcccatctctagtcagtaactcactgtttctaagcctcctggaccatggcccaattcttctcccagtgaggtggttgctcagagtgccgacccttccatagggagtgagcagtgcaaagaaggtgccccctcctgaaccttgaagtgtagccattagggttttccctggggggccttctcactaattgtactctggtgctgccagagagaaggttgtcagcttcccactgctaggtggcagtagatggtggcagccctctctttccagggcaaggtctggtggatgaggtgcacatggttaatgcagagcagcttaacatccaccacagagggtgagccctgggataatgtgttgggaggcgtcctggggagggtgaggattgaagcagcccagtctgctgtggcgtgcgtgcttggcaagcatcctgttgtggcagtggccactgatgtttgatcgtgaatgtttatcttgggactgtcttgctgggccgggcccataggtgtagctgagcattcgtggggaatggacgccagcagagttgtaccagggcagagaggtcagggcagagaggtcaagacagatggtccgggctggggagaagttgaagggtccttgtgccagtcctcccctttttgtgtgctacctcatcttgccactgcagtgactttgggcagagggtgggacagggaccttttaaaatttttaaatggcatttcagcctgtgctccagttctccatgtggcaggcactgtgctggctgtcttcccagacacttgttatcttgttcacttgttccacaacaacctgtgaaatagctgtgagctccattggatccatggatgaggaacctgagaccaggaagtcacctgcctgatgccacagctcatgtggcagcactgagacttgaaccagggaattgtgtctgcagaagtggctgggccatttcctttacctctcagccacctttctgccagctccctgatgacaaacatcccggggccctggccacagcattgtagggctgggtcaggggagtggcaactgtcaggcagaggaaagaaccctgtagacagagaaaccaagccctgcaatgagtcctgttagatctccaggagttggggctccagaacctcccaagttatgttctcagagagattaattgctaccgctgtaaacagcagtgtttattacccctgctgtacacatcaggcagttgaggcccattcaggtgttggaactggctagggttacccagcaaattatccttggagttggaattaggtctttctattcagactgtagcttttggctcctgttcggaggtctatgggacagataatttagtggggattctttgtagtccagggcagcagttcttaacattgctgcatggtagaattacctgggaagctttaccaatttcaggcccttccttaggccaggtacttcagaacctcagagctccccagggggctccactccacagccaagggtaagaattcctggtctagggctgtgaggccacctccttgcacacctgaaaatgtttaaattggtattattctactgaaatggctgaggtggggtttggggtatcttgaaacaaatcaaactctgttactaattgagccctagctgggtgccaggccccaggtatgtgtgttgggagggagtgggctcttgaggcccaggagctgaggtttctgatagacttggggatgggattttggctgaaaaagaaagtcttttggggcaggagcttggaacccttgacccaaggagtcatggggaagatggggcaaggaggggtgggaaaataggtaattcatggctgcttctctaagatgtgcctgcctagccccagtaaacctacctccctccatccctgccaggccatggtggcgtgttacccaggcaacgggctcgggtacgtaaggcacgttgacaatccccacggcgatgggcgctgcatcacctgtatctattacctgaatcagaactgggacgttaaggtaggggtgagggtgagggtgagggtggcgctggggctagggctggggcgggggtggcgtgcgtccactccattttccactctcagcccagattctggcattctcctgtttctcttctcaacacacagcgggcagtgcgatctgccggctcttcctgggaaatggcacctcctcctctctagcggactgtgtggtgggaactcccctctttccgggaatggtgctgtctgcccagccccacccggccttgtaatgaacactttcccccttttcctgtctttagtagcttcctgcccatctccatggtgatgcagtctctgggttgtcattcactttgagagcccgaggggtgggagggagtgatgcaggcagacgctgcgcctcctagtgggctcccggggcaccgtgggaggcagcggctcctggccgtaccagctagcctcatcctttggcctgcccccaggtgcatggcggcctgctgcagatcttccctgagggccggcccgtggtagccaacatcgagccactctttgaccggttgctcattttctggtctgaccggcggaacccccacgaggtgaagccagcctatgccaccaggtatgacctgtacttctggagacgcacccaggtgctccccctgtgacaatgtcctgtcagagcctcagagtgactagggagcgacgaagtattgagagggggcctaggtgggagcagaaccgggtggctcaaaaggatggccgcctagtgtgtgtggatatggtagctggaattgcagaaaactaatgtccaaccaccctggtctccaggtacgccatcactgtctggtattttgatgccaaggagcgggcagcagccaaagacaagtatcagctaggtacctgcttccctcccttcagtccttcctattctgtgggccctcttgggcctgatgccaccccatccccctcatcagcctcttgttaaatcccaccactcatttttcttcatctctgcccaccttccttagcccactctcctggtaccccaacaggagccccatttcttcctggtcctctccccatctccccaggtttcccttggcttctttgtccttctgatgactcactgtctcctgtcccctctcacccccagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgcacacatctga

SEQ ID NO: 7203 - DNA, 1182 bp, Homo sapiens
ccatctgcaatttagggcctttattgaccgaggagggtatggaggtttgagggccagtgagcccaccatagtggagcctgacctcagcaggccactggctggagctggaagtctggggggacactgcccaggccagtgcactgcaggtgaggttgatggtgccagggcgtaccacagggagcaggcagaacctctgtaaggtggccgtaaggaataggaagatacccgagtgggccaggcctgtgcccaggcacatctgctttgccgggtacacaggtgcacagtgagcaccaggtaccccagagccagtccaggctggtccccttcctcctctgcctgcacctgaggcaaagggcatgaaagcatcattgccctggaacttgcccttgtccaggaagttggtagggttgaagcagtctgggtctttgaattgagtggggtcccggtgtgcagtcacaagcaggggaatcacaaaagtgccctggggatacatgcaacttgggttacctgcgggcttggtgagcacctgcaccacctccatccaagacgctttttaaaagcccaagggaataggccgggcaagtcatcacgcctgtaatcccagcactctgggaggctgaggacagatcacttgaggtcagaagttcgagaccagcctggccaacatggcgaaacctgtctctactaaaaatacaaaaattagccaggcgtggtggtgggtgcctgtaataccaggtactcaggaggctgaggcaggacaatcgcttgaacccaggaagtggaggttgcagtgagccaagatcatgccactgcattctagcctgaatgacagagccagactccgtctcaaacaacaacaacaaaaagcctaagggaaggcagagctgccttcctgctccaggggtaactgattgtgttttggtctgcacagcgcacacctgctgattctggctgatctcatgcacccgggtcccgcacgatccccagactcagtgggtacctttgggcagacagtggctgtgcaggtgggtgtcgagggtgagggtgcgcggcaccccaggggcaccacgctgatgaagcactggatctcgagcagcactgcgttggcgtagggcaggcacacgcgatagtccaggcttggggcgggcctccaccctaccacagggtccagctcctgcacct

SEQ ID NO: 7204 - DNA, 1186 bp, Homo sapiens
ccatctgcaatttagggcctttattgaccgaggagggtatggaggtttgagggccagtgagcccaccatagtggagcctgacctcagcaggccactggctggagctggaagtctggggggacactgcccaggccagtgcactgcaggtgaggttgatggtgccagggcgtaccacagggagcaggcagaacctctgtaaggtggccgtaaggaataggaagatacccgagtgggccaggcctgtgcccaggcacatctgctttgccgggtacacaggtgcacagtgagcaccaggtaccccagagccagtccaggctggtccccttcctcctctgcctgcacctgaggcaaagggcatgaaagcatcattgccctggaacttgcccttgtccaggaagttggtagggttgaagcagtctgggtctttgaattgagtggggtcccggtgtgcagtcacaagcaggggaatcacaaaagtgccctggggatacatgcaacttgggttacctgcgggcttggtgagcacctgcaccacctccatccaagacgctttttaaaagcccaagggaataggccgggcaagtagctcacgcctgtaatcccagcactctgggaggctgaggacagatcacttgaggtcagaagttcgagaccagcctggccaacatggcgaaacctgtctctactaaaaatacaaaaattagccaggcgtggtggtgggtgcctgtaataccaggtactcaggaggctgaggcaggacaatcgcttgaacccaggaagtggaggttgcagtgagccaagatcatgccactgcattctagcctgaatgacagagccagactccgtctcaaacaacaacaacaaaaagcctaagggaaggcagagctgccttcctgctccaggggtaactgattgtgttttggtctgcacagcgcacacctgctgattctggctgatctcatgcacccgggtcccgcacgggatccccagactcagtgggtacctttgggcagacagtggctgtgcaggtgggtgtcgagggtgagggtgcgcggcagccccaggggcaccacgctgatgaagcactggatctcgagcagcactgcgttggcgtagggcaggcacacgcgatagtccaggcttggggcgggcctccaccctaccacagggtccagctcctgcacct

SEQ ID NO: 7205 - DNA, 4048 bp, Homo sapiens
gcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggtaaaagcaacaggctggggctattcttgggggaatgagagttcaccttgcagccttggggagagcaggtgccactactgtccttaatgccacaaccgatttctctagagaccaagatttttagaggttttagctgaagtcatgtgttgatggatgcaaagcttttcagaacccctctgctgggtacctctacttccttgtactttgaaatgcagacacatcagaaagtaagaggttcctgtgggataccgctaaagaaggtgccagatgtagccgggcgcggtggctcacgcctgtaatcccagcactttgggaggccaaggcgggtggatcacctaaggtcaggagtttgagaccagactggccaacagggtgaaacctcgtctctactaaaaatacaaaaaattagccaggtgtcttgacgggcgcctgtaatcccagctactcaggaggctgaggcaggacaatcgcttgaaccagggaggcagaggttgcagtgagctgagggtgccaccactgcactccagcctgggaaacaagagcaaaactctgtctcagggaaaaaaaaaaaaaaaaggtgccagatgtttaaagttacctcaccctactgtcattttcttttcttaatgtcattccacctgggtttgaaggagctgtgatggcgttctgtccacataatgacagaagatccgtggtgggatcacagacatgcaaagggccaagttggaagagaccttcagaatagtggagtccacttgcattgcatatggagagaaactgaggccctaggttcaggggggagggaacaagtacaaaaatcacagagcaacaatgcaggataagtaactacttgctgcccttcctccctctcctagcactcatcctgccactcatctggagtcaaggtaagaagaggaattcaggccgggtgcggtggctcacgcctgtaatcccagcactttgggaggccgaggcgggcggatcacgaggtcaggagatcgagaccatcctggctaacacagtgaaaccccatctccactaaaaaaaaatagcagagcgtggtagcgggtgcctgtagtcccagctactggggaggctgaggcaggaaaatggcatgaacccgggaggcggagcttgcagtgagccgagatctcgccactgcactccagcctgggcgacagagcgagactccgtctcaaaaaaaaaaaaaaaaaaaaaattcattgctaaccaaggcttacatttattgagaggacacatcagacagtcatttagtactcctgatatccccaagcagtggtgaatgttatttattcccatttaccaggttgacagactgagtatcagaaagattaaagtcacttgtacagaatcaccagggcataattgggtttccagctctagaatccctacatttatctttaaaagttttccctagggacacattccaggcatcttcatgagtgaaattagagctgtctgatagcgtatgagccttcgtaaatctcccagtcactgaatctcagaacttgctgcagctcaaggctctgatggtccagcgactgcacatggctctcagggtgcacctgctgccacccccaggcctccttgacccaaatgaggcacacgtcctctatttctttgagagacagcctcagcccatcaaaaagccattgccccttccgtggagacaggtttggactctatcagagcaaactaatttgacttaacatggccttctctctgctctcaattaccgagtaaagatctgatattcatttacattattatgctctcggggacacagaaagcagtttcaaaggccaagtaaagggcacacatccatgaggggaacagtccttagcagaagtcatcacagaacatcttgtctctgccattccgttttaaactcaagtcctccttccctaccctgagcaaggttcttctccaaggatgctagtttttcagctatacaatgcaacacctccaacgatgcaaatgcatggtgggctttggaaccaaacaagaccccccaaagctcagttctgccctgtaactagccattggaccctaggcaagtgatacagtctcaccaagcccctgtgtcctcagttggaaaacaggggtaagaataccaactacctaaagtaacgctgtggatttcatgagaatatgagagattcctggaatagagcatggcaccccatggatgcagtaaatgccaggttactttggaatttttggacctttgggaaatctatcccaactttttctccttctgccacctacactctgccatccctttctgtggagttgctacagtaacgccacctgggtatacagaattccaggccctccaccccattcattgtctctatcaaaatgtacccatcttcctggccaggcacagtggctcatgcccataatcccagttctttgggaggctgaggcaggaggatcacttgaggccaggagtttgagaccagcctgggcaacatagtgagtccccacctctacaagaaatacaaaataaaaaattagctgggtgtagtgacatgcacctgtaatcctagctacttgggaggctgaagcaggaagatcacttgaacccaggagctggaggctgcagtgagctatgattgcaccactgcacactagcctgagtgacaaagtgagaccctgcctccagaaaaagaaaaaccttacccatcctttgtcccattcatcaactctgacctatgtttgcttccagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatcccc

SEQ ID NO: 7206 - DNA, 163 bp, Homo sapiens
ggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagag

SEQ ID NO: 7207 - DNA, 1127 bp, Homo sapiens
gatttttgtcttcagccgtgcaactatgttggggtcatcttattcctccttttcggcggtggacacaggcaaaaacattttaatacaatggaagtgcatcccctggcagccctgcggcagtcacagcctccttattggcaaggctgaagtcaaagccttgggctgcccagcctgaatgacactggcttcctgggatggttgttgctgtgtcagggacatttctgggtctctgccactgctactggtgctcttggtggagaaggccacagggtgttgctggggaggtggtgagccagaggtttctgggtctgcaccactgctgctgttgctctgggtataggggtaggccacagggtcatgctgggcggcttgttgagcctgggatgtttctgggtctccaccactgctgctggtgctctgggtggagaagaaggccacaggctgatactggaaggcttgttgagccagggacatttctgggactccaccactgctacaggtgctctgggtggaggggaaggccatggggtcatgctgggggccttgttgagccagggaggtttctgggtctgcactactgttgctggtgctctgcgtggagggggaagacacagggtcatgctggaaggcttgttgagccagggacatttctgggtgtatccagttgtgcaggtctcctcctcttgcatactctgttactaaataaataacagggtgatgctcaggggcttgttgagccagggatgtttctgggtcttcaccactgctgctgttgctctgggtggagggggaggccacagggtctttatgtatttaagcataaaggcaaggcttggcgcggtggctcatgcctgtcatcctaacactttgggaggctgaggcgggtggattgcttgatcccaggagttcaagaccagcctgggtaacatggcaaaacctcatctctatagaaaatacagaaattagccagctgcagtgcatgcctgtggtcccatctactcggaaggctgaggtgggaggatcacctgaacctggaaggtcaaggctgcagtgagccaagattgtgtcactgtactctagcctgtgttagagagccagacactatctcaaaataaaataaaataaaa

SEQ ID NO: 7208 - DNA, 1115 bp, Homo sapiens
agccgagcaacgatgttggggtcattttgatacatgcttcttagtggggggcacaggctggaacgttttgatacaatggaagtgcatgccctggcagccctgtggagctcacagcctccttattggcaaggctgaagtcaaagccttgggctgcccagcctgaatgacactggcttcctgggatggttgttgctgtgtcagggacatttctgggtctctgccactgctactggtgctcttggtggagaaggccacagggtgttgctggggaggtggtgagccagaggtttctgggtctgcaccactgctgctgttgctctgggtataggggtaggccacagggtcatgctgggcggcttgttgagcctgggatgtttctgggtctccaccactgctgctggtgctctgggtggagaagaaggccacaggctgatactggaaggcttgttgagccagggacatttctgggactccaccactgctacaggtgctctgggtggaggggaaggccatggggtcatgctgggggccttgttgagccagggaggtttctgggtctgcactactgttgctggtgctctgcgtggagggggaagacacagggtcatgctggaaggcttgttgagccagggacatttctgggtgtatccagttgtgcaggtctcctcctcttgcatactctgttactaaataaataacagggtgatgctcaggggcttgttgagccagggatgtttctgggtcttcaccactgctgctgttgctctgggtggagggggaggccacagggtctttatgtatttaagcataaaggcaaggcttggcgcggtggctcatgcctgtcatcctaacactttgggaggctgaggcgggtggattgcttgatcccaggagttcaagaccagcctgggtaacatggcaaaacctcatctctatagaaaatacagaaattagccagctgcagtgcatgcctgtggtcccatctactcggaaggctgaggtgggaggatcacctgaacctggaaggtcaaggctgcagtgagccaagattgtgtcactgtactctagcctgtgttagagagccagacactatctcaaaataaaataaaataaaa

SEQ ID NO: 7209 - DNA, 1144 bp, Homo sapiens
gatttttgtcttcagccgtgcaactatgttggggtcatcttattcctccttttcggcggtggacacaggcaaaaacattttaatacaatggaagtgcatcccctggcagccctgcggcagtcacagcctccttattggcaaggctgaagtcaaagccttgggctgcccagcctgaatgacactggcttcctgggatggttgttgctgtgtcagggacatttctgggtctctgccactgctactggtgctcttggtggagaaggccacagggtgttgctggggaggtggtgagccagaggtttctgggtctgcaccactgctgctgttgctctgggtataggggtaggccacagggtcatgctgggcggcttgttgagcctgggatgtttctgggtctccaccactgctgctggtgctctgggtggagaagaaggccacaggctgatactggaaggcttgttgagccagggacatttctgggactccaccactgctacaggtgctctgggtggaggggaaggccatggggtcatgctgggggccttgttgagccagggaggtttctgggtctgcactactgttgctggtgctctgcgtggagggggaagacacagggtcatgctggaaggcttgttgagccagggacatttctgggtgtatccagttgtgcaggtctcctcctcttgcatactctgttactaaataaataacagggtgatgctcaggggcttgttgagccagggatgtttctgggtcttcaccactgctgctgttgctctgggtggagggggaggccacagggtctttatgtatttaagcataaaggcaaggcttggtgcggtggctcatgcctgtcatcctaacactttgggaggctgaggcgggtggattgcttgatcccaggagttcaagaccagcctgggtaacatggcaaaacctcatctctatagaaaatacagaaattagccagctgcagtgcatgcctgtggtcccatctactcggaaggctgaggtgggaggatcacctgaacctggaaggtcaaggctgcagtgagccaagattgtgtcactgtactctagcctgtgttagagagccagacactatctcaaaataaaataaaataaaataaaataaaaaaagaaa

SEQ ID NO: 7210 - DNA, 1729 bp, Homo sapiens
ttttttttttttttttaagtggcagtactgcagggctgacagaatctgcctgaacatggtccgggcctcctcttcctcctcgatgtggccatagtggtatatctggtggtgcaactctcctcctctggtttactccctcaccacctggaagagctgaatgatatttgggtgatggaaagtcttcaagatggcaacctgggtcccagttggcctatgctgagccagttccctatcagatggtgtctatgaactgatagttttgtatctccttgtcaagtgaggtggagggtgatccctgctccatggtgcctcccaactatactgactacaaatcctgcctctaaaagctatgctgtgatgcacagcactaactgtgctagctaggctaaggccactgtcggtgacaataccccaggctccaaaccctctgggtctgagggccgttcccttccacggttacacagattcccacccctccctgcccatctacccaccatgcggggaaggtgccaaggagtagacacatggacagtcgttctggtgtctcctggtggggccagactgggcaccatggctgcaagcacagacagggcagagaagaggccagggccacgtggtggagctgggtctaaaacaggactcccaagggcaaaggccctgcccagacttggcacccacagtcttctgctgaatgctatgagcccgcttcagtgaaagagggaaggtggaaacttcaatgtagagaggacaagtgggatccccaggaggaagggtctgtggtctgatagtggaccgcttcttctgttttgtttgttccaaaacaaggtaggtggccatgggataactgaataatttttctttgattgccacagataggttctcagcctggaatcccatggccaccaaaagctgggttgttttgggattcaggtggtccaggatttgttcttcatgttgtcagaggcaactcctgaccactgttcacccacgggtccctcataacttcttctagtgtggtctgctccctggggtctactgttaatagttttttaatgaggcttttaagacctcaggaaaagtagactggggaaaaatagcttccactttaaatttttgctgagaggaccctaatgctgcatgagcagaagggcagaaccccagccaccatgtggtataaaattactctgaggctctgaatatccatggtggcacattggtagcactggcctaggatacgtttcagggccatgtaggggttaagtgctacaaagggctgtcagcttctgcccatcatggaatgtggtaccaaagccgaagtctgcgatcttaacgttaccgtcctcatcaaggatgatgttttctgggttcaggtctctgcgcaatttgctatggcactactgcatggccgacagaatctgcctgaacatggtctaggccttctcctccctcatgaggccatggtggtgtattggttgcgtgggtgtcctcctcttgcatactccgttactaaataaataactggtgttgggggtgtcaatcacttgatacaaccgtacaatattgaagtgacagagtaactttaaaatacttatcactctctggagagtgatgccaagggagccagccttggggatgattttgatggccatttgggtcccaatcagcatgtgatcctggacctcactgaacgtgccacggccaatggtgtccaggattttacagttctgga

SEQ ID NO: 7211 - DNA, 696 bp, Homo sapiens
agtgtgcccagtgccacaccgtggaaaagggaggcaagcacaagactaggcctaatctccaaggtctcttcgggcggaagacaggtcaggctgttggattctcttacacagacaccaataagaacaaaggcatcacctggggagaggatacactggtggagtatttggagaatcccaagggtatggaagaaaaatgatctttgccggcattaagaagaaggcagaaagggcaggcttgatagcttatcttaaaaaagctactaatgagtaataattggccactgccttatttattacaaaacaaatgtctcatgactgttttatgtgtaccatactttaatagatctcatacaccagaaatcagatcataaatgacagaatattttgttgggcagttgtgatttaaaactaagactagcttgtggttaaatgttcagtttttgaattttaatagtaattccaattcagaacatggtatcactgtttaccccttctaaaaatatgattagactttgttagtaatgttcaacttctcacaaagatggtgagtgccatcttaaaacttaatagaggccgggcgcagtagctcatgcctgtaatcctagcactttgggaggccgaggcgggtggttcacttgagttcaggagttcgagaccagcctggccaacatggtgaaacccccgtctctactaaaa

SEQ ID NO: 7212 - DNA, 5304 bp, Homo sapiens
ttcccaccgcatcgtccgcctcagccagaaccttctggtccccgcccccggatagggacccaggaggcccaagccccttcttccggcggggagtgggagcctctcgcactctcggcagctccagaccctcgggatctccgtttacagttcaggacctcagctgcactttggcgctaacgccctgtttcccaggtggggaaatcaagagatggggttccttggaatgggaagtggggtgtgaaggggaaacctttttggccaggagaatcaggtgttccatatctgggagctattgagcagcttgagcagactttgtaggttcaagcccttctggagtggttgacagtgacttctgggcggtggggatggggtgaaccatctttaaactttgtgcgaagaggtgcagggacctaggtttagaagcgctctcgtcccatgttggttctgccgaatatttaggctgactcctgacctcaagtgattggcccgccttggcctcccaaagtgctgtgattgcaggcctgagccaccgcgccgcgacctaggctggacatttgacaaagacttttacttctacctctacttcctcttagaagatgtggcaagaaaaggatccggggggcccgggcccggtggctcacgcctgtaatcccagcactttgggaggccgagacgggcggatcacgaggtcaggagatcgagaccatcctggctaacacggtgaaaccctgtctctactgaaaatacaaaaaaattagccgggcgtggtggcaggcgcctgtagtcccagctacgggaggctgaggcaggagaatggcgtgaacccgggaggcggagcttgcagtgagcggagatcgcgccactgcactccagactgagtgacagagcaaggctctgtctcaaaaaaaaaagaaagaaagaaagaaaaggatcctgggattaaatacttttttaaatcccatattctgggattaaaaatatgcttgacagcattcataccctccgcccaccttgccatggtggtgtaccacagtagtccctctcttggatatgtgctctgaaggtcaagatatcaagcaccagaagcctttcacagggtgtttggaatagataactgtcccttgggtgtccctttctcattctaaggcagcccagatatttgaacacttagtactttgcaaagagcctacatagatcatgagaaacatactagttggagaaaatcaacaaatccccctatactaaccattgtcaggagcaggtcttctggtctgaaatgtcaccaacgtttttttcttttttgagacggagtctccctctgtcacccaagctggagttcaatggcttgatcccggctcaccgcagcctccattcaagtgattctcctgcttcggcctcctgagtacccgggattacaggcacccaccaccacgcctggctaatttttgtatttttagtagagacggggtttcaccctgttggccaggctggtcttgaactcctgacctcaagtgatccacccacctcggcctcccaaagtgctgggattacaggtgtgagccactgtgcccggccaacagttctttttttaaaacgaacttttctatctcacaaacggcggtgaaggtgtcaaaattttcacagtatttctggggcaattactggataggatgagatctgctgctatcttctgtgggagaagaaggggcagagaaatacacttggctagaaagaaaagggacctgctatgcccactaacaaaataggtacgtgctaaaaaaaattagcttctgaatttagtaaaacttcttatatactggcaatgttgaaggagaatgatggaaaattctaattttacttgcataaattttcagttagcaatatcctcacagccctttttaatcttcaaaggaaaaagaaaattaaggtcttatggaaccagtaggtcttccatagatggaaaacaaacaaatcagaaaaacaaatttaaaaccacacccacacctagaaaaacaaaaatctttaacagttttttgactggactttggaagtgttttctcccagcctggtgtagctcctctgaggtggtatataaataacccaggggtctgcaagttgctcccttgtgctagaaaatgcagaggcctttggggccaggagatgatctcagtaatgaatagtgaaagctagagttgtttgaaaggaatagcataagaaattctcaaaatagacaatgcaagagggcttatataaatgcagattgctgggtcccacgtggagtttgttcctgttggtctgaggtggggcccaaaaatgtgcatttctgcaagtttccaaatgatgctgaagctgctactacagggttcatacatcgcgaacctcaaaatatatatatatatatatatatatatatatatatatatatatatatataattttttttttttttttttttttagatggagtcttgctctttcacccaggctggagtgcagtggtgcgatcttgactcactgcaacctccgcctcctgggttaaagcaattctcacacctcagcctccccacagagctgggactacaggcatgcgccaccacgcccggctaatttttgtatttttagtagagacagggtttcaccatgttggccaggctgttctggaactctgacctcaagtgatccgcccgcctcagcctcccaaagtgctgggattataggcatgagccactgtgtccagccacaaatatttttaagacatgacttttctgagcttcttctaatctcaagtaataaggtctcatcatgaagtcccagaagcttctgtcacctcagaagataaagactctgtcattagcagctaacaacacagcataggtcctaacagtggacctatattcatttcagacaaatccattgcctcatctataaaatgggttaagacctacttccaaaggcttgtgaaaaagtttaatataaagttttagtacacatagcagttgccagatcaatacttgtaatcattccctacttccctttattagaattactaatatctaggctgggcgaagtgggtcacgcctataatcccagcactttgggaggccgaggcggtggatcacctgaggtcaggagttggagagcagcctggccaacatggcaaaactctgtcactacaaaaaaatacagtgagccaagatcgctccactgcactccagcctgagtgacagagcgagactcttgtctcaaaaaagaaaaaataaaataaaataaaataattactaatatcctaacacctgttggaatctattcatgggaactatagaacaagtttatgtctatagtgagacagagatgggaatttgaaaggccatgctctcatgaaaagcatgtcagggaaattccatgctctgatttccctcctttaggactgtcaatggcaggataccagctctggtcaccatggaccccactggatgagagtttccaatggctgcggcacacgacacctacaccttcctccaagcacccattcaaggcctccccctgcttcccacacacaccgtccgaccttgaagtgcagctgtgctttcaagaggtcactctagtcctagacagcccattcctggaatctggagtgagtcccaagttaccctgccacacatcagagttgcgcacgatgaacaacaaaggactggtcaggaagccccagcccatccgcctcagtggagtagattctgtctttggcagggttatcacagctcagccaccaaagtggaccgggactttcagagtttcagacaagtcagccttttgcaaaatcattagcagggagcaccagtggcccattggactgaaggagcctcagattcagatgacagtcactatgtgcaaacagatgctgcgctctatcctcttgctgtatgcaacttacaaaaagtgcacctttgccttgcagcactccaagtaaagggtcctcatttgatccccatttactcacaccatgccctttggtatgtacctaaagcttacagaaacctgtccatgtaaatgaaactgtgacattgtcccagccatcttgcttttgtttcaagcagtgatgattcaggagcccctttcatcccttcccctccaaaaaaggaccaatgatagagaacaaggaagaacattcccattgtaaggttgaaccatttagagtcaaactagcattgacatgtccatgtgataaccgttaaacaaatgatataaaccaatgagcctagtgtgaactcacataaacacctacaaccacaatgaattggggggaaaaggggtgtagaggagaaagatgtatggatttctatgtaccaggggatgtcaaaaatctatatatataggtcaaggattactttaaaacctcccccgaccaaaacaatgaaaataagaaaaaaaccctaaccaaccacaccctaataccactagagtgtacaaaagtgggtagaaatactgatattaaacaatacttacagcctggcaagaaagaacttggtagcagcactgaagctaggctttctggtaggctacatggaactcatgagtctccattttagctgaaatgtactcctaatgtaattttgtagcatttttttggtttttggagacagggtttcattctgtcatcacggctggactacagtagcatggtcttggctcactgcagcctcaaactcccaggctcaagtgatcctcccgcctcagcctcctgagtagctgggactacaggtgcgggccaccatatctggctaatttttgtattattattattttttgagatggagttttgctcttgttgcccaggctggagtgcagtggcgccatctcggctcaccgcaacctctgcctcccaggttcaagcaattctcctgcctcagcctccctagtagctgggattacaggcatgtgccaccacgcccagctaattttgtgtttttagtacagacagggtttctccaggctggtcgggctggtctcgaactcccgacctcaggtgacctgcccacctcagcctcccaaagtgctgggattataggcatgagccactgcgcccggccattaatttttgtatttttttttttttagtagagatggagtttcaccacattgcccaagctggtcttgaactcctggactcaagcaatgccttggcctcggcctcccaaagtgttgggattacagcggtgacccacaatatctggccttagtagcgttcttgtaactaggttaggtataactcagaaaatggaaataaacattacatatacaaagttaa

SEQ ID NO: 7213 - DNA, 945 bp, Homo sapiens
agtgtgcccagtgccacaccgtggaaaagggaggcaagcacaagactaggcctaatctccaaggtctcttcgggcggaagacaggtcaggctgttggattctcttacacagacaccaataagaacaaaggcatcacctggggagaggatacactggtggagtatttggagaatcccaagggtatggaagaaaaatgatctttgccggcattaagaagaaggcagaaagggcaggcttgatagcttatcttaaaaaagctactaatgagtaataattggccactgccttatttattacaaaacaaatgtctcatgactgttttatgtgtaccatactttaatagatctcatacaccagaaatcagatcataaatgacagaatattttgttgggcagttgtgatttaaaactaagactagcttgtggttaaatgttcagtttttgaattttaatagtaattccaattcagaacatggtatcactgtttaccccttctaaaaatatgattagactttgttagtaatgttcaacttctcacaaagatggtgagtgccatcttaaaacttaatagaggccgggcgcagtagctcatgcctgtaatcctagcactttgggaggccgaggcgggtggttcacttgagttcaggagttcgagaccagcctggccaacatggtgaaacccccgtctctactaaaaatacaaaaattagccaggcgtggtggtgggcacctgtaatcccagctacttgggaggctgagagagaactgcttgaacccggaaggcagaggtgcattgcagtgaaccaagatcgcgccactgcactccagccagaatgactaagcaagactccatctcaaaaaaaaccccaaaaaataaaaacaacaacaacaacaaaaacttaatggagattggttttatatttagatttatttaactggttatgtg

SEQ ID NO: 7214 - DNA, 3503 bp, Homo sapiens
ttgtttttttttttgagacggagtcttgctctgtcatccaggctggagtgcagtggcacaatctcggctcactgcaagctccacctcccaggttcacgccattctcctgcctcagactcctgagtagctgggactacaggcgcccaccaccacacccggctaattttttttttttttttttttttgtatttttagcagagacagggtttcactgtgttagccaggatggtctcgatctcctgacctcgtgatccgcccacctcggccccccaaagtgctgggaatacaggcgtgagccaccatgcccggccgacaaattgatttttgacaagggtgccaaaataatttcagtggtgaaaggaccatcttttcaacaaatggaactggaaaaactggatatccatatgcaaaagaatgaagctaaatccttaaaatacactatacacaaacattaactcaaagtggatcaaagacctaaatttaagaaaataagagaaaaccttcatgaccttggattcggcaatggtatcttaagcataacaaccaaaaggacaagcaacaacaacaaaaaaagtaaagagtgggttgtccggctttggagtggcaaccttcgtggccccagggactaaaaagagaattaaatacaagtgatgttgagaaaagcaagatttttgttcagaagtgtgcccagtgccacaccgtggaaaagggaggcaagcacaagactaggcctaatctccaaggtctcttcgggcggaagacaggtcaggctgttggattctcttacacagacaccaataagaacaaaggcatcacctggggagaggatacactggtggagtatttggagaatcccaagggtatggaagaaaaatgatctttgccggcattaagaagaaggcagaaagggcaggcttgatagcttatcttaaaaaagctactaatgagtaataattggccactgccttatttattacaaaacaaatgtctcatgactgttttatgtgtaccatactttaatagatctcatacaccagaaatcagatcataaatgacagaatattttgttgggcagttgtgatttaaaactaagactagcttgtggttaaatgttcagtttttgaattttaatagtaattccaattcagaacatggtatcactgtttaccccttctaaaaatatgattagactttgttagtaatgttcaacttctcacaaagatggtgagtgccatcttaaaacttaatagaggccgggcgcagtagctcatgcctgtaatcctagcactttgggaggccgaggcgggtggttcacttgagttcaggagttcgagaccagcctggccaacatggtgaaacccccgtctctactaaaaatacaaaaattagccaggcgtggtggtgggcacctgtaatcccagctacttgggaggctgagagagaactgcttgaacccggaaggcagaggtgcattgcagtgaaccaagatcgcgccactgcactccagccagaatgactaagcaagactccatctcaaaaaaaaccccaaaaaataaaaacaacaacaacaacaaaaacttaatggagattggttttatatttagatttatttaactggttatgtgaatatatttaaatactggggaaatttcctcactgtcttagaaccaagcaagattcaactgtgtttggtgttcatttgcctcttaaaggctaggattgaaggaaaataaggtagcaatgtctagtttattatttaacacttctcacattttatacatgatctataaggtcacatgcttttaaaatagtaacaagttaaacttcactcttgaattctttacactctaactcaaactaagttatgattcaggattgtctttaaagaaccattcgaaaacataaaactgctgcgtatttgtgattgggaatggtgcttttgccaacttaaaatgattagaatacacactttaaaactatgtgtgatcatacgactcaaaataattaagaaaatcacagatcaaaaaaataataaaataacataaaaaataaggccagatgtggtggctcatgcctgtaatcacagcactttgggaggctgaggtaggcagatcacgaggtcaagagatcaagaccatcctggccaacatgtgaaaacctgtctctactaaaaatacaaaaattagttgggcgttgtggcacaggcccatagtcccagctacacgggaggctgaggcaggagaattgtctgaacccgcaaggtagagattgcagagagtcgagatcgtaccactgcactccagcctggtgacagagctagactccatctccaaaaaaaaaaaaaaagataaatttgactttatcgaaactaaatacttttgtacatcaaaggacactatcaagggagtgaaaacccatagaatgggagaacatgtttgcaaatcatatgtctgataagggatcaatatccagaatatataaataactcctatacctcaacaatgacaaaaacccaatttaaaaacgggcaaagggctgagcacagtggctcgtgcctgtaacaccagcactttcagaggcagaggtggttagatctcctaagctcaaaagttcgagaccagtctgggtaacatgacgaaaccttatgtctaccaaaattgcaaaaaattagcggggcaccatggtgcgcacctgtggtcccagctactcagaaggctgacatgagaggatcgcttgagcctcggaagtggaggttgcagtgagccaggatcataccactgcactccaacttgtgtgacagagtgagacctcatctctgaaaaacaaaacaaacaaaaatgggtaaaggacttgaatagacatgtctacaaaaatatagaaatggccaagaagtatgtgaaaagatgcttaacatcattagtcattagggaaatgcaaatcaaaccacaatgaggtatcactccgtactcatcaggataattataattaaaaaatagggccaggagaggtggcaggtacctgtagacccaggtactcaagaggctgaggagggaagactgcttgagcccaggagtttcaggctgcagtgaactatgatcacgccactgcactgcagcctgggtgacagagcaagatcctatacataaaaaaaaaaattaaattattaattcattaaaagcaaaattattattattattattattattattattattattattattattattattatttgagacagagtctcgctctgttgccccggctggagtgcagtggcgcaatctcggctcactgcaagctctgcctcccgggttcataccactctcctgcctcagcctcccaagtagctggtactacaggcgcacaccaccacgcctagctaattttttgtatttttagtagagacggggtttcaccatgttagccaggatggtctcaatctcctgacctcgtgatctgcccgcctcggcctcccaaagtcctgggattacaggtgtgag

SEQ ID NO: 7215 - DNA, 1729 bp, Homo sapiens
ttttttttttttttttaagtggcagtactgcagggctgacagaatctgcctgaacatggtccgggcctcctcttcctcctcgatgtggccatagtggtatatctggtggtgcaactctcctcctctggtttactccctcaccacctggaagagctgaatgatatttgggtgatggaaagtcttcaagatggcaacctgggtcccagttggcctatgctgagccagttccctatcagatggtgtctatgaactgatagttttgtatctccttgtcaagtgaggtggagggtgatccctgctccatggtgcctcccaactatactgactacaaatcctgcctctaaaagctatgctgtgatgcacagcactaactgtgctagctaggctaaggccactgtcggtgacaataccccaggctccaaaccctctgggtctgagggccgttcccttccacggttacacagattcccacccctccctgcccatctacccaccatgcggggaaggtgccaaggagtagacacatggacagtcgttctggtgtctcctggtggggccagactgggcaccatggctgcaagcacagacagggcagagaagaggccagggccacgtggtggagctgggtctaaaacaggactcccaagggcaaaggccctgcccagacttggcacccacagtcttctgctgaatgctatgagcccgcttcagtgaaagagggaaggtggaaacttcaatgtagagaggacaagtgggatccccaggaggaagggtctgtggtctgatagtggaccgcttcttctgttttgtttgttccaaaacaaggtaggtggccatgggataactgaataatttttctttgattgccacagataggttctcagcctggaatcccatggccaccaaaagctgggttgttttgggattcaggtggtccaggatttgttcttcatgttgtcagaggcaactcctgaccactgttcacccacgggtccctcataacttcttctagtgtggtctgctccctggggtctactgttaatagttttttaatgaggcttttaagacctcaggaaaagtagactggggaaaaatagcttccactttaaatttttgctgagaggaccctaatgctgcatgagcagaagggcagaaccccagccaccatgtggtataaaattactctgaggctctgaatatccatggtggcacattggtagccctggcctaggaaacgttccagggccatgtaggggttaagtgctacaaagggctgtcagcttctgcccatcatggaatgtggtaccaaagccgaagtctgcgatcttaacgttaccgtcctcatcaaggatgatgttttctgggttcaggtctctgcgcaatttgctatggcactactgcatggccgacagaatctgcctgaacatggtctaggccttctcctccctcatgaggccatggtggtgtattggttgcgtgggtgtcctcctcttgcatactccgttactaaataaataactggtgttgggggtgtcaatcacttgatacaaccgtacaatattgaagtgacagagtaactttaaaatacttatcactctctggagagtgatgccaagggagccagccttggggatgattttgatggccatttgggtcccaatcagcatgtgatcctggacctcactgaacgtgccacggccaatggtgtccaggattttacagttctgga

SEQ ID NO: 7216 - DNA, 130 bp, Homo sapiens
aaaaaaaaaaaaaaaaacaaaaagaaaaaaaaaaaaaaaaaaaaaaaaaaaaaaaaaaaaaagaaaaaataaaaaaaaaaaaataaaaaaaaaaaaaaaaaaacaagaaagacaaaaaaaaataaaaaga

SEQ ID NO: 7217 - DNA, 143 bp, Homo sapiens
aagaaaagaaaaaaaaaaaaaaaaaaaaaaagaaaaaacaaaaaaaaaaaaaaaaaaaaaaaaaaaaaaataaaaaaaaaaaaaaaaaaaaagagaaacaaaaaaaaaaaaatagaaaaaaaaaaaaaaaaacaaaaaaggag

SEQ ID NO: 7218 - DNA, 151 bp, Homo sapiens
aaaaaaaaaaaaaaaaaaaagaaaaaaaaaaaaaaaaaaaaaaaaaaaaaaaaaaaacaaaaaaaacaaaaaaaaaaaaaaaaaaaaaaataaataaaaaaaaaagagaaaaaaataaaaataaagaaataaataaaaaaaaaaaaaaaaa

SEQ ID NO: 7219 - DNA, 151 bp, Homo sapiens
  misc_feature (4)..(4): n equals a,t,g, or c
  misc_feature (45)..(45): n equals a,t,g, or c
  misc_feature (89)..(89): n equals a,t,g, or c
aaanaaaaaaaaaaaaaaaaaaaaaaaaaaaaaaaaaggaaaaanaaagaaaaaaaaaaaaaaaaaaaaaagaaaaaaaaaaaaaaaanaaaaaaaaaaaagaaaaaaaaaaaaaaaaaaaaaaaaagaaaaagggaaaaaaaaaaaaaaa

SEQ ID NO: 7220 - DNA, 118 bp, Homo sapiens
ggattacatactgttgccaactgaaggttggaataaacttgtcagctggtacacattgatggaaggtcaagagccaatagcacgaaaggtactgtttaataataactgactataaata

SEQ ID NO: 7221 - DNA, 126 bp, Homo sapiens
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c
gccaaaaannaaanaaaaanaaaaaaaaaaaaaaaaaaaaaaaaaaaaaaaaaaaaaaaaaaaaaaaaaaaaaaaaaaaaaaaaaaaaaaaaaanaaaaaaaaaaannanaaaaaaanaaaaaaaa

SEQ ID NO: 7222 - DNA, 1786 bp, Homo sapiens
gatggacatttgagttgctgccaccttttggctattgtgaatggtgttgctgtgaactttggcttacaagtatctgagtccctgctttcagttcttttgagtggaatttgctggatcatatggtaattccgtgtttaacttttggaggaactgccaaactgttttctaccgtggctgtaccattttatattcccaccaaccattgatttagtttgacttctgttgtttaaagaagtatatctgaattttacacatactccaaaactgtaattatttgaattaattggagtagaaattaatttgaaataatgaaatgtctgattactggacatcaaaagctgctttgcattaggccatggttctcagaattcacaatcctcctttccattttttcctccctccctcccttcctcctctcgctaccatggtcactctcagcttcacaataagcacgtgtatcttagggcatttgaacttcaaatactacagcacctcacacgtaagaactctgtaacagtagacctctatttccctttcctgtcctatgtgctacttttttgttttgtttttttgagacagggtcttgctttgttgcccaggcaggagggcagtggcgtaatcacagctcactgcagcctcaacctcctgtttaagcgatcctcccacttctacctgccaagtagctaggactacagatgcagaccaccatgcccggctaatttttgtatttgtagagacagggtctctccacggtgccctggctggtcttaaattcctgagtttgtgcgatctgtccacctcggcctccaaaatgctggggttacaggcatgagccactgtgcctggcctttgtatttttgtcatacattttatttcccagtattatagactccagaatatgttgttgttattgttttaaaagtcagttatcttcttagttttctttcagaaaaattaaatggtgagtttttttgtttgtttgtttgtttgttttgcatggcccatgtatttaccattcctggtgctcttccttcttttgtgtggattcagttttccatctagtatcattttcgttctggtaaaagcatgtttgacatttcctgtagtattgctttgctggtgacacattcttcctcagcttttgtctgaaatgcctttatttcaccatcatttttgaaggatgtttttgctgggtatagaattctaggttggtagtttttgttatttttcagcatttttaaggtgacatttggcttgtacatgttgttcttgagaattctgcagttattctttgttccactgtatgtaataatatatgtttttctcctttctctgattttacggtttttctctttgttgctgatattctgaaacttgactatgatgtgtctttgtgtggttttctttgtggtttttttcctgtggaatttattcaacttctgggatctgtaggttatagttttcacaaattggaaatttttgacattacttcttcagacactttttctgtcttcccctccatcattctgggatttgaattacatgtatacagtaactgttgttgtttcataggtgactaactgggtaggggaatgtctggttcccttactatccggtgaagtagcagaaccaccttttgtaggaatcagttatcaggccctttactttcccttgaactctaggctagttccagaacctttggtggactggaaagaggaaatagttatgccacaatttttagtacatgcaaatgtacatgtaatgtttaaaaaaaaaaaacaacaaa

SEQ ID NO: 7223 - DNA, 141 bp, Homo sapiens
cggagcctcactctgtcacccaggctggagtgcagtggtgccatcttggctcactgcaccctccacctccagggttcaagcgattttcctgcctcagcctcccgagtagctgggattacaggcgttcgctaccacacccag

SEQ ID NO: 7224 - DNA, 1413 bp, Homo sapiens
ttctgggaaggggtgtgatgcattaaggagatggtgtctgcatggtgccaccgcaggccatggccagctggatctgtgtcttctgcaccagcccatctggatgcagtgcaacctgtctggtctgctatcctgcgttcccctaactggcaccctcctgggccagccagcagcaggacatagaccaaggccaacctcctccacacccagggcctctgccttctaccctctgtggagtctccattaacttggcattgacagggctgcttgactcaaaacaaccccagccctgccctgaagccatctcgccagtcagtcagagctcaagactctctctttctctggagaagagcaggaaagtaatcccagctaaccctcatgcagccaccactctgtgtcagaatctcttctaggccattgcattgaataagtcatttaatccatataaacctgcaaggagtaggtgatattgttaaccccattttataggcgaggaaactgaggcatggtgaggttaagtgaccagcaaggtggaaatctgaggtttgacccatctcctggtgtggagtccagttctctcagcttcactgatccttcctgatttgtgctgagttagggaccccttgggaagcccccatgggcagggggtgctggtgctagcatttcctgtggattatgggagggggatgtgtggaggacctgtgtctactgttcctctagcctctgggggatttggagaacccactctgcccagagatgtaagtcatctttggatatagatgagacttgttccccctccccctgaatcccagggcacagctctatggaataagctctagctggaacttgtaaagtttggcccagccctccctgggaggctaggaggtggggaagagccaggagactcgaagtggtggtggtagttaatgtctatgtggttagacgttaaccagttactctgtggtgccaggcactgtcctaggcacgctatagttatcattgtctcctttggtgcccccagacagcccagggtcaagacaggtagcctcagtttacagatgcagcagtggaggcttgcacaatgagtaggtggctttgttcaaatcacagacctaggccaggtataaaagcctaagtgtggtgtaattccagcactttgggaggccaaggcggggagattgcttgagtccaggagtttgacaccagcctgggcaacatagtgagaccctgtctctacaaaaaaaaaaaaaaaagaagaagaaaagaaaagaaaaattagcctggcatggtggcatctgcctgtagtcccagctactcaggaggctgaggcaggaagatcacttgagccagggaatgtttgaggctgcaatgagctgtaatcacaccactgcactccagcatgggcgacagagtctc

SEQ ID NO: 7225 - DNA, 1411 bp, Homo sapiens
ttctgggaaggggtgtgatgcattaaggagatggtgtctgcatggtgccaccgcaggccatggccagctggatctgtgtcttctgcaccagcccatctggatgcagtgcaacctgtctggtctgctatcctgcgttcccctaactggcaccctcctgggccagccagcagcaggacatagaccaaggccaacctcctccacacccagggcctctgccttctaccctctgtggagtctccattaacttggcattgacagggctgcttgactcaaaacaaccccagccctgccctgaagccatctcgccagtcagtcagagctcaagactctctctttctctggagaagagcaggaaagtaatcccagctaaccctcatgcagccaccactctgtgtcagaatctcttctaggccattgcattgaataagtcatttaatccatataaacctgcaaggagtaggtgatattgttaaccccattttataggcgaggaaactgaggcatggtgaggttaagtgaccagcaaggtggaaatctgaggtttgacccatctcctggtgtggagtccagttctctcagcttcactgatccttcctgatttgtgctgagttagggaccccttgggaagcccccatgggcagggggtgctggtgctagcatttcctgtggattatgggagggggatgtgtggaggacctgtgtctactgttcctctagcctctgggggatttggagaacccactctgcccagagatgtaagtcatctttggatatagatgagacttgttccccctccccctgaatcccagggcacagctctatggaataagctctagctggaacttgtaaagtttgcccagccctccctgggaggctaggaggtggggaagagccaggagactcgaagtggtggtggtagttaatgtctatgtggttagacgttaaccagttactctgtgtgccaggcactgtcctaggcacgctatagttatcattgtctcctttggtgcccccagacagcccagggtcaagacaggtagcctcagtttacagatgcagcagtggaggcttgcacaatgagtaggtggctttgttcaaatcacagacctaggccaggtataaaagcctaagtgtggtgtaattccagcactttgggaggccaaggcggggagattgcttgagtccaggagtttgacaccagcctgggcaacatagtgagaccctgtctctacaaaaaaaaaaaaaaaagaagaagaaaagaaaagaaaaattagcctggcatggtggcatctgcctgtagtcccagctactcaggaggctgaggcaggaagatcacttgagccagggaatgtttgaggctgcaatgagctgtaatcacaccactgcactccagcatgggcgacagagtctc

SEQ ID NO: 7226 - DNA, 498 bp, Homo sapiens
gctgacccagagttctgaaaggtcaggggagtctggagggtgaggagaagctctgccccggaggtgacatttgaactagtctctgaagcgccagagttctccccaaaggaaggaggtcattcaagaatgaggaaacagggcgcccaggcgatgggctgtggtgtgtcctgggagcagccaatgatcagcagagtagaggcagcgagtgttgacccccatagcaaaaaatgagtgctggggtctggagtcctccctcctccttaaccctcctctgttatcaaagactcaaggttaactcaccttacgtcttctccctacaagtcaggctcagggaggggagcagataccctgcttgaggacccccaggaaaccagttcctctttccttcttgtggagggagtgcctgggctctgggcagggaagacccccacagagggtggagtccagctccaggagaggcagcctgggcagggaggggctgctctcccggctgggcgt

SEQ ID NO: 7227 - DNA, 498 bp, Homo sapiens; identical to SEQ ID NO: 7226

SEQ ID NO: 7228 - DNA, 5088 bp, Homo sapiens
  misc_feature (5)..(304): n equals a,t,g, or c
  misc_feature (3943)..(4892): n equals a,t,g, or c
tattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagatagaatctcactctgttgcccaggctggggtgcagtggtgcgatctcagctccccacaacctctgcctccagggttcaagcaattctcctgcctcagcctcctgagtatctgggattacaggcatgcaccactacgcttggctaatttttgtatttttagtagagacggggtttcaccatgttggccaggctggtcttgaactcctgacctcaggtgattcgcccgccttggcctcccaaagtgctgggattacaggcatgagccaccgtgcctggctgaaagttcattttcaatagcatagtccagaccattttttttctaaatgtgctaccagaatcaaagaaataataacattccattaaaacaaataaaatggcattaaattaaatgttctgcataatttaagagccctgaccaattttagtcttttttttttttttgagacagagtctcactgtgtcgcccaggctggagtgcagtggtacgatcttggctcactgcagcctccacctcctgggttcaagtgattctcctgcctcaacctcccgagcagctgggattacaggcatgtgccaccatacctggctaatttttatatctttagtagagatggggtttcaccatgttggccaggctggtctcaaactcttgacctcaggtgatctgcccgcctcggcctcccaaagtgctggcattacaggcatgagtcactgcgcctggcctagtctattattaacaaataaaaattttaatacataaaaatggatggatattttctagagccttaattaagtaattcactccaaatgtcttttttttttttttttttagctagtaagtggagacactttgaaacatggtgcttaaaaaaaaacacactacctacctggtgggctgtttcatggtgaaataacttattctgtataatttgaatgcaattcagatactatgtagatgttaaaaagctaagttaacataaaatgtacatcatgaaacgtcaccttacttgacggcattaatacattttttccactaaaatacttgtaaccatggccatcagtatgaagaaaaattttaaacacgatgaaaggtggaaacgtttcacctctaaatctgaaataaagataaaaatttagttatttggcatcaggttttgggctcagttgcttttcccccttatacttaagatagttcatatagtttcttgcatacagggtaaaggctatgtcagagcatgtaaagaactggtaatgaaatggatcacataggatgtaagacccacactttggtgtactcacaactattctcatacctgtgtaagactgaatacagaatgggagatgagagctactctcatggcaacttttagccacagagtcatgcctcggtttctttacataacaaatgtaaataagaataacacatttactttgtaattaagttctgagaagttacaagaatttaaaaaatccatatctaagatttcctcatattaactaagtacttcttgaaataaatcagcatagatacattacctgaatctaattttacactgcatagtaggatccttaataagcttagcctctaagggggccactttcttcagtatttcatgtgttacatagaattcctgaaataaaggacagtgctgtaaaaggaaagcagtatcccacccagacacaatttatggactataacagaggcaacgtggtaaagtgaacattatgctggacttggagttctgaaggggtgggtttttgttttggcacctccacttactatctgtgtagccttgagccagttacttaatcattttggcctccaactttggttatctgtcccttttagagatcaaaggcactattatttccctatgacagcacttttcacaatatattataattacttatcaacttgtctgtgcctcctactagactgtaagcttcatgaaggtagggatggtggcttttctctttaccactatattcctagcatctaatacagtgcctggaacacagcagatgcttaagaagtatttgttgaatgaatcactgtaagatgaggatgataatagtaataagttactagcttttaagcaccttttatgtaccatatactactatgttaggtgccttatatacattagctcatttaatccttacatcagcaacactatgagaattttttgtttgttttgagacagagtctcgctccgtcgcccaggctcgagtgcggtggcatgatctcggctcactgcaacctccgcctcccaggttcaagcgattctcctgcctcagcctcccgagtagctgggactacaggcacctgccaccacgcccggctaattttgtattttttcagtagagacggggtttcaccatattggccaggctggcctggaactcctgaccttgtgagccgcacgcctcagcctcccaaagtgctgggattacaggtgtgagccaccactcaggctgcagtgcaatggcatgatctcggctcaccgcaacctccacctcccaggttcaagtgattctcctgctcagcctcctgagtagctggaattacaggcatgcgccaccatgcctggctaattttgtatttttaatagagatggggtttcttcatgttggtcaggctggtctcgagctcccgacttcaggtgatccacccgcctcagcctcccaaagtgctgggattacaggcgtgagccactgcacctggcccattatgagaatattatcacgcctattttacagatgagaaggctgaggctcagggaatttttgtaatttataaaaaggcatacaggtagtgaatggggaagccaggattcatttagttctgtttgactctaaagtcccaactctttcccccaaacaaccccaaccaaccccgttatgcctatgataatcacataaaaatgtacactaaagagcttttaggctgggcactgcggctcacgcctataatcctggcactttgggaggccaaagcgggaggatcacctgaggtcaagagttcgagaccaacctggtcaacatggtgaaaccccatctctactaaaaatacaaaaattagccaggcgtgatggcaggcgcctgtagtccaagctatttgggaggctgaagcaggagaatcgcttgaacccgggaggcagaggttgcagggagccgagatcgtgccactgcactccagcctgggtgacagagcaagactctgctcaaaataaataaataaatagcttttaaaaggacaaagcattattaatttaaggtattaaagtattactataacagataaaaaagaatttccttctgttacaaaagtctaaaaatactatgaaaccagcattataaaattaaatacaagttccatattcaaagacaatggataatagacctgaaatgccaggagtttacctgggtgggttttctctgaagtattcagacggagtcttgctctgtcgcccaggctggagtgcagtggctcaaactcggctcactataacctccacctccccggttcaaggtagctgggattacaggcgcacaccaccatgcccggctaatttttttgtatttttaggagagacggggtattcaccatggtgaccggactggtctcgaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaattagctgggcatggcggcacgcacctgtagtcccagctactagggaggcggaggcaggataatcccttgaacctgggtggtggaggttgcagtgagccaagatcatgcccctgcactccagcctgggcaacagagtgagacttcatctcaaaaaagaaaagaaaaaaaagagtatcactaataata

SEQ ID NO: 7229 - DNA, 1191 bp, Homo sapiens
aaaaaatgtaagctgaaatgatgacgtgttcttttagaaggtttatcatagcaactactataggcagtgattctaagaagatgctattctttttttccattgctttgtctagttttttttttttaaatctgtttttgtgcctttgtaattctagggttattggtatagttctcaccatatcttgaatacagatgctttttcctttggaaataatttctcataaagcacattgcttatagctgcttcccttttcccagagtagtaaaagttgtgatacaagacagtgatatcagctgggcgtggtggcacacgcctgtaatcccagcacgttgggaggccaaggcaggcagatcacttgaggccaggagttcgagaccagcctggccaacatggtgaatccccgtctctactaaaaatacacacaaaaaattagctgggtgtggtggtttgtgcctgtagtcccagctactcgggaggctgaggcacgagaattgcttgaaccagggaggtggaggttgcagtaagctgagattgcaccactacactccagcctgggtgacagaacgagactctgtctcagaaaaaaaaaaaaagagacaatgatatgaaaaggtcttacatgaatgagttttacgcatgattcaatctgtaagtcctataaattatttttgatggatggtatctattttcttcctattagtagtttggggcaaaaataaatttaactgaatgtaaaaatattcagctctatggggagctgagaagaactaaatattttcagacacttgttatgtgcaggttgtttggcatatatttttaaaaatctttataataccattttgaattaaattctatccccatttaacaaatgaggaggtggtttctattcttaagtaactttcccaaaatcactcaattaagtggcaagggtgggatttaaatcgaagcctatactctttcacttgtttccaaagatgccaaactcaaaatgtggctaaacagtaaatcttgagcaaagaaatgatttactaggaagcagcacaatagaacatactggatgtaggaaatgttatatatcttgatctcattggtggtaacacaagtatatacatatgaaaaagttagttttatccttactgttagtactcagtgctcttattattcctcaaaaatgaaaaaaaaagtaaaaaa

SEQ ID NO: 7230 - DNA, 1192 bp, Homo sapiens
aaaaaatgtaagctgaaatgatgacgtgttcttttagaaggtttatcatagcaactactataggcagtgattctaagaagatgctattctttttttccattgcttggtctagtttttttttttaaaactctgttttggtgccttggtaattctagggttattggtatagttctcaccatatcttggatacagatgctttttcctttggaaataatttctcataaagcacattgcttatagctgcttcccttttcccagagtagtaaaagttgtgatacaagacagtgatatcagctgggcgtggtggcacacgcctgtaatcccagcacgttgggaggccaaggcaggcagatcacttgaggccaggagttcgagaccagcctggccaacatggtgaatccccgtctctactaaaaatacacacaaaaaattagctgggtgtggtggtttgtgcctgtagtcccagctactcgggaggctgaggcacgagaattgcttgaaccagggaggtggaggttgcagtaagctgagattgcaccactacactccagcctgggtgacagaacgagactctgtctcagaaaaaaaaaaaaagagacaatgatatgaaaaggtcttacatgaatgagttttacgcatgattcaatctgtaagtcctataaattatttttgatggatggtatctattttcttcctattagtagttttgggcaaaaataaatttaactgaatgtaaaaatattcagctctatggggagctgagaagaactaaatattttcagacacttgttatgtgcaggttgtttggcatatatttttaaaaatctttataataccattttgaattaaattctatccccatttaacaaatgaggaggtggtttctattcttaagtaactttcccaaaatcactcaattaagtggcaagggtgggatttaaatcgaagcctatactctttcacttgtttccaaagatgccaaactcaaaatgtggctaaacagtaaatcttgagcaaagaaatgatttactaggaagcagcacaatagaacatactggatgtaggaaatgttatatatcttgatctcattggtggtaacacaagtatatacatatgaaaaagttagttttatccttactgttagtactcagtgctcttattattcctcaaaaatgaaaaaaaaagtaaaaaa

SEQ ID NO: 7231 - DNA, 228 bp, Homo sapiens
tcgaggtcaggagattgagaccatcctggctaacatggtgaaaccccatctctactaaaaatacaaaaaaaattagccgggcgtggtggcgggagcctgtagtcccagctactcgggaggttgaggcaggagaatggcgtgaacctgggaggcggagcttgtagtgagccaagatcatgccactgcactccagcctgggcgacagagcgagactccgtctcaaaaaaa

SEQ ID NO: 7232 - DNA, 711 bp, Homo sapiens
aggagatgaaactagagatttgtgccaaattgtgaaaggccttgactgccttgcttcttgctaaacagtggaatttatcaacccactgagacaaagtcagttaagatttttgagccttccatatatttagctgcttatatttaatgtcttgtctttaaaaataacacgtatgacttgttgtttgcatgcttttgcatatataacttatttgaagttaggtgcttctactgattgactttgactttttgttcacaaaaatatagggatcttgatttatgactggaccacttaatgtattaatttgcactgtgttatatcctaaacttttaaaactactcatgactaatgtctttcaccaaactgttacctacgaactttctaaagaaatgtgtgacaaaggcgtgattagtttcatttgctctgccatttttagctgtatatgtgataaaacatgttttaatacatctctttttaacttcgattttatttggaatttttgaatgagctgtttgtttgtttttaagcaaagtaattggagtgaactttctttgattcccaggttttcttttttccccttttttctttttttattgcattggtagatgcagggcaagaaatttattactctaaatttgtgactcagaattttaaaactaaattaacttcataaatgcgctcacttttttcttaatgcattacgtctaaccccca

SEQ ID NO: 7233 - DNA, 374 bp, Homo sapiens
cctctctctacaagatggtataaaatttagtattattttaaagaaataatacctagcagcagtaacctggcagcccaaaggctgtatatggcccgtagatgtgtatatttatgtattttgtatcagcatttaaaactaggagattttgtattaaaatacaacatttagatttgttggaaaaatttaaaaagtctgacaaaactgtacctttatagtactcctttataggagtcagaggctggagtcaagtgttaactgtgttggacttgcttttcagtttgacagttcatggtatgccaacacctaggctgtttttcagttgccatttattatcatatgtgctctgctgcttttcttacgatagagaaacatgt

SEQ ID NO: 7234 - DNA, 710 bp, Homo sapiens
aggagatgaaactagagatttgtgccaaattgtgaaaggccttgactgccttgcttcttgctaaacagtggaatttatcaacccactgagacaaagtcagttaagatttttgagccttccatatatttagctgcttatatttaatgtcttgtctttaaaaataacacgtatgacttgttgtttgcatgcttttgcatatatacttatttgaagttaggtgcttctactgattgactttgactttttgttcacaaaaatatagggatcttgatttatgactggaccacttaatgtattaatttgcactgtgttatatcctaaacttttaaaactactcatgactaatgtctttcaccaaactgttacctacgaactttctaaagaaatgtgtgacaaaggcgtgattagtttcatttgctctgccatttttagctgtatatgtgataaaacatgttttaatacatctctttttaacttcgattttatttggaatttttgaatgagctgtttgtttgtttttaagcaaagtaattggagtgaactttctttgattcccaggttttcttttttccccttttttctttttttattgcattggtagatgcagggcaagaaatttattactctaaatttgtgactcagaattttaaaactaaattaacttcataaatgcgctcacttttttcttaatgcattacgtctaaccccca

SEQ ID NO: 7235 - DNA, 1646 bp, Homo sapiens
taaaaaaagaaaatacagtaagtagccacataaaccgcttctagctgggtccactggtccccctgcttcttgtttattaacggaatctgttcaggggctctagggctcagagctttaggggagtctgagcccttctccagccctggggtgatgggtcttgattgatccaggtcaaattctccacagatttaattctggccaatgaatatgagaagaaatgagaaggtggaaaggtgtcttagtctactttttgctgctataataaaaataccaatacatggggtaaattataatgaagagaaatttatctcatggagttctggaggctggggagtcccaaaatcaaggtgttggcatctggtgaggagcttcttgctgtccaccccatggtggagggtggaagggcagaaagagagagagggctggaggccaataggtggctgaactcatttttttatgaggaacccactcccataataacagcattaatccactcatgagagcagagcccccatgacccaaccatttcccattaggtcctacctccccacacccactgcactggggatcaagtttccaacacatggaactttgggagacacattcacgacatagcagaggaccactggagaaaggaaggtttttaaagattttttttaggacactatggaagtgatagccattggacatggatggtgtttttgtttttggcatgggaaaaggcttatacaactctggtcaacttggcaacactaatcaaaagtcaaaatctcctttgaccctagggatcccctactattaacagtattatatcttatagaacctaggtatttaggaaagaaaaaaatgttcaaagatgtattgacatttaataaaagcaaataactggacataacccagctatccaaatacaggctatcaggaaacactgtgaaggactttgaaataggtcttgcccactgcccccacccctgcctccaattactgagtgttctgtctaatctagcccacctttctgagttgattccctttcatttcactgcctttgagctactttacaattacgtaaattaagggaaactgataatgcagatgattcttgttcatagaaatgcaaattgtgaccaatggaatataactgattattgttctgcaggtatcagccaattttgccagttttgtaactacgaagcaaactcatttcagcattcctgctaggcttataattatttgttctttggattctcctttgagccaattaaagtgtcctactggttctctcaataattaacaagttaaatacaatcatctttaacatgttacttttatatttgtatgagtcataattttaacttctaaaaaaattatcctttaacaaggtagttaagtaaatttaatgttcatgtggtataatttacttagcagccctcttaaaacagttataaaaaccatatggcaacagggacaaatactcctgataaaaatggcaagtggggaaaaaagcagaaatgcaaaatttgtactacgttgtgattaaagctaaacgttgtaagtgcttagggcaagaaataggaaggagaaaaaaaattgaagttggatttgtttgttagggtggtaggatcctggattaaaaaaaaaaaacaaaa

SEQ ID NO: 7236 - DNA, 510 bp, Homo sapiens
gaggttcctcttcaaagactttcctccctgtctaattaagaataaatagtaacttctcttaggagcaaaacttattcaaagacctgtgctaacattcttaaatatctgctagccgtaataaagaaatcaatgtactttatgttcttagctcccacaatttagcctatttgccctggcaatgcttatactggtccaagcaagcattaggtcatagcctgttcctcttccttatctgaaggtgtttttacgtttctcagcattccacaagttacttcctccttcattctcctctgcctttgcctcttttaaaaagttctaagttgctagccaatcaggacaaatacagaatgtgaggtcccgttccagccaatggaaactggacacagcagtaaagtggacttgtcaagttataaatgaccctgtctcctttgttcggtgttctctcgtggcaaaactgctggcgagtgtaccctttctgcagaaagtataaaaatgaccttgctgaagaaa

SEQ ID NO: 7237 - DNA, 1972 bp, Homo sapiens
tcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaa

SEQ ID NO: 7238 - DNA, 105 bp, Homo sapiens
ttttttgtatttttagtaaagacggggtttcaccatgttagccaggctggtcttgatctcctgtcctcgtgatcctcccgccttggcctcccaaagtgctgggat

SEQ ID NO: 7239 - DNA, 949 bp, Homo sapiens
gtcatgtttaagtggggataatgacattggcatacctgcttgctagagttaatgtgtgggtcatgagataacgaatataacaaatatttggaaaagtactatgttgaaatattttaaaataaaatttaaatccctcttcatttagaaaggatttgaggcagctaaatgcagaggtgtaagatggttttttggttaggattgtttctgagctgtgactctgtagtcactttcttactcagccctgccactcagctgtattcctctgtagctctgggcagacgactctgaacacggcttcatattggccttccatgagtgggtgaagggcatagtcatctggcagttttacctgctgttctatgcatgtctctccagcgcttgcttattttccccttctgcaaacattccattcatgccatgggcattcagtacagtcctgtaagcaagggtaggggcggcacaccaggtggatttaagcgcaaagacaggacgactgctttgccacaggcgcctttacagccagcagtgaacagttagacatattcaccttcctctaggtggaaaacagtcctcttctcagtagccctctcatgttcttgagacccatttgatataaataacaatgttgcaggaaatttcctgaaggaactgaaatgaaccatagaaacgagatcattcttttcctaccacacagctgggattagactgcttagtttgtacttgcagcacttttgcagtatgggccgtattaaaaaaaaaaaacatttaacactcagctatgggtacaaagatagtcactgaaacattattatttacttttatttatatatttatttttgagatggagtctcgctctgtcgccaggctggagtgcagtggcgcaatctcggctcactgcaacctcagcctcccaggttcaagtgattctcctacctcagcctcccgagta

SEQ ID NO: 7240 - DNA, 1359 bp, Homo sapiens
aattttggtttttgttttgttttgttttttgagatggggtctcgctctgtcgcccaggctggagtgcagtggcgcaatctcggctcactgcaagctccgcctcctgggttcatgccattctcctgcctcagcctccagagtagctgggactacaggcacccaccaccacacccggctaattttttgtatttttagtagaggcggggtttcaccgtgttaaccaggatggtctcgatctcctgacctcgtgatctgcccgcctcggcctcccaaagtgttgggattacaggcgtgagccactgcgcccagccaattttggtatttttagtagagatggggtttcaccatgttgaccaggatggtctcgatctcttgacctcatggtccgcctgcctcggcgtcccaaagtgctgggattacaggcatgggccactgcacctggctgcattattattattattattttattttgagttagggtcttgctctgttgtccaggctggagcacaggggtgcagtcatagctcactgcaggctcgaacctccaaagttcaagtggtctttctgccccagcctcttgagtagctggaactacaggtgcacaccacctggctaattttttattttttgtctagaggcagggtcaccctatgttgccaaggctgatcttaactcctgggctcaagcaatcctcctgccttttcctcccaaagttctgggattacagacatgagcaactgcttctggcctgaagcattaagagcaaaaagaaagtggtaatcaccatgtactgatatggatatagtaccaagatatgttattaagtgaataatgcatgttacaaaacagtgtgcataatatgatgcattttgataaataaatttatgtatatatgcacatattgttttctctggtaggaaagaaaagcataaacagggtttctctttgatggatggagtggggtagtgaggggagaagttcttatttttccatttaatactactccttggtgtttgaattttacagctgtatacagtattaagttttttttttttttttgagacggagtctcgctctgtcacccaggctggagtgcagtggcacgatctcggctcactgcaagctctgcctcccgggttcacaccattctcctgcctcagcctcccgagtagctgggactacaggcgtccgccaccatgcccggctaattttttgtatttttagtagagacagggtttcaccgtgttagccaggatggtctcaatctcctgacctcatgatccgcccccctcggcctcccaaagtgttaggattacaggcgtgagccaccgtgcccggccagtatgaagtatttttaaa

SEQ ID NO: 7241 - DNA, 294 bp, Homo sapiens
tcttggcctcccaaagtgttaggattacaggtgtgagctaccactcctgaccccaagacaatatcttaactgtaaaaattaaactctaccatattttaaaaagctgagatagtataaatgtttataataaaacataaaaccaacatttctcacaagtctttgtaactagtagagactgtagttgttctgtccagatataagtgtggtatatcaacttggcacttagcaacattgatatttaatttgttaaatttttgttaggaagaggtgttttcagatctcaggtgtctttgg

SEQ ID NO: 7242 - DNA, 12710 bp, Homo sapiens
cttgccactttgctgtctacagctccaatcacatccttcaccaggctcaaggactgtgctagatcttcctgctccacttcattgtcttggaaggaaagaataattctgttttttatggctctttttggacaagggcagaagcaagggaatcctgacttctcactccatatcatcttttccctttgtgactatgctatcagagggaagccaacacgtcagagatcatgtgcctatccttcttgctgtcataagtttgattctaaaaaaagtcagaagttttcaatgatataaataatatgcaatcatatgttgtgctctgaaataaaaggaactaaagacttctaggagggacagtaatagcaggaagagcaaccaagtttttttttttttatttgttttacttaatttttaatgtactgccttgtaatctttaaaataactacctaggaacagaattagccaagagagagaaaccagtaattactgattaagtgaaaaacagcagcaattctagcacttctgggaataactagtggaaattatctcccagcctagtgataacagaatactgttcaggtcattgaactctggatggaatcaatgtgttccctttccttcttgctatcatctatcctaagtctggtaacataacagtccaaattttcattcaacaaaattcaagataaaacacaaggtctcttttagacatactaaagcatgaaatagcacttccatggggcttccagtactactggccacagaggaaacagtccatgaccatacaagaccgagttagaaaggagacttacctttggtacactgcaatattctttggaataaaactgggtacttggtaatccgctgagttacaagcaatatgcactctggaattccaagccttctaacaactgaactgctcatcttcttctgcaagggagtaaacagactgtgaggaatcacatgaaaaaggctctagtgaaagccgacagggacacatggctctcaacaataacggggattttcatgtttcttatcaatacctttacaaaggcttgaaaacgcttatccttggcataaaggtctttgaagtagtttacagactggttatgttgcccacaaaacttgccatatgtcttctttaaacgttctgcattctcacctgaaaactgcagagaaaagagaacagaagttatgccatggggcgccaaactcataataccattttgtaaaatgtttccagtctagttgtaaaagtcaagagcgcttcctcataaattctcccaaaagaatgaaatggtgcagcagctttggaaagcagtctggcagttactcaagaggttcaactttaaatgggtagactatatggcatatggattaaatctcaataaagctgttatacagatttgaaaaacaacaaaaaattaaagaaactttatgtactgtgcacacggaaaatgcaaaatgtattctaacttctatttgtcataaacagagtaataaaacaatgagattcactaggagtttttcatgagacaatcttaaatatctgaccttgataagttagacagacatgacaaacagccatcatacctaggtatctgtttgtactacttacttcaggccagcagtcctaataattctatgaggcccttaaatcattcccaaatgtgtgcaatctcaatgattcctctaaaggtatgttcactttgcactaaatcaatgaatttctgtatgcagttcataaaatacatgctaattattgatttccatgtactacaaacctccagaggcaacacaaattgatccttaccaaaaaactggaaagaaggatcagggtagattttcacttcaccatttaccaatggaggagctgagacagagggacggtaagttatctgctcatatgacaaagcaaatgccccaaaggttgatcctaccactggcacacagaacgagcaaacggatactatgagttaaactgtgaattctagcaccaaagatcttactaggggttgtacacaagtacaaggaggtacaaatggtaatacaagtcaaagtttgatgaagtactaagttagagaaagtaaaagttagatgaaaccagagaggaggggcagagagagagaaatggaaatgcccaaggggatgtttcaggaggaaaagtcatcacttgtaggtcttaattttgagctctatctgttgcagctatctgtgttcatttaccgcactgcatttgcatttatttcataacatgcttacttttactcctaggagttccctgaggcagaggcctaagccatatccccctttgtagttctacctggcatttaatagatgctcagtaaatacctgaaaaatgaatgagtgaatgtgctaataaattaatgaagtgaggggtatgggctcaagaacacaaaggaaagacaaaatttacaattctcagacaaatgttccaacaattaagcctctgcttctacacagcagcagatatttgcccaaaatctttggggaatttgcatctttggggaatctgcatctttggggaaatacctagtcagatgtacatgttatatacccctctgcctgtaaaggttatactggcaatgtgtttttcaagaagaatattttaaaaagaaacattaaaatctgtctatgacaatcacatctacaagtaccaaagtaattttagctgaattttttggagtatgactaaaaccataccacaccttgatgaaagtatcaacaatacatattttattaagcattttacagatagtcacttattcaactttctgtgcttcagctggtttttagacacatgagatccttctgatttgaggcagaggggaaagttgaagatttccaacacacacacacacacacacacacacacacagagtttgtttttaaatgttgagctggggtctctcactctctcgcccaggctggagtacagtggcacgagcatcaccatggctcgctgcaactttgaactcctaggctcaagtgatcctcccacctcgggctcctgagtggttgggaccacaagtgtgcactaccacacctggctcattttttcacttttttttgtagagacagctcttggtacgttgccaggctagtcttgaacacctggcttcaagcaatccatccgcctcagcctcccgaactgttgggattacaggtgtgagccagtgtgcccagccccaaatatttaaataattttcaatttttttttttttgagacagagtatcactctgtctcccaggctggagtgcagtggcatgagctcggctcactgcaacttctgcctcccaggttcaagcgattcttatatctcagtctcccatatgccaccacgcctggctaatttttgtatttttagtagagacagggttttatcatgttggccaggctggtcttgaactcctgacctcaagtgatccgccctcctcatctcccaaagtgctgggattacaggcatgagccactgtgcctggccatattaattgatttcttaaactatactgtttctgatgatggcacagactctgaggaagaaaaactaagttttactgagcatctatcatatgcattaggtactttatatataccctccctttaactttccaaaataacattaggagagaaaccctactgtctgcattttacagaaaaggaaatcaaggctccagagaaattaaataagttccctgagcttacacagataataaatggtagaaagaagatgtgaatgcatggctgtggaaccccatgacttccctttttcccagtgtatgtaagaacctgagatccttcccattctcacctgatttacaagcacatcccctatcctcttgatgagaaagttcttttcacttttatccaccagagactccttcttccgctccagaatcctctggaagaattggctatggatactgatcagctcatccaaacaggggaacagcttttctaccatctgctgctcaaaaagcagatccgccatcatcccctggctgtacacaccactcatgatcttgagagtgcggacatgatgaaactctgtctgcatcaactctaaaaggaggaaaaagatcaagtgtcaggaacactcttttataagcattcgccctcagagatcatctgctgcagtcgcaaagctagtttagagcccaatttgaaccttaaaattgggtcaacagctatctttcccctaaaagtgttctcgttttttgttttttgtttttttttaagacaggttctgctctgtcacccaggctgaagtgcaggctgaagtcatggctcattgcagcctcaacctcctgggctcaagcgatctttctgctttagcctctcgagcagctggggctgcaggtacatgccatcacgcctggctgatttttgtattttttatagaaatggggtttcactatgttcccaggctagtcttgaactctgggctcgagtgatccacccgcctcagcctcccagagtgctgggattacaggtatgagccgctgagcctggtcaagtgttttcgtcttattcctctatttttcacgtgtcctattttctgataataggtaccccggattccatcagtcttaaattatgacttccaaagaggtcttcactggattcagcacctgtcgtaactgactgtatacccagttctcagaaatgacttgtgtttagtctagtttttagtgtaggtaaggaaaaaaactgagatatctctttctaggactgctgtataaataagtactcacatataagtacaatgttcagtagaactgaaaacagaagagtggggcaaaaaggagataggataccaacaggaccacgtctctgtaccttaaagtttttaaaggaaatcttttcaagaagccacatactaaaaaactgatttttcatagtccaacaaattactgcttaaaaatgctggacaatggaaatcaaatataatcagagcaaaatgaagactctcaccatatattacttcttgccgtttgaccacatctttcttttgctgttttagaaacttgctgtctattatccgactccaagactctgcttccagctgtttggactcaatctcaaagtctcccagtagttgtccttcattcatgtctgtacctactcctcaatatatcaaaaaatcaatatcagaatcaggtttgtgacctgtaaaataagcctatgttggactttcctcaagatgatagttgatttcataagacacatgaatacaggggatattcacagagatcatattctagtaccagaaaaaaatcaatatcctgttcaggagtgacagactctacattcgagacttaggttaacagtaataaacatgacataaatcaaacatgattaagacatgacttctatctacacgaagttaagaattggaagggacctggtaccttttcatatttaagagagcaggcttacaattgctctgtgagctagaactgtacatgtaaaaaagtctaagggaaggaaaagatttgtactaaagagtaggcccacatcgaaataatggacatccttcacttgacagctgctggatgagtctgattacgcagtcatgacaaagcactggacactttactgacaatttagagaatcttcacgggatacagaagaggcaggtactgtcactccattaagacttatgttctaggtaatgacacacacacagtccctacagaggcataaaataaaggccataacttcctcttaccctcatcagtaagtgattctgttgactcattgaccttgctgattttatttagtgagtctgttgaatgagacaggaatttccaggtgtttgacatgttctcatcattgccaactctggggacaaaagaaaaatacatactgtcaaatacattctgataacctatggcttgcattcttaaatgagtacctgaagactctagaatgacaactggctggaagtactacagtgactgaagacaaattgcttatgtcggggccacagcaacatgcacatggcctggtaacaaagtcgggagcatttagtatcactggagactcaaattctgaggactttttgagcctttttaaagaaagtgataagaagcaaggggaactttcttccatcaaaccatgtacacattatataagaaactttctgtttaaaacttattgcctaaccaatacactgttttttctgttctctagataactacagatctagcacttacaatcaactatgttctctttggactttctcaatcccaactcaccagctagcacagcaggcacccaattgatgtgtgagtagacacaatagcaagaacactttaaagaccaacttttgaaagttacaatgcatacaaactttagtaatgttacaacttttgaaaagtacacttttggaaataatgagaatacaaagacaaaacaaaacaaaacaaaacaaaaatacctgaaactttttagaggaggagaaaacattagccagcacagaggttaggaattacaaacaaaaggagacttttgcatcctttagttaggaattttgctccaagataggttaaagagatactctgagtcctacatttgaaatggcttattcacccgacgggaaggcaggcatcttacccaaaatagtcagcaacatcattatcagccccctgctaaccacttgacagccaaggcctggccaggagaccagaaaagaaactcagtgcaaacgagtgagtgagaacctaatagtaataattggctcagcactcacctccatgaaactgacttaagtgttaaaaggcaaagatgtaaaacagaggtaagaagaaacaaaacaaccaggtttacttgaacaacagaaaagcatgacatctgtaagtggttgcaacccaaaattctgaattaaatcaccctttttcctattcctacttattttgatctaaaaaatcatctttttagaactcagattcttcaaaagtagggctgatgatatacaaaaagcctacagcaaccagcctgctaagggtatttaaaggagatccttgcgacagaatgaccatcatgacatgcatcagaaacataatccccatcgtccttgtctgcaccaacccatgaccttatagatttatttcttaaaaaaaaaaaaaagctttttgtcatatgatgtgattattatgctctggtcacctagatgccaactgtgctatctttaaatatctccacttacccagtaatgttctgtatggagacacttttggagagcgagacactctgctgggatcgtctattggcaaatattggggtggtagcggtttcatccaccaggaggactgcggaccgaggacgctccttgggctgtgaggctgcaaaaggaggacactaactgaagcatcacccatccagctccacctggtactgacccatctgacaaataacaagcagaagtaaggcgctttacagtggatttgccctggaactgtaagtttatataaaaactccatggaggagaggacactaactgaagcatcacccatccagctccacctggtactgacccatctgacaaataacaagcagaagtaaggcgctttacagtggatttgccctggaactgtaagtttgtataaaaactccatggaggatagtttggtgataactattgaaattgtaaatgcctatattcttcgatccagcaatttcacttttaggctatgtttattttacaagatatacctgcatattcgtgaaatgatgttatgtccaaagttattcaatgcaacaccattggtaaaagcaaaagactgaaaatgacatgagtatcacaagaagactggtgaataagttatactacaccacacagcagaatacaatgccacttacaaaaaataaggacactttccaagtactgacacagatagatctatctccaagatctattaaggggaggaaaatcaaagtgcagaacaaagtatataacaggctatctttcatgcttaaaagagagaaaaataatccaagttgtatttactttaacaagcgaactccaggaaaataaacaaaaaaaactaagaagagtggttacctctggggtgggacaggcaacggggataaagaatcctgtgggagtattacatattttaatatttaagctgcaaataagattgaaagaatttcttttttttttgaaatgcagtcttgttctgtcgcccaggctggagtgcagtggcgcgatcttggctcactgcaagctccgcctcctgggttcatgccattctcctgccgcagcctcccgagtagctgggattacaggcacccgccaccatgcctggctaatttttgtatttttaatagagacggggtttcactacgttggccagactggtctcaaactcctgacctcatgatctgcccgcctcggcctcccaaagtgctgggattacaggcgtgagccactgcacctggccccaagattgaaagaattttaagggtaaaaggaacctgagagataactgggagcagcgttctttaggaccgttcaccatgaagacatctggagtgcctgttagatatggaatctcagccccccttgtcttctaggggtggaacccaagagtctacatatcttacaggctcaagtgattcttctgcgctccctgctagcgagcatagattttgatgatttcctttaatttacagatgaggaaaatttaacacttgtttaacacctgtaactacagatgacccctgaacaacatgggtttgaactacatagatccccttatatgtggaatttcttctgcctctgccacccttgagacagcaagaccaacccttcttttcttcctcttccttcttggtctactcaatgtgaaaacgacaaggatgaagacctttatgatgatctacttccacttaacaaacagtaaatatattttctcttccttatgatttttaaaataacattttttcctttggcttaatttattgtaagaatacagtatataatacacataacaaacaaaatgcattaattgactgtttatgttattggtaaggcttctggtcaacagtaggctattagtaggtaagttctgggggagtcaaaaagttttatgtggatttttgactgcatgggggtggggctggcacacctatcatccgagttattcaagggtcaattctaaattgttctcatagtgcatatttctcattaacatgactaaagaggaaactggagatctaatttgctaaagtggtcacgctggcacttgggaacatttttccctggtaatggacttgctgtcccattcacaggttgcattatctgtccatccccaggagtgtcaagaggtgaaggaaataagactggggtggtagttatgacttcacagtatttcaggatgtctttgactcaatgagcattaatataatcattaatttccaattcaaattctatttacaagatgatgacacaataaaatagcagaaacccgacattctaaaacctgaccagattctagctgcagaaagtacacaaggattatgggatgtggccctacccctctgcccccacccccacccccacccaagagaaaaagagcaagtgggtagaaaagagaatgagcttaagagttaaagggcctggagcataacctgaatgtttctgaagggaggtcactgagcggataaaatctgatggaggaagaaaacactagttcttgaagaattgcaaggatgtggatgggtcagaagaaaaaagagaggacaattctgatgagaagaaccatggaatgaaggcagaagtaattatgtagtattaatgtaaaagggagacacagagtagaagatgaagcaggtagaaggaatcagtgaaagggctggaaaagcagaatgatgttaggcagagctcataataacttgtatctaaaagccagcataggggggaagaaaataacagctttccttatttgtaaccaatccatattctacccaagtaagtgactcaatattgctgtttccttatttgtgatgatcatagcagtgaaagctaacacttaaggaatgtttactgctaagtactttataggtatgatctgatttaaacctgactaccaccctatgatactattatcgtccccttttacagaggaagaaaatgaggcacagagaggtttggtaatgtccagttacacagctcttaagcagtggtgtcagacttgaatccatacaattagaattcacaatctgtactctacaccactatgttgcctcagtggagtacaacaggaataagaatatttgtgggagggccaggtacagtggttcacgcctataatcccagcactttgggaggccaagacagacagatgccttgaggtcaaaaattcgacaccagcctagccaacatggtgaaaccctatctctagtaaaaatacaaaaattagctgggtgtggtggctcacacctgtaatcccagctacttgggaggctgaggcaggagaactgcttgaacccagaaggcggatgttgcagtgagtggagattgtgccactgcactccagcctgggtgacagagtaagactcttgtctcaaggaaaaaaaaaaaaatacttgtggggatcaaaggtaatactcatgaaccttgcacataataggcatttgtttttaagaaagacatgaaaataagaaagaaaacagacttctgaaacaacagataatgtcacaagaaaaaaagcattttaggaagctagacataaaaagtatgtggaatgggtaagatcacagactaaaagtgggtatcaacctggagaagctcctcttctagtcatctacgtgtgaagatggataaaaaccagattaaatatatctaaagggaatcactctcttctgggagtgtagactagtatagccattcaggagctatctggaagtactcagagaaactgggcataaaggagcggttttcaagcttgagtgggcatcagaatcacctggaggatctattaaaacacagaccaggctgggtgcggtggctcatgcctgttatctcagcactttgggaggccaaggcatgaggactgcttgaggccaggagtttgagacgagcctgggcaacgtagtgagaccccgtctctacaaaaaaattaaaaaatcagccaggcatagcggcgcacacctggagtgccagcaactcaggaatctgaggtgaggggatttcttgagcccaggagtttgaggttacagtgagctatgatcacaccactgcactccagcctgggtgacaaagcaagaccctgtctctattaaacacactcccacacaccacaaaaaaacacagaatgctggtcccatcccacggtttgtgattcacagatcagggtggggcccaagaatctttacttctaaaaaactacattttcaagaacactgcctgggaaaagtctcacagaggctcccatggagccagctaagaagatattaatcattgcattatttatggtagtagctggaagcaaagtaaatattctgtctctaggggaactttaaatgtgaaatatgcttatgaaagaataccatgccatagtctgaaacaatagcgtacaataacatgcatatctcaaaacaatattgagtgaaaaaaataagcagaacatataagcataagtcatattatctaatttaaattcacacaaaataatacatttttttcaaagtatacatatgtctaaaaatatggcagattagaaggacatacattaaatatactaaagtaggaatgagacagggaatggggagtgaaaagggaaaagtatcagtaaaaccaaagtggagtcttctatgcactggtgaaaatggtttgatgtgaatggaagagtgtgatttactcaattctgaataacatttgaggtccttagaaataataaaaaaaaagaactattttctataacttctcagtttagaaagaagtttaggccgggcatggtggtgcgtgcctgtaatcccagctattggggaggctgaggcaggagaatcgcttgaaccagggaggtggaggttgcagtgagccgagattgtgctattgtactccagcctgggcgacagagagagactccgtctcaaaaaaataataaaaaaaaaaaagtttaacaagccagatctcatttgatttgtatgattgtaaggcactaaaaacaagtcttttaattctcaactactattaaagaggaagttgagatgcgcaggggtcacttgcttaaacacacagggcaaaggtgctgcctttaagctaatacacagactgttttagagaccttccaagagggtttgatggtataatgttatatgggtaaaggaatctgcaggataaaacagcagccttctctcacttaccacaaaataggtattcatatcttgactatgaataataactgaatattacaacagcatttttacattcagaaccagaaagtcagaaagggaattgagaggtgggctgagctacttacgcttgtttctcataatgaccgtgggcagtgatgatgtgtcatgtgcctgaaggctccctttgggctgctaaagagaaagaaagtaagtccattgacaattcacctctgacaagccctgagaagccgagtaggaagggagcaagcagttcagcttcctttcccactctgctttttgcactgccctaagcaccctgtgtcccagc

SEQ ID NO: 7243 - DNA, 8243 bp, Homo sapiens
cgagtgatccacccgcctcagcctcccagagtgctgggattacaggtatgagccgctgagcctggtcaagtgttttcatcttattcctctatttttcacgtgtcctattttctgataataggtaccccggattccatcagtcttaaattatgacttccaaagaggtcttcactggattcagcacctgtcgtaactgactgtatacccagttctcagaaatgacttgtgtttagtctagtttttagtgtaggtaaggaacaaaactgagatatctctttctaggactgctgtataaataagtactcacatataagtacaatgttcagtagaactgaaaacagaagagtggggcaaaaaggagataggataccaacaggaccacgtctctgtaccttaaagtttttaaaggaaatcttttcaagaagccacatactaaaaaactgatttttcatagtccaacaaattactgcttaaaaatgctggacaatggaaatcaaatataatcagagcaaaatgaagactctcaccatatattacttcttgccgtttgaccacatctttcttttgctgttttagaaacttgctgtctattatccgactccaagactctgttccagctgtttggactcaatctcaaagtctcccagtagttgtccttcattcatgtctgtacctactcctcaatatatcaaaaaatcaatatcagaatcaggtttgtgacctgtaaaataagcctatgttggactttcctcaagatgatagttgattttataagacacatgaatacaggggatattcacagagatcatattctagtaccagaaaaaaatcaatatcctgttcaggagtgacagactctacattcgagacttaggttaacagtaataaacatgacataaatcaaacatgattaagacatgacttctatctacacgaagttaagaattggaagggacctggtaccttttcatatttaagagagcaggcttacaattgctctgtgagctagaactgtacatgtaaaaaagtctaagggaaggaaaagatttgtactaaagagtaggcccacatcgaaataaatgacatccttcacttgacagctgctggatgagtctgattacgcagtcatgacaaagcactggacactttactgacaatttagagaatcttcacgggatacagaagaggcaggtactgtcactccattaagacttatgttctaggtaatgacacacacacagtccctacagaggcataaaataaaggccataacttcctcttaccctcatcagtaagtgattctgttgactcattgaccttgctgattttatttagtgagtctgttgaatgagacaggaatttccaggtgtttgacatgttctcatcattgccaactctggggacaaaagaaaaatacatactgtcaaatacattctgataacctatggcttgcattcttaaatgagtacctgaagactctagaatgacaactggctggaagtactacagtgactgaagacaaattgcttatgtcggggccacagcaacatgcacatggcctggtaacaaagtcgggagcatttagtatcactggagactcaaattctgaggactttttgagcctttttaaagaaagtgataagaagcaaggggaactttcttccatcaaaccatgtacacattatataagaaactttctgtttaaaacttattgcctaaccaatacactgttttttctgttctctagataactacagatctagcacttacaatcaactatgttctctttggactttctcaatcccaactcaccagctagcacagcaggcacccaattgatgtgtgagtagacacaatagcaagaacactttaaagaccaacttttgaaagttacaatgcatacaaactttagtaatgttacaacttttgaaaagtacacttttggaaataatgagaatacaaagacaaaacaaaacaaaacaaaacaaaaatacctgaaactttttagaggaggagaaaacattagccagcacagaggttaggaattacaaacaaaaggagacttttgcatcctttagttaggaattttgctccaagataggttaaagagatactctgagtcctacatttgaaatggcttattcacccgacgggaaggcaggcatcttacccaaaatagtcagcaacatcattatcagccccctgctaaccacttgacagccaaggcctggccaggagaccagaaaagaaactcagtgcaaacgagtgagtgagaacctaatagtaataattggctcagcactcacctccatgaaactgacttaagtgttaaaaggcaaagatgtaaaacagaggtaagaagaaacaaaacaaccaggtttacttgaacaacagaaaagcatgacatctgtaagtggttgcaacccaaaattctgaattaaatcaccctttttcctattcctacttattttgatctaaaaaatcatctttttagaactcagattcttcaaaagtagggctgatgatatacaaaaagcctacagcaaccagcctgctaagggtatttaaaggagatccttgcgacagaatgaccatcatgacatgcatcagaaacataatccccatcgtccttgtctgcaccaacccatgaccttatagatttatttcttaaaaaaaaaaaaaagctttttgtcatatgatgtgattattatgctctggtcacctagatgccaactgtgctatctttaaatatctccacttacccagtaatgttctgtatggagacacttttggagagcgagacactctgctgggatcgtctattggcaaatattggggtggtagcggtttcatccaccaggaggactgcggaccgaggacgctccttgggctgtgaggctgcaaaaggaggacactaactgaagcatcacccatccagctccacctggtactgacccatctgacaaataacaagcagaagtaaggcgctttacagtggatttgccctggaactgtaagtttatataaaaactccatggaggagaggacactaactgaagcatcacccatccagctccacctggtactgacccatctgacaaataacaagcagaagtaaggcgctttacagtggatttgccctggaactgtaagtttgtataaaaactccatggaggatagtttggtgataactattgaaattgtaaatgcctatattcttcgatccagcaatttcacttttaggctatgtttattttacaagatatacctgcatattcgtgaaatgatgttatgtccaaagttattcaatgcaacaccattggtaaaagcaaaagactgaaaatgacatgagtatcacaagaagactggtgaataagttatactacaccacacagcagaatacaatgccacttacaaaaaataaggacactttccaagtactgacacagatagatctatctccaagatctattaaggggaggaaaatcaaagtgcagaacaaagtatataacaggctatctttcatgcttaaaagaaagaaaaataatccaagttgtatttactttaacaagcgaactccaggaaaataaacaaaaaaaactaagaagagtggttacctctggggtgggataggcaacggggataaagaatcctgtgggagtattacatattttaatatttaagctgcaaataagattgaaagaatttcttttttttttgaaatgcagtcttgttctgtcgcccaggctggagtgcagtggcgcgatcttggctcactgcaagctccgcctcctgggttcatgccattctcctgccgcagcctcccgagtagctgggattacaggcacccgccaccatgcctggctaatttttgtatttttaatagagacggggtttcactacgttggccagactggtctcaaactcctgacctcatgatctgcccgcctcggcctcccaaagtgctgggattacaggtgtgagccactgcacctggccccaagattgaaagaattttaagggtaaaaggaacctgagagataactgggagcagcgttctttaggaccgttcaccatgaagacatctggagtgcctgttagatatggaatctcagccccccttgtcttctaggggtggaacccaagagtctacatatcttacaggctcaagtgattcttctgcgctccctgctagcgagcatagattttgatgatttcctttaatttacagatgaggaaaatttaacacttgtttaacacctgtaactacagatgacccttgaacaacatgggtttgaactacatagatccccttatatgtggaatttcttctgcctctgccacccttgagacagcaagaccaacccttcttttcttcctcttccttcttggtctactcaatgtgaaaacgacaaggatgaagacctttatgatgatctacttccacttaacaaacagtaaatatattttctcttccttatgatttttaaaataacattttttcctttggcttaatttattgtaagaatacagtatataatacacataacaaacaaaatgcattaattgactgtttatgttattggtaaggcttctggtcaacagtaggctattagtaggtaagttctgggggagtcaaaaagttttatgtggatttttgactgcatgggggtggggctggcacacctatcatccgagttattcaagggtcaattctaatttgttctcatagtgcatatttctcattaacatgactaaagaggaaactggagatctaatttgctaaagtggtcacgctggcacttgggaacatttttccctggtaatggacttgctgtcccattcacaggttgcattatctgtccatccccaggagtgtcaagaggtgaaggaaataagactggggtggtagttatgacttcacagtatttcaggatgtctttgactcaatgagcattaatataatcattaatttccaattcaaattctatttacaagatgatgacacaataaaatagcagaaacccgacattctaaaacctgaccagattctagctgcagaaagtacacaaggattatgggatgtggccctacccctctgcccccacccccacccccacccaagagaaaaagagcaagtgggtagaaaagagaatgagcttaagagttaaagggcctggagcataacctgaatgtttctgaagggaggtcactgagcggataaaatctgatggaggaagaaaacactagttcttgaagaattgcaaggatgtggatgggtcagaagaaaaaagagaggacaattctgatgagaagaaccatggaatgaaggcagaagtaattatgtagtattaatgtaaaagggagacacagagtagaagatgaagcaggtagaaggaatcagtgaaagggctggaaaagcagaatgatgttaggcagagctcataataacttgtatctaaaagccagcataggggggaagaaaataacagctttccttatttgtaaccaatccatattctacccaagtaagtgactcaatattgctgtttccttatttgtgatgatcatagcagtgaaagctaacacttaaggaatgtttactgctaagtactttataggtatgatctgatttaaacctgactaccaccctatgatactattatcgtccccttttacagaggaagaaaatgaggcacagagaggtttggtaatgtccagttacacagctcttaagcagtggtgtcagacttgaatccatacaattagaattcacaatctgtactctacaccactatgttgcctcagtggagtacaacaggaataagaatatttgtgggagggccaggtacagtggttcacgcctataatcccagcactttgggaggccaagacagacagatgccttgaggtcaaaaattcgacaccagcctagccaacatggtgaaaccctatctctagtaaaaatacaaaaattagctgggtgtggtggctcacacctgtaatcccagctacttgggaggctgaggcaggagaactgcttgaacccagaaggcggatgttgcagtgagtggagattgtgccactgcactccagcctgggtgacagagtaagactcttgtctcaaggaaaaaaaaaaaaatacttgtggggatcaaaggtaatactcatgaaccttgcacataataggcatttgtttttaagaaagacatgaaaataagaaagaaaacagacttctgaaacaacagataatgtcacaagaaaaaaagcattttaggaagctagacataaaaagtatgtggaatgggtaagatcacagactaaaagtgggtatcaacctggagaagctcctcttctagtcatctacgtgtgaagatggataaaaaccagattaaatatatctaaagggaatcactctcttctgggagtgtagactagtatagccattcaggagctatctggaagtactcagagaaactgggcataaaggagcggttttcaagcttgagtgggcatcagaatcacctggaggatctattaaaacacagaccaggctgggtgcggtggctcatgcctgttatctcagcactttgggaggccaaggcatgaggactgcttgaggccaggagtttgagacgagcctgggcaacgtagtgagaccccgtctctacaaaaaaattaaaaaatcagccaggcatagcggcgcacacctggagtgccagcaactcaggaatctgaggtgaggggatttcttgagcccaggagtttgaggttacagtgagctatgatcacaccactgcactccagcctgggtgacaaagcaagaccctgtctctattaaacacactcccacacaccacaaaaaaacacagaatgctggtcccatcccacggtttgtgattcacagatcagggtggggcccaagaatctttacttctaaaaaactacattttcaagaacactgcctggggaaagtctcacagaggctcccatggagccagctaagaagatattaatcattgcattatttatggtagtagctggaagcaaagtaaatattctgtctctaggggaactttaaatgtgaaatatgcttatgaaagaataccatgccatagtctgaaacaatagcgtacaataacatgcatatctcaaaacaatattgagtgaaaaaaataagcagaacatataagcataagtcatattatctaatttaaattcacacaaaataatacatttttttcaaagtatacatatgtctaaaaatatggcagattagaaggacatacattaaatatactaaagtaggaatgagacagggaatggggagtgaaaagggaaaagtatcagtaaaaccaaagtggagtcttctatgcactggtgaaaatggtttgatgtgaatggaagagtgtgatttactcaattctgaataacatttgaggtccttagaaataataaaaaaaaagaactattttctataacttctcagtttagaaagaagtttaggccgggcatggtggtgcgtgcctgtaatcccagctattggggaggctgaggcaggagaatcgcttgaaccagggaggtggaggttgcagtgagccgagattgtgctattgtactccagcctgggcgacagagagagactccgtctcaaaaaaataataaaaaaaaaaaagtttaacaagccagatctcatttgatttgtatgattgtaaggcactaaaaacaagtcttttaattctcaactactattaaagaggaagttgagatgcgcaggggtcacttgcttaaacacacagggcaaaggtgctgcctttaagctaatacacagactgttttagagaccttccaagagggtttgatggtataatgttatatgggtaaaggaatctgcaggataaaacagcagccttctctcacttaccacaaaataggtattcatatcttgactatgaataataactgaatattacaacagcatttttacattcagaaccagaaagtcagaaagggaattgagaggtgggctgagctacttacgcttgtttctcataatgaccgtgggcagtgatgatgtgtcatgtgcctgaaggctccctttgggctgctaaagagaaagaaagtaagtccattgacaattcacctctgacaagccctgagaagccgagtaggaagggagcaagcagttcagcttcctttcccactctgctttttgcactgccctaagcaccctgtgtcccagc

SEQ ID NO: 7244 - DNA, 184 bp, Homo sapiens
ttttctcaccttcagaagcatggcattcttcccctttaagacgatttaagggttgcctccttggtaaagccatctatagcttctctcctctcctcacccaaggcagtgactggcacctttctcatttatagtaactgtccgtcttccccagtagattgctggtgccttaagggcagcatctttt

SEQ ID NO: 7245 - DNA, 184 bp, Homo sapiens; identical to SEQ ID NO: 7244

SEQ ID NO: 7246 - DNA, 2853 bp, Homo sapiens
agtctgtgtcttttaacgggggcatttagcctgtttacatttaaggttaatattgttatgtgtgagtttgatcctgtcattatgatgctagctggttattttgcccgttagttgatgcagattcttcataatgtcaatggcctttacaatttggtatgtttttgcagtggctggtactgctttttcctttttgtatttagtgcttccttcagaagatcttgtaaggcaggactggtggtgacaaaatctttcagcatttgcttttctgtgaaggattttatttctccttcacttatgaagcttagtttggctggctctgaaattctgggttgaaaattcttttctttaagaatgttgtgccaggcaccgtggctcatgtgtgtaatcccagcactttgggaggctgaggctggcagatcacctgaggtcaggagttcaagaccagcctgaccaacatgggaaaactccatctctactaaaaatacaaaattagccagctgtggtggcacatgcctgtaatcccaactacttgggaggctgaggcaggagaatcgcttgaacccaggaggtcaggttgcggtgagccgagatcttgccatcatactccagcctgggcaacaagagtgaaactccatctcacacaaaaaaaagaatgttgaatattggcccgcactctcttctggcttgtagtgtttccgcagagaaatccactgttagtctgatgggcttccctttgtggataacccgacctttctctctggctgcccttaacgtttttttcattcctttcaaccttggtgaatctgatgattacgtgtcttggggctgctcttctcgagaagtatctttgtggtggtctctgtctttcctgaacttgaatgttggtctgtcttgctaggttggggaagttctcctggataatatcctgaagagtgttttccaacttggttccattctccccatcattttcaggtacaccagtcaaacataggtttggtcttctcacatagtcccatatttcttggaggctttgttcattccttttcattcatttttctctaatcttgtcttcatgctttatttcattaagttgatcttcaatctctgatatccttttttccacttgatcgatttggctattgatacttgtgtatgcttcacaaagttcttgtgctgtgtttttcagctccatcaggtcattgatgattttctctagactggttattctagttagcaattcttctaaccttctttcaaggttcttagtttccttgcagtgggttagaatgtgctcctttagctcggaggagttacccaccttccgaagcctacttctgtcaattcgtcaaactcattttccatccagttttgtttccttgctggcgaggagttatgatcccttggaggagaagaggtgttctggtttttggaattttcagccttcttgtgctggtttttcctcatctccctggatttatctgcctttggtctttgatgttggtgacctttggatggggtttttgtgtggacatcgtttttgttgatgttgatgctattcctttctgttttttagtttttctcctaacaggcaggcttctctcctgcaggcctgctggagtttgctggaggtccactccagaccctgtttgcctgagtatcactagcagacactgcagaacagcaaagattgctgcctgctccttcctctggaagtttcgtcccagaggggcacccgccagatgctagtggagctctcctgtatgaggtgtctgttgacccctgctgggaggtgtctcccagtcaggaggcacaggggtcagggacccacttgaggaggcagtctgtcccttagcagagtttgagtgctgtgctgggagattcgctgctctcttcagagctggcaggcaggaacatttacgtctgctgaagctgcacccacagccgcctcttccgccaggtcctctgtcccagagaggtgggagttttatctgttagcccctgactggggctgctgcctttctttcagagatgccctgtccagagaggaggaatctagagaggcagtctggctatggcagctttgcagagctgtggtgggctctgcccaattcgaacttcccagaagctttgtttatactgtgaggggaaaaccacctactcaagcctcagtaatggtggacgcttctccccacaccaagcttgagagtcccaggtcgacttcagactgctgtgctggcagcaagaatttcaagccagtggattttagcttgctgggctctgtggcggtgggatccactgatccacttggctccctggcttcagttccctttccaggagagtgaacagttctgtcgctggccttccaggtgtcactggggtatggaaaaaaaaaaaaaaaaaaaaaaaaccttctgcagctagcttggtgtctgcctaaatggctgccctgttttgcgcttgaaacccagggccctggtagtgtcagcactcgagggaatctcctggtctgtgggttgtaaagaccatgggaaaagcatagtatctgggttggaatgcaccattcctcattgcacagtccctcatggcttccctttggtgggggaggttgttttctcaccccttgagcttaccgtgtgaggtgatgcaccccccctgctttggctcgtgctctgtgggctgcacccactgtctaacctgtaccaaagagatgagccaggtaccttagttggaaatgcagaaatcacccactttctgcattgatctcactgggagctgcagacctgagctgttcctgttaggccatcttgccagccactcatattttacttttaagtgattaggttgtttgggaga

SEQ ID NO: 7247 - DNA, 2853 bp, Homo sapiens; identical to SEQ ID NO: 7246

SEQ ID NO: 7248 - DNA, 421 bp, Homo sapiens
tgaggagtgttttacttccaattctgtggtcaattttagaataagtgtgatgtggtgctgagaagaatgtatattctgttgatttggggtggagagttctgtagatgtctattaggtctgctttgtccagagctgagttcaagtcctgaatatccttgttaattttctgtctcgttgatctgtctaatattgacagtggggtgttaaagtctcctactattaattgggtgggagtctaagtctctttgtaggtctctaagaacttgcttatgaattgggtgcttctgtatagggtgcctatatatttagggtagttagctcttcttgttgcattgaaccttttaccattatgtaatgcccttctttgtcttttttgatcttggttggtttaaagtctgttttatcagaggctaggattgca

SEQ ID NO: 7249 - DNA, 340 bp, Homo sapiens
aatttcttgtgtatatgcatcttttacatataaaggctgttttaaaaatgagttgctgctttatagtttcttctttagaaacatataagattaaagataaaagaaatagaatagggaaatagcctagctatagaaacagcacttttaaatttcatatgtacagtgatttattatttgcaaatcatctactttttaaaagtatgatactttattatttgcaaattatttaatttttaaaagtgatttttgtgggaggtcagagttggatggagaagggtcattttcatttttgattagaggattcttgtaatgacctgatgaaaactgctctgagggcatc

SEQ ID NO: 7250 - DNA, 340 bp, Homo sapiens; identical to SEQ ID NO: 7249

SEQ ID NO: 7251 - DNA, 421 bp, Homo sapiens; identical to SEQ ID NO: 7248

SEQ ID NO: 7252 - DNA, 2853 bp, Homo sapiens; identical to SEQ ID NO: 7246

SEQ ID NO: 7253 - DNA, 2853 bp, Homo sapiens; identical to SEQ ID NO: 7246

SEQ ID NO: 7254 - DNA, 421 bp, Homo sapiens; identical to SEQ ID NO: 7248

SEQ ID NO: 7255 - DNA, 340 bp, Homo sapiens; identical to SEQ ID NO: 7249

SEQ ID NO: 7256 - DNA, 340 bp, Homo sapiens; identical to SEQ ID NO: 7249

SEQ ID NO: 7257 - DNA, 421 bp, Homo sapiens; identical to SEQ ID NO: 7248

SEQ ID NO: 7258 - DNA, 4400 bp, Homo sapiens
gggaccccaggcttcctttgagacatccaccagcggtgatgggttgggaccaatctcccccactcctctccaccctagcagtaaggtccccgctctcgatactgccccagcacctgcactggccctctctgatttcccaactccagcccattccaagtgctgaaggcgggtcgctaggtgctgggacctgggcgcggggcaagaccttgggctgtgtggggtgcaggctggtttactgggttcacgattgagggagtggtctgggggttaggtgtagggccaggctgcgttgtgctctaaggggcaggcggcaggcggtttgggggggctgtggtcagacagggtggggtggcggtgggtttggggaagccgcagcagcccgccttggggtcccgcgagtgccgagggagctgccggggcatggtggcgcggggcccgtggtcctgcccggcacgacccccgccccgcagcgccccgcagcgccccgcccccgcggccccgctcgcgacgcgtctcccgcggcgccccgcccccgcccgcagtgcccggatgcgggtgacgcgcggccgccatctttccgtcccgggcagccagcgccagtcggagccagcgcgagccgccgccgccatcactgccgctgccaagtcctccacccgctgcccccgccatgtgagtcggccgcccgccaccctcaccgcgcttccctgcgccggccgccgcccttggcaaccggccgtcgggagtgcccggggtctctcctgcgttccccgcgccccggggccaggcccaagccggtgactgcgcgcgggcggccgaggagccccgcgtcccgggctggccggctcgggcgatggccgcgggaaggagcggacccagtgtcctcctgcccctccccgcccctgtcaccgcggccgcctgtcttttcgggtcgacccggatcgcatctgtgaggtcgccctcagttgacaggcggggaaactgaggccgggggggcctcgctcaaggtcacgcagctcatcggcggcagggctggaccgagaccagggcttacatcgggtggccttcctcccgaaaaggaggactggagggacgaggatggacaggtggatgggcggagccctggctgcggggccgggaggctgcaggccctgggtcttaatccgtccctgctcctcaggtctgctaccgctgccacggccccccctgctgccccggctggggagggtggtccccctgcaccccctccaaacctcaccagtaacaggagactgcagcagacccaggcccaggtggatgaggtgagtgtggggggagtcaaaagcagtaggagggaccctgggggttggcgtataggtgtaggggcccatgttggtttgggagtgatgacagttcacgcctgtgggtttgcggacaaagataccatgccccatccctgtctccctgtcagcacgcacttggaagggcgctgggggtgttaatcagctttgctagcctggggtgtgccagcctgggcaggtgtgctctggtgatggacagagcgcctgaggttccatagagggagggtgttgctatgacatctgagatgtcaccagcatgcccctgatgtgtgctccttgcatgtccccaggtgtgctaggcatgttctgtgtgtccttggcatgttaacctggcagtatcagggtgcatgttccatgtgtggcacggtgggcacatgtttgaggattgccctcactgaggtgggccttggcacacccccctgcctcgtgggcccttctcccaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaaggtaagggtggggacaggaaggaggacaggtgggtgaatggggtatcatagtttgtcttactgatcctcgcctctcacccccagatgatgatcatcttgggagtgatttgcgccatcatcctcatcatcatcataggtgagtagggtgagaatggccggggccctttccctggagaggtttccccagtggattctaggttttgaaggtcattaatctagtttttactcttcagccaaaaacacatatagctgctaatggcaattctgattcatctagagccaaaaactttgatgttatttagcctgcattttgcctagttcttggcagtcttgttaacatttggaaataggaaagctggtgtatccattgaggaccctttaggcctaagagcccagtctgagaaccctggaattgaggagtgggagaaaggaaaggaccaggggcttgagacatgaccaggaagccaaccaccccattatttgagagcttgcggtctcagaggctcagaggattagggtctgtggcttcaaggccataccatggagcggaagggacctcagaacctacctgtctagccccttgctttgtagatggaaaaactgagtccaagagagggtgtcagccagctggggagtggggaggattggagcagggccaggcctgacacactgctttcttgttctctctctttctctcccctctccctcttcctcatcttcttcccctctctccacagtttacttcagcacttaaatccccgaggagtctgccctgcctagagaagggcctctcccccaaccctcagccgttcctccacctctcagccatatctttcagcccccactcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaacaacagcacctgtccaggcttccttaggtacatcttctttgtatccattgggaggctctgagactggccccacttggtcctaagaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagctggtatgtaagtgtcttgaagttcagtatgttatgatggaccaataattctgccacttcgggtttctccctacattcctgctccccagttttcatgtggggtactcaactgacattcccatggggtttccctcccatctgcctgatccacctcctcctcccaccaggagagttgggggttggccacaattgatctcttgtgagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttccccccacacttctggttttctgtgtggagggggagcagggatatctaagctgtggtgtgaaagggtaggagagatgctggaggtgggggtgctgtgttttagaccccccatattatcccagtgtcccctgcccccctcttcccccaccccatgcccccaattctgtggcgcatccagattgtgaaaatgtacaataaatgtgtaatgagtaaccagg

SEQ ID NO: 7259 - DNA, 463 bp, Homo sapiens
gtctaagatcttttttatttttctattttttttttttggttgggggagaataagatcttttcttaaccaatgggaataatattggatcggaaggtataccaggaaggttgagaagatacattggtaatggactggactttgcaagaggccctgaccttgggcagggcaaagtgtgattctcaaagtggccacaggggggcactaggagttggtaatgggaagtgtcatagccagcccgtgtctctaagcccggtgcgccctgtggtctagggttcccagctttcgtttccctttactggggcatgttcctgctgttggactcctttctactcctcgatttaacttctagacgctctgccgtggctcccgtgcagcagtagatgaagtagttggccatttctgtgaagcatgtcttcccctctgtgcctaacccagtgccagcgcccagatggggttagtaaat

SEQ ID NO: 7260 - DNA, 359 bp, Homo sapiens
ccgggactgtcagtgcacaaggaccagggacgcggctgctcctctgagggggaggaagccaagagtatcttctcttagattgggctgagttcccacacccagcacacacattccctgctcactcacctcccacagacagctgggaaatgacacctctggtgacagagccactctccgggcttctgtggggagcgggtggggcactgcagtgggggaggatctcacacccggaggccctgggaagccagggtgggggagggaggaagctggttcctgtttgtcttagagatcaaggccatcagcctccctgcaccttccagggatgtagtaagcacccccaccccagggccaaagggcct

SEQ ID NO: 7261 - DNA, 16146 bp, Homo sapiens
gtgtggcgtcacttccggcttccttcagtccgctggtcccgagcacgagctgtgaggggattcacttgtgtgcggaactcctcggaaccatggtgagcctgactcccctgcctattgccctacccctgctccgccgtgctcttgccaccccactgcttcctctgtcctgctagggacgtaggctccgtttttgtctccccggccctccgcacatggtgcgagccatgcgcggggcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgtacgtaactgtcaatctcgctggtgtataatttatactcccgggggccttgtaaatccgaaaagccatgtcgctctcctacaagtccctctctcccacttaaatgctttctccgatgatggaagcttcatttgattgaaaacattgttgtaaatgagttttctcttagatgtccacttgtaagactagtggaaggcacctcagtgtatgtgttagagtattggtacttaaacggaatgcctcttggttttccttttcaggcgtccctttcccttgcacctgttaacatctttaaggcaggagctgatgaagagagagcagagacagctcgtctggtaagccttgttctaagcattgttttaaagataaaactggaggccaggcgcggtggcttactcctgtaatcccagtactttgggaggccgaggtaggcggatgaactgaggtcaggagttcgagaccagcctggccaacatggtaaaaccccgtttctactagaaatacaaaaattagccgggcgtggtgatgggcacctgtaatcccagctactcgggaggctgaggcaggaggatcgcttgaacccaggaggcggaggttgcagtgagctgagatcgcgccattgcactccagcctgggcgacagagcgacactctgcctcaaaaaaaaaaaaaagtaaataaagataaaactgtacttgaagactgtaaagttgattctgataatctccttggtttttactccagacttcttttattggtgccatcgccattggagacttggtaaagagcaccttgggacccaaaggcatggtaagaaaaatagaaaagttttatattttaatattgttttagagcgcttggtggaaatataataacaagcgtattaaaatgctttttaatctttaaaacgtttaattataaaagacaagtatgttctccttagtaaaaatcagagtccccagaatcaccatccccaatcccatgcccctccccaatgacaagtactgttatcatttgcacgtacatcttctaatattctgtttatgtagaagtatgtgtacttcattatgtattttatactcatgtaacatactgttttataaaacagatactatttatcaatacttttttgtagcttgctcttttaaattcctttcagtgtaagtagataacactgcccctttaactgtcaaatattatcctgtaccttaattattttataatttaattatggctgtattgatagtttctttccattgtttttgcagttacggtgttgaaacaaaaactagtgtctacctgtgcttctagtgtttctaggggtagatacatggtttggttacgtggtgtatgtattgaaaacatttgatgaatggataccacaaaatagctatccagagtgtttatacactagcactgtgtgagaatactgattgatccatgcattcttcaagatgtgcttatgtcttaacttgaaccaattatgttccctttaggacaaaattcttctaagcagtggacgagatgcctctcttatggtaaccaatgatggtgccactattctaaaaaacattggtgttgacaatccagcagctaaagttttagttggtaagtctgaatatactttttcaccaacctaataatactgtttgttaacatttttgaaataactttataaataggctgtgttgaccaatcgtactgtcaattgatgtccactagttgttaattatcgttgttaaaatacaagcttcaggagtgcccgtatgttggtggtaaaactgttgcatttcagacctcagagttccaaataatttgttgaatgaggaaccctggtaagtttagattggtagtgaatatttttggagaatttagtaagcaaagaagcaattttgagttaataactaatttctttttctagatatgtcaagggttcaagatgatgaagttggtgatggcactacctctgttaccgttttagcagcagaattattaagggtaagagcaactaagcaactcttttttcctactgtgtttttgagtatcagaggtaatctagtccttacttcctctgtctttactattgaggagtgcttaataattttctatttataacttttgttttataactttattaataggaagcagaatctttaattgcaaaaaagattcatccacagaccatcatagcgggttggagagaagccacgaaggctgcaagagaggcgctgttgagttctgcagttgatcatgggtttgtatagcaaagtactactgttctaaacatttagtgttctttcataacatgcttaatgcaagaaatctataggacactgaaaagcatacacaaagatcatcttgctgcctcaccccactccaacagtcaaacctacatcagcctccagagatagccactaaagttaagtttgggtttttagtctttttgtatatatcatcaaaatatacaaataaagcaaatagtataatactgtatagagaatttgttagcctctttttaacctagttaaatattaagcacatttttggatgtcaattttctgtgcagtattttaatagagttacacatttgaatatttggctagaatgactgtattaacctatctgtagggggagatttgtgtatttgatgatttttagcattataaaataactttgtgacgttgcgacatagcccaaaggtttctagaagtgtaattgttgggtccaaaggtaagtgtgtgtgttttaaggcacccccaaacctgggctgcacagcaggtgagcagcaggtggaaaaattgtcttcccatgaaaccagtccctggtgccaaaaaggtccgggaccactgttttaaggcacttctatttatttgcccattcacaactgtataataatacttgtttttcacgtccttttatttatttatttattttgagacggagtctcgctcttagagttgcccagaatggagtgcagtggcacgacttcggctgactgcaacctctgcctcccgggttcaagcgattctcttgcctcagcctcccaagtagcagggactacaggcatgtgccatcatagccagctaattttgtatttttagtgtagatggggtttcaccatgttgctcaggctggtcttgaactgacctcaagtgatccatcctcctcagtctcccaaagtgctaggattacaggcgtgagccactgtgcccggccatttctcacattcttgccaacattagacttttgcatgcttgtgtggcccccacccctcttttttttttggcattttgccagtttggtggggaaaataacatctttaatttgtgtttcttgattactgctgaggtttaattcttttcatatagcttacagacttgatcagttagggtaaaattatctattgacatgaatatctagataaattttgaaaagtaaagtagggttaatatgtatatttggttggttttatttagttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggtatgtatgaatgtcagatacaagaagctttgattagatgctgagggctgaatactgagtgaattctgttttgagaccagtgaccctttacaaagccagtgaacttgaatttaaggacatatcatatgtgcaaccatttttgtcattttattgacagtgtactcctcttcccgcgctattccagcattgttgatgatctctagagtttacttaactaccatgaagttatttgcagtctctgataaagaggaaatgttttcttttactagaaatcatctattctcaaatggtacttttaccaggattatatgtattctccaggaagggtctgggtcagtcaaatcattgtgttagctggttgttgaggatgtacagttgaccattgaacaacatgggtttgaattatgtaggttcacaatgcaggttttttcaataaatatagtcagccctttgtgtccgtggtttgcacatgtgcaaccgaacgtggatggaaaatgcagtatttgcaggatttgaaacccatgtatatagtgggccagcttttcaaatctgctggttccagtcagcctggaacttaagtatgtggggattttggtgtatgtgggcgtcttggaaccagtccccttcgtatactgggggatgactagttttttttagaaaagaattaaaaaaaatttctttaacaaataattatgtatgtttatagggcaagaggatctagttcttaaagagtgataaatgagacataataagtactgctttcttagtagtacatttttgtttagagtgaagttttccagatcatcttcacattatatttacttcacaaaatggcctgtcaaaaagtataggcattcttatatagagaaggaaaaaaaaagaattagatggtgctttacaacttctgtttttaccagtggtttggagtcctggttttgttctgtgtcataggtcttgatttattttaagagagagtcataattctgaaaatactcttgattaagtttatatacaagagctgtgtagcatttctttttttttttttttgagacggagtctggctgtgtcacccaggctggagtgcagcagtatgatctcgcctcactgcaaccactgcctcctgagttaaggcgattctcctgcctcagcctcctgagtaggtgggattacaggcgtgtgccaccatgcctggctaacttttttgtatttttagtagagacggggtatcgccatgttgaccaggctggtctcgaactcctgacctaaggggatccacctgcctcagcctcccaaagtactgggattacaggcgtgagccaccatgcctggccgctgcgtagcatttctgataggggctggtggtagggaaggagcattaaaacaagaatattagtagcacaagcagcaccattcttgaatgtctgctctgtactaggaattgtaataggaactttagtcatttagtcatcatgacctggtgagtgaggattaggttcacttgaatagagtagaaaacccaagataatggtggcttcataatggaaaagtttctaatgtaaccaaaaaaaggcctagaaaggtaggtggtactgggtttgtatgatggttccaaagcagcaggactaggctggtaactagcacctctgctactggttacattcctgttttacaaattagcatttctggttggataatttgtcgaaggttatatagccagcagcaggggcatgatcagggtcagatttatctgactccacggtgtccatggtttttccatttttaccaccagcctcaatacctgaatcttcaatttttctcttgtggtggtgattttaagctaataaaaatataggacttaacctattgtctttatattgcaacccatacagatgtgggtgtagcgtatatctgaaacaaaagtttcaaaatactgtttaattttattgtctgtactgtgctcttatattttctgtttcatattttttaagtaacccattaaattgattttgtaataactcttctagtgggatgctttataccagaagtgtccaaggaagagaatacagtcatgggttcctagtttctgtttctggttgggtcggtaaagccccttcctcctccctcttttctgcttatcactagagacagaaactaaaatccatggctttcaggcgctaaaagcctaaaagcaaaacaacaacagaataaggcaggttggacaagcttgcttttatgccttctaagagcttggtaaattggacttaaatagcttctttgaaacagtgatatgataaagcagacagctttttataagatttactaaggctgctttgaagtattaaatatgatactgttcttatatttattgtaggcttcctgttggataaaaaaattggagtaaatcaaccaaaacgaattgaaaatgctaaaattcttattgcaaatactggtatggatacagacaaaataaaggtatgtaactctactttttaaaaattaaaattactgcccaggcagagtggctcatgcctgtaatcctagcaatttgggaggccaaggtggtggatcatctgagatcagaagtttgagaccagcctgaccaacatggagaaaccctgtctctactaaaaaaaaaaaaatacaaaattagctgggcatggtggcgcatgcctgtaatcccagctattcgggaggctgaggcaggagaatcacttgaacccaggaggcggaggttgcactgagccgagattgtgctactgcactcgagcctgggcaacaagagtgaaactccgtctcaaaagtctcaaaaaaaaaaaaattgctggattctataaactcaggaatcaattgcactaaaaagcttggaataggtatgaatctattgtgtatatacacatatatatacgttggtaaaaatgttgaaatatgctatgggactctttaaaaagagtaatgaggcctggcgtggtggttcacgcctgtaatcccagtactttgggaggccaggcgggcggatcacaaggtcaggagttcaaggccagactgaccaatgtgagatggtgaaaccctgtctttactaaaaatacaaaaattagctgggtgtggtggcgcacacctgtaatcccagctgcttggaaggctgaggcaggagaatcacttgaacccagcgggtggaggttgcagtgagccgagattgccccactgcactccagcctgggcaacagagcgagactcaatctcaaaaaaaataatgaaactgatgctctctttatgcttcgtttgtcttagatatttggttcccgggtaagagttgactctacagcaaaggttgcagaaatagaacatgcggaaaaggaaaaaatgaaggagaaagttgaacgtattcttaagcatggaataaattgctttattaacaggtctgtgtttgcttttaagaaaggatttttttccatgaaagtttatggaatacttcatatttacttatattgaattagattttttacctaggaactgtcttagataacttcacttaaattatggatttttgtaatcagtaaattgtgatttatgcacacttacagtgaccagaattacgggattgatttatacagttactataataaagaacacttcttttcatactagtaatggatgcattagtactatagttgataaactctaattatataggtaagaaatgcaatcttgttctaatttgcatttcttttacttgtggtaaaaatgtttacatgttttttagtctaatgtagtttatcttgtaacagttgtgagcataatgttttcatgtaaaatatttacaggcaattaatttataattatcctgaacagctctttggtgctgctggtgtcatggctattgagcatgcagattttgcaggtgtggaacgcctagctcttgtcacaggtatggaaaaaaggtattgttttctaacaaacacaatagtcactcttgaatttgttatttgttactatatgcaactacctttaaggagtttagaatttcagcagttattctgaaatctattctcttggatacctttaatttagatacatagatacattacatttacgataccaagttatataccacatttgccgtaggtatagatttctttcattgtgtcactgttttaaaggtagatttttggccaggtgcagtggcttgtgcctgtaatcccagcactttgggaggccgaggcagccagatcgcttgagctcaggagtttcagaccaactttggcaacattgcgaacccacatccctacaaaaaaaaaaaattggccaggtgtggtggcaagcgcctgtgatcctagccacttggggggaggctgagggaagagaatcgcttgagcctgggaggcagaggttgcagtcagcggagatcgtgccactgcgctccagccttggcgacacagtgagaccctgtctcaaaaaaaaaaaaagatatgtatatttttttctcacaaacctgtaagaccgttgttaaaatctgaacaaactagagctttaaaaagtcttaagtctacttacatttatctagttcgtacatttgtttttattgcttagtaagtagttgaatgctttgtgtcctttgtagtagtacagttacaatagtaacctttattgaacatttactgtgtgctggagagtgggtcaagtactgaaacattgcttttgttaattttaaaaaatttctgaaagtaataaacgttagcatacgtgaaacaatcaacattgtataatgaaaattagtatacctcaataccctttaatagaagtatgagtgatataattccagttgtgtcaaatagaaattgtgtttataaatcagacatgtctgtctacatcacaatgacatgagttcaggctggttgcggtggctcatgcttgtaatcccagtgctttgagaggccaaggcaggaagattgcttgaagccaggagttcaagaccagcctgggcaatatagtaagactgtctctacaaaaaattagctgggcgtggtggcacatgcctgtagtcctagctacttgggaggttgaggcaggagatctcttcagcccaggagtccaaggctacagtgagctgtgatcacgtcactgcagtccatcctaagtgacagagcaagaccctgtctttaaaaaaaaaaaaaaaaatgcagcttgtttgctttttattgtggtaatggtttaaaaattattgtttattaaatttttacagatttagggatataagtatagttttgttaatggttttcatagtacactctaagccctggaaaataagtttaacacttttctagattttaggtccttgaaaatgaatgaataggttggaaagttggtttgggaatgagaattaaggagacctgggttatgagttgtgaagtcagtagggctgtcacactgtttggaactgccatgaatattagaagaaattatagtgtactaacctttggagagtggacttggtctcatcccagaatgatctcttaagacgttttttttaatcatttgagaagcatagtcgtcttctaaccaagagacattttcctttaattacttgaagtgggtttacttgctttaaagttacttaggagccattgcgtacttgatgctttaaggtgacaaataaacacaatttaagatgctcatgtttatgtaattcattctttagttccacaaaataaagatgtaagaggccgggtgtggtggctcacgcctttaatcccagcactttaggaaggcctaagtgggcagatcacaaggtctggagtttgagaccagcctggtcaatatggtgaaaccctgtctctactaaaaataaaaaaattagccaggcgtggtggtgggtgcctgtagtcgcagctactcgggaggctgaggcaggagaatcacttgaacccgggaggtggaggttgcagtgagctgagattggcgccactgcactccagcctgggtgacagagcgagactccgtctcaaaaaaaaaaaaaaaaaaagatgtaagaagtaaatggtaataatatattgatgggataaacatatcgtaaggtcttgacatgaaattgctctatacccagaagaatgtttattaagtacaccaactgtatgtctatgaaggtgaccacatggtggctcccatccttaaaagctcagtggttgtcaaaggtgtatgatgacattggttcttgcaagtgtcattaaataaatgtcttgcactgggcatggtggcatgtgccagcagtttgatctattcaagaggctgaggcagaaagattgcttgtgcccaggaggttgtgctatgatggtgcctggtgaatagtcattgcgctccagtctaggcaaggtagcaagacactctctctttaaaaagaaagaaaagtctcatgtagaaggatgaagtgaaaagtttcataagccaagttagtcttatttttggatatgacgtcccaaatatctgttgtgtctcacatctagaacacaaagcagtctcagaattttgccagccaaaagtaaaaagaactttatacaaattatgagtataaattagtagtttcaaagaccagagtctttatgaatttattataaaataaataatagagcattgacagatttatcagtaaggcataggaaaagaagggttgattgataatatatgcaattcacattatgaaaggagtagtcagctagagaaaaggattttgaaatggaaacctgacttttgcttagttaggaaatagggaacgaagtggctgacctgttcagtttacagcatggaagatggagggaaaataggaatagaaatgagacataaggactaaattaatttgttcttattaaatttggtctgggaaattcttagtatgcatttcttgtttttttaggccttaggacatttcatttgtgataattagagatatcaggtgcttattaagcagttcatgaagtgtatagtggttgacttataggacaaatattttcatgtcttgtgctgggaattgtatcatgaggtcttagtcttataggttggattcagaagagaatctgaatttaaactcaaaagtaactgctttaagactcagtttaaccttgggaaggtagtattgtatagtgtgtgcttataggtctgaagccagactgcttgagtttgaaccccagctttttatattcatcctagttaggtctttggataggaaggtaaacctcttggcctcatttttatcatgtgtaaaatgggataataatggagcctatccaagaggattattttaaagattaaataattagtcgatatgaagtatttaaaaagagtgccaggaatataatcagcaatcaatttttaaaatgtgaaacacattacctatcattatctatccattactgcttattagaaaacaggaattttaagcctgctgtgcatttaactaatacatgtttatgtttataggtggtgaaattgcctctacctttgatcacccagaactggtgaagcttggaagttgcaaacttatcgaggaagtcatgattggagaagacaaactcattcacttttctggggttgcccttggtgagtgattatgtagatcctggttagggtgtctaaattcttgctaggctctgttgaagtaaaggttattgtagttactagaatagcatatcttacaagtcttaactcttcagaagcatgatacatactttgtttcagtctcttgagtcaacctcatatttaccgtgtctttgtgaacagtgcatgttcaacagttttttttccttgataacttagaaccattatgagccttgattgttggagaatgtataatacaggaagacaggtcagctttcagaacccagtaatataaccaacaccggcataaataatagaaggcaaactttttatccctaagtggtcactgtgtcttttaattttaggtgaggcttgtaccattgttttgcgtggtgccactcaacaaattttagatgaagcagaaagatcattgcatgatgctctttgtgttcttgcgcaaactgtaaaggactctagaacagtttatggaggaggtaagcatttagaaaatgttgaatatatttttaatttcttaaagtacaatataagtcataagtggttttaatggttcttacagaaatcttatattgcttttgcactaaattttaaaatgcttggcatatcttaaagtcagtaattcagtatcttggagacaactaagcattgcaatattttattggaattttaatctttaggctgttctgagatgttgatggctcatgctgtgacacagcttgccaatagaacaccaggcaaagaagctgttgcaatggagtcttatgctaaagcactgagaatggtaagttaatcaaaatgagagatccgaacttaagttttgtggttattgatagttttaaaatgagtagaaaatgaactggttaatactgcttttaaatttgattctggagtttctcctcttcgtgagcagtaactgaagcagattttacattgttcctaaatgtataattttaaaaagctatcctagttaggagtaaatcagtggttcttacagtagagtgagtagttacttgttttcttcattttcatagttgccaaccatcatagctgacaatgcaggctatgacagtgcagacctggtggcacagctcagggctgctcacagtgaaggcaataccactgctggattgggtaagcaatcaaggggaactttgtggccgttgttaaaagtaactcttttcactaagctttttttttcttttggaacataaagagttacaataaccgtataaaagactcttttggactttgtcctcataatcattacatgtgctgggaaaatgtgtgtgactttatatgctcagcatttcccaaactttgttattccataagacatgtaaaactggttagaagatttgtaactatttggtatataacgactataggatttaaatataaacaatacttacattctgaaaaataacataaactattatgttgtttatacaatcagtattaacttctaatttcatagtaaacttactgcaagataatcttgagtacagatcacagatctctagtccatagataaaagtggccaatgaggcagatttaattcatattgaaaaactttctgacaagctgtgctggacattatagagtagtcttaagaaggtagataatcctgtcattgaacaagagggagcaccagttaatctgtgagaaaatgaagcaggattctcacaagaagagaagttgggtaggtaacttatgaattttcttccatttgttttttattatttgatatgttgtcttctattaatatgggtgatcagtagttgacattattgttgttattactattattataactgacacaatggtcttgctctgttccccaggctggagtgcagtggcaccatgataattcactgcagccttgaacccctggctcaagcagttctccttcctcagccttccaagtagttagggctaaaggcatgtgccacaatgcctgactaaattatttttattttcttagagatgggggggcagtctcactatgttgttcaggctggcctcaagcaatcctcctgcctcagcctcccaaagtgctaggattataggtgtgagccactgatcctggccccttttattttatttatttattttttgagatagagtttcactgttgttactcaggctggagtgcagaggcatgatctcagctcactgccacctctgcctcctgggttcaagtgattatcctgcctcagcctcctgagtagctgggattacaggtgcccaccaccatgcccggctaattttttatatttttagtagacggggtttcaccatgtttgccaggctggtctccaactcctgaccttaggtgatctacctgcctcagcctcccaaagtgctgggagtacagatgtgagccgctgcacccggccccttttaatttttttaaaggctttctttgagctcatttgtaggcttatctacctactgagtaaagtagttgggtgtcctaattttattaataggattaatttttattataaatcattagagatgttttgatactttagttaaaactgctttttagtaaatttgtttttctttgcagatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggtaccctaacacttttctcagaaaaaattactaacagcaaaacaaaatagggagctgtatttattttataattagagttaatgaaaagcagagacagttttgcctggataaaagtatgtaagttatttaaaatatcacaactcttaacacttaagccagaaaaacttaaggggaaagagggatgggcagctgaggtagctcttaggattgaaaaggcacagaaagagccatgcttggaaaggtcaagtactgaggacagtagatgctgtgatgctttctattgtctttaaacagaatgatagcaaaaggaaactgagttctgtaactaaagtgttctagggcaaggtcatatagccacacctactcccagaaatcttcacaagaagtcagtgccctcacccacagttgaaataacgcttaaaaaatgtataataccttgtttggtctgatactgttttagagatcaggtatcttttattagcaaattctgagtaatttgcaataaagaaactgaattttaactcagccttccagacctaccagaccatgggcttctttttcatattccttattaatctccagaagactttttttttcagatcagtgccctgtgacagctgcttcataactcttgacaatggttagcatcctagtccccccataagctaccaagggtgaaaagtttatctctctatatgatccctgtataatgctgtactctttgatctgttcttaagcttcttcagcttctcgtaactgttgtgtttgcctctaaaagcagtgtttctcaagctttagatccttgaacaagcattaagtacaaatttactagtacccttatcccatctttccaaaagattgttctatgcccccttattgtatggtcatcaaagaataaaagatgagaatagaaggtgcttcttgttggtgggggtgtctgcagagtcccaaggcagaacagtcctgatgtggtgcagggcatcacacagaggagggggctgagtggctagctcaggtctgtcttcctcctcacctaaagccagcagtcccatcctatataacccattagtccatgacataacttggtcacctcttaaaagcccaacttccaatactgccacattggggattcagtttcaatgtgagtgttataggggacacacatgcaaaccattgcagagttataacagttttaatacaggattctagttgtgtttgtatttagtataatactttggataaaatcatgctcttcatttttcactattgacttttttcttactctcataggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttggttct

SEQ ID NO: 7262 - DNA, 100 bp, Homo sapiens
ggtggatcacttgaggtcaggagttcaagaccagcctgggcaacatggtgaaaccccatctctactaaaaatacaaaaattagctgggcatagtggtggg

SEQ ID NO: 7263 - DNA, 1744 bp, Homo sapiens
attcaaggctcactccagtccacgtttctagcttccgtcttccctcccctgcacatactactgcatgtacctccacagtcttcccttttgctttgctggcatctcatgtctttgttgcctatccaagctccctgttgaaattctatccatacttataattaacatgtcccttgattcatacagactttatcagcctgcccttagtttctgtcagacagaattaagtcctctgttcccatataaagcagatctttatagctgttttagtagatattgtttatatatctctctctttcacagccccttgtaacccatctcattcccatattctctttcaacccccatctctgattacagatagaaagggtgataagtttgtgggctgtgtctctttaatcttgtacctccacagcatctaggacagtgtcttgcctaaagcaaggatggaattaacatttgttaatagacgcttatctgtcagtcttactatcctcaccctgcttcataaggaaattatattttatttatattttatttcaaatcagtaatactgcctgtcacatcactaaaacctcaaaaaacagaaatgtttgaaataagaattttcaggtttgccttgtgataactgtatactaactagttgaaagtatggattcagtatcttcaaagtgttctgatttgctaggactcactgttttcttgtgtttaatcttcagtttgtgaggtcatttaatttgtagcatttgcaaatgttatactgaaaaactctgagaatgaaataagtcactatactacgtatttttataaataaggaagtgcacaattatgtgacttcacatttcttgcttgcttgctttttttggggtggggacagagtgttgctctgtcacccaggctcgagtgtggggtggtgtgatctctgctcactgcaacctcctattcccaggctccagtgatccttctgcctcagctgggactacaggtatgcaccaccatactggctaagttttatattttttgttgagatgaagtttcactgtgttgtccaggctggtcttgaactcctgggcttaagtgatccacctacttcagccttccaaagtgctgggattacaggcaggagccactgtgtccagcttacattttttgtataatcaacattagccagagtaaccacactttagatctgttggtcttcaggaaaagcaatatgtgtctggatgtggtggctcacacctgtaatcccaacactttgggaggccgaggtcggaggatcacctgaggtcaggagtttgaaaccagcctggccaacatggtggaactccatctctactaaaaaaaaaatacaaaaattagccggatgtggtggtgcacacctgtaatcccagctacttgggaggctgagacaggaaaatcacttaaaacccaggaggcggaggttacagttagctgagattgcgccactgcagtccagcctgggtgacagagtgagactctgtctcaaaaaaaaagcgaagttacatgcaataaaatcacacagaaaaattatttttaataaaaaattaaaacaattgacagatatcagttatatgatttattgttccaactgttatatgtgtatttctgagtgccctttggcttcttgcccggtggtacttgaagtcataggataaacatggcatattttccttaagtgtcaatattactcaacaaatataggttaaaaaagcattctatctgatgt

SEQ ID NO: 7264 - DNA, 94 bp, Homo sapiens
acgtgcaggtttgttacgtatatatacatgtgccatgttggtgtgctgcacccattaactcgtcatttaacattaggtatatctcctaatccta

SEQ ID NO: 7265 - DNA, 199 bp, Homo sapiens
tgcaacctctgcctcccgtgttcaggtgattctcctgcctcagcctcctgagtagctgggattacaggcatccaccaccacgttcagcaaatttttgtatttttagtagagatggggtttcatcatgttggccaggctggtctcgaactcctgacttcaggtaatctgttctccttggcctcccaaagtgctgggatta

SEQ ID NO: 7266 - DNA, 11597 bp, Homo sapiens
cggtcacgtaactagtgagttgtgcagctagggttagaataaacagatttattttttttttttcttagaaacagcaattaacaatgtgactcctaatcaaaagaaaagagatgtccttggggcttaaagtactatggtgggagtcttggactgagtaggtttgaaaatacaattttatgatcgtggagtactaggatttagtcattttgatgcagagcatttcctgatcaactgctgttgtggagtgtactgtccaatagaattctctacaattaaggaaatgttctgtatctcaagagattgttcttaatggtggccagtagtcatgtgaccgttgagcatttgaaatgtggctagtgctactgaagaatggaattgtaaattgcttttaatctaaattttgcctgtgatattattggctgtgggtttgccaaaatttgtttttttaaagaggaaaagataacggactgttggctgctttattggacagcacagctagcatatagatgcagataggtagtataacttgtttgtagtttaatataaatgttgtattttgtaattaggccaaatttgagtttcatcatggtgactatgaaaaacagtttctgcatgtactgagccgcaaggacaagactggaatcgttgtcaacaatcctaaccagtcagtgtttctcttcattgacagacagcacttgcaggtaagcagcttttttgaaaaccacttacaggctcattcaaaaacttattggttagtaaacgttttatatacaagttacttaattgttgtgtcccccaaacactgcattatttttgaagttatttaaaaagcaaaaaataggctgggcatggtggctcatgcctgtaatcccagcactttggaaagccgaggcgggcatattgcttgagctcaggaattccagaccagcctgggcaacatgacgaaaccccatctctacagaaaatataaaaactagccaggcatggtggcgtgtgcctgtagtcccagctactggggaggctgaagggggaggattgcttgagcttaggaggctacagtgagatcttgtcactgcactccagcttgaatgacagaacgagaccctgtctcaaaaaataaaatgaatttttaaaaaagtatttcccaggcctcactgtagaacaatggttcccaaattttgctgcatgttacagcaacctggcaagccttttttttttttttaaacgggaaaaaacccacctccttcgaagcttttaaaagtcatgattctagtgaacagtagtgagaactattgccctaaagcgtgtctaccagatgtgtgggcaatggatgaacatcacttgagaacttgttaaaaatatagactctcaggctctactaatcagagtctgcactttaaacagaaccctcaggtgatttgaaacacactttgtttccagaagcactgacctggacgtttttttttttcttgagagggagtctctgtcgcccaggctggagtgccgtggcgcaatctcagttcgctgcaagctccaccttccgggttcacgccattctcctgcctcagcctcccgagtagctgggactacaggtgcccgccaccacgcccagctaatttttttttttttttgtattttagtagagacagggtttcaccatgttagccaggatggtctcaatctcctgacctcatgatctgcctgccttggcctaccaaagtgctgggattacaggcgtgagccaccgcaaccggctgactttttaaatctaaaaggatgagggacatatatttaaaagatccacatttatttcaaataagcacttccatttgggcacagtgtctcacacttgtaatcctagcattttgggaagccgatgggggaggattgcttgagtccaagaccagcctgggcaacagagtgagacgacatctctacaaaaaatcaaagaaattagccggacattgtggcgtgttcctgtggtcctagctactctggaggctgaggcaggggagaatcacttgagcccaggagtttagagttgcagtgagccatggcaccaacacactcctgcctgagtaatgcagcgagaccccatctcaaaaaaaaaaaaaacaccgccaacaacaaataaccacttcccagttaagcagcaatccaagtattgcaatttagtttttagatgcagccacttgctggctgtatgatcttggacaggtaactgctgtgagcatgttgcttctgtgaaattgaacaaatgataatcctaaggttgttaaatttaacgtaaggttgttacatttaaaattaactaatacaagtaaagtatattacatatgtataggtttatttacatttgtaggctacttcagacatcttcaaagtcagagtccttattttgccttttagaggtgctagatagtgaagaaaagatgaactttgtaattaagttggatgttcaaatggtaactactttttaaaaataagggttttgatttaactggtaatactttggcttttttctagtcccttaccccaggatatgcttaaatcttttatttattttttgagacaaggtctcaactctgtcaccacgctggagtacactggcatatggatcatggctcaccgcagccttgacctcctgggcgcaggttatccacctcagcttcccgagtggctggactacaggcgtgtgccaccacatccagctaatttttatattttttgtagagatgggttttcgtcatgttgcccagaatggtcttgaactcttgggctcaagcaatcctcctgactcagcctcccaaagtgctgggattacaggtctgagccaccacacccagccttaaatttttacctattccttcatcctctcactagcttctattcttaccacatctgctttatcttcctctatataaaaatgacttcaaacttctcaaaatctgtccccatgaaatgcctttagctttaatttcttctagcaagtagtctctggtttacttccctaactttttatcttctaattctgcataaatttttcctttatcttatatggcaagattttgtctgtctagaatatggatagggactacaatttgtcccttactctgtatgttaagatgtttaataaattgtgggaaatggacttcatgtgacagttacgctaaagtcttatttttaaaaaatattaaaatgttttccccttccagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctgccatttattatctacctaaacactatggcctcatattttttccctccaaatcataatttgcatgcctttattattttgagcatctcctttcatgcataagatactgtaacctttctgtcccagcctcaagccctggagtcagctgtttctccaaggagcccagcttccttttagtgggaaatactagaagtaaacatctgggactcctgtatgctcactgctgctattgctactgtggagtcttctgccctttcacagtggacagatcagcaggcgatctaatgtagggaaaggatttgtctttaactgttaacttgacttaaatttacttaaagctgcatcctttttagtctttagtcatgaaatgttcattaagattccctgacagaaatcaagtaagagtcagctgggtgcagtggttcacacctgtaagtccagtacttggggggccaaggcaggaggattgcttgagcctaggagtttgagacgaggctgggcaacagtgagaccttgtttctacaaaaataaaattaggcgtggtggcacacgcctgtagttccagctactcaggagactgaggtggaagaatgtcttgagcctgggattttgaggctatgggaagctgtgattgtatcactccagcctgagtgacagaagctgtctcagagtgccacagtcaactgaacttggagacttctgagaagtgaacttggtcttttcaatactatagacttggaggtttgagatctgcatggttttattctcggtacaagaaaaggggctagtagcatgctttttttcttccccctctattggaccatttcctgtaacactaacatgcttagcctcaaacttttcttgaggtcttttttaggcatatggctcaatctattttatttttcaatatgggctgtagttcatatattttgaagtttcataatcttaaaaaaaggaaatgcaagtgtagcttggcattttagatctgggaaggacctaagattcgctaaggattggccattgctgtggtctccatgtgtttcccctaaatttgtatgttaaaatcccaacccccaaggtgatattagcaggtgggggtctttgggaagttattagatcacgagggcagaaccctcaagattggagtaagtgcccttacaaaagagaacccaggctgggcacattggctcacacctgtaatcccagcactttggggggccaaggcaggcggatcacctgaggtcacgagttcgagaccagcctggccaacatggtgaaccctgtttctacaaaaaactacaaaaattagctaggtgtgatggcacatgcctatagtcccagctacttgggaggctgaggcaggagaatcacttgaacccagggggcagagattgcagtgagccgagatcgtgctgctgtactccagcctgggcaacagagcgagactccatttcaaaaacgagaacccagagggctcacttgccccttccaccacacagtgagaaggcaccatctatgagccaggaagcgggccctcacctaacaggatctgctgggccttgacccaggactttccagcttctagaaccatgaaaaatttctgttgttcctagcagcccaaacagaattagaaccattaatttctatttctcctttagcttaacactggactttagttttaatcttaactgagagtggtcctgctagtttctttgctttacctgtttttaaaacactttgagctaagaatttttcacccaattatcacacatgattagaaaacaagatgcttaaagtgaaaaaagacacccccacctttaccctacttgatatccaggtccttttcctccaagaatatttctagctgcttctggttttgctagtttatttcaaaaattacaattgtttgagtcaaatctatacttgatattcattgttgggtttctttaggtcattctgctgttctctcagtttcccaggtgttttgtgtgtcttccttgtgctattaattttcctgtggccttgttggtcagatccacagaggtaaatgcaagtgtttttccttgcttcagaacatgtgctgtaatcactatatcttctcctaattttgcaggtgacatgtaccttgaaagaaaatgaatatagttaacagcagataatttttcaaagggaaagttgtgtgcatctcacaacagtgttcctatgtaacttattttactcctaaaaatagttttaacggtagtattggtaagctttctgtactatcaaatgtgaatggctggtcctaaccaggttctattttacccattccttacccacacaagtttcttttcccaaatatgtgagaagaggttttcttgcctccccttttttccctttacatttcccacttcacatttatttggggctggtgaaagatttcctccagctttcatttaatctccttaacttcttagatgaaatatcacttggtgtctgtatattgtcctatccatatttacaatttatttgactctaaaatgacaatataacaactataaggaattgatatgatgtccttacaatcttgatgatggactgtctatatttttaagagatgtacatcctagtcacttgtaatcataagttgtctttaactcagctggctccagctaattaaaaaaaaaattggggagatgaggattgtttaaaacaaatgttaatgttttaaagggaaataatttccttacagtttatttttatgtttctgctttttagaaagaaacctttaaaaaggatatgtatttttgccatattcaaaataagacttcagtatttatggctaggaggtataagaaaggtggatctggccgggcacgatggctcaagcctgtaatcccagcactttgggaggccgaggtgggcagatcacctgagggcaggagttcgagaccagcccggccaacgtggtgaaaccccgtctcaactaaaaatacagaagttagctaggcatggtggtgggcacctgtaatctcagctacttttgaggctgaggcagaagaatggcaggaacccaggaggcagaggttgcagtgagccgagatcgcgccactggactccagcctgggcaacagagcaagattccatctcacaaaaaaaaaaaaaaaaaaaaaaaaaaggtggatcttattgctggaaagaacaggcttgtctttaattcacatacctcaatgtaaagaaatgaaaaatagtatgtttagtagtagtttggccagtttttattatttccctaaattttgtcttagaaatcaagaattttggctaacagccattaacttaaactgagggaagataaggaaccctttgtgctacagatgagtaaacattaagtccggggaatttggagattgacattttgtcagtaatactctaaaatttccccttttgttgttttggaacctcgcttgtttttaacctaagtcacagtctaacaggcatcctcagtctgtataatataggacttgatgtgcaggggtggagtaaatttggtaccatgtcaagtaaatcaaagagtgaatcatgaagtgttaactgactgaaacattattcatttacttttgaaatatctctaacttttgaaagaccatgtcctagtttttgttgaagtgaatcagtttttgaagcgtaggcagctcttgatggccaatgcttttggcaacacatatttgaaaggccaaaactatgtttgacttactgaaaattccttagggttctaaaggcaaaagtaccttagtagatcatgaaatgcagtgctaggtttgaagatctctctgctcttaatagagacttttagggaaaatcaagtcatctactgatctcacctcttaccacatgaaataaggactgctgaatatgcacaccagtaacataagcagagcctttcttttctgtacatcttaatttcaaaaagagcatttggctgcatcttgtaatttgcttattgtaccctcaatttaagttattcccatgaagagggactgaatgtttcttaagtaaacttgataaaatatttagattccttaaaagcctacattggctgggcgcggtggctcacgcctgtaatcccagcactttgggaggccaaggcgggcagatcacaaggtgaggagatcgagaccagcctggctaacacggtgaaaccccatctctactaaaaatacaaacaaattagtcgggcatggtggcaggcgcctgtagtcccagctactcgggaggctgaggcaggagaatggtgtgaacccgggaggcggagcttgcagtgagccgagactgcaccactgcactccagcctgggccacaaagcgagactccgtctcaaaaaaaaaaaaaaaaaaagcctacattatttccattaccctcatatctactcacaatggctctctcaacctgacctctcagttagttacatttttgttgcttaggtggaaaaagcagttgtcttgaaactaaatccctgtgcccagctctttctttattgaatggggctgcagtagtaccagtttatgttggaattgagtttcttacattttggaagtttgaccctgaggggcactgttccctgatcatgtagtttaactcacagaacatgtctgtgtagtcacagggagagatccaggattgctgcccattcttaaaactcaacactttgggaggctgaggtgggtggacactggaggtcaggagttcaagaccagcctggccaacatggtgaaaccccgtctttactaaaaacacaaaaattagcccagcatggtggcgcacacctgtaatcccagctactagggaggctgaggcaggagaattacttgagccccagaggcggaggctgaagtgagccagattgtgccgctgcactccagcctgggtgatggggagactccgtgtccaaaaaaaaaaaaaaaccccagcaatggtgttcagtttgttagagtaagattataatgtgtatatgaactctaactttactttgaattgtatgtactcaatacaatcctcatagtgttataagtggtatttttaaaattaaataatatttattttttgtagagatgggggtcttgaactccaggcttcaagcaatcctcttgcctcggcctcccaaagtgctgggattataggcgtgagccactgcgtctggccctgaatggcacttttaaggactgtatgaaacagttatgagccatcagtttgtgatttttccccctgcatcagtatacacattaaaagctgaatgttgctcttttgaatgtttgggatcattccctttttactattgatacacactgtacttgcaaattaactgctctagttctagattttaaggctggaatattttaggacaaaatctataggtgcagttaaggagataagcagctaattgaatctcatgcgttactaataatataaatgtgtttagtctcagttgtttagacagttatcacacagaagggatttggaatacagtttggatacatacgttatgttcatatcgacactgactccgggtgctcccctttccgtgcatagcagagccattgttgatatgttatctactaacgtggctgtcaaaccgccgtggagagtgcctattgcattggtatgctcttcttctactttcatttcacaaatcactttcccaggagcagcagagacaagagtaatct

SEQ ID NO: 7267 - DNA, 22073 bp, Homo sapiens
accctctcccgcccgctccacccgggcgggaattgtttcctcgatcaaatgagtgaaaacctgagtgatcctgtgtctcccgtggtgcgagtgagtcgctgccgctgaaggctaaggggtgggggtgggacttgcgggggtggaaggctaggtggtctccgggctccgcctgggatttgggagaagaacccgcctcctttgcctcggcaatgctcacaagaagataaatcgcactccccaccattttgaacgggggcagatccacagggaagtctcccttggggaatgtaggactagttgcaggctgggggtgttgggaacccgggcattaatcaggtctaaccacagagccggaataattaataccgtattatataccccttttccttctgccgtcatgattctccttggcagcagcgttagcagccgcctgagggtgaaaatgtgggtgatggggaagttggtaatgactccgctgttttttctcatggctcctttgggccacagctgcccgcccccggtatacactgtagttgattgcagggaaaccctgtacctctccctttccttctctaccgattttgcacttttctctatgctcaccaccaagtgtaatcaataacaagcactgacaatacatagcaatagtgaaatctgaaataactaagaattaggtactacagccatggagctggctgggtaaaatctaattggatatttcagtttcattcacctaccctgttttggtgtttggttttggttttggttttggtgagttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaaggtaatttaaagttcttaatggtgaattagcacaagtaatttttgtaagtgtatattatttgttactcttaaattattatgaatattaggttaaagagtggttgaaaaaaagtctgctttgtatgctctgttttttcacccttaggggtgattctgtgaattgagcagttgcagcatgcgaaaagacccttgagcgttctttggtttggaaataaatttgagtctgaagcttagtagtagtatacactgagttgacatggggtgggcaagattacaaaattttatatggagttaacatgggaaaccttatgatggaatttaaagattatctaatgtagagtataaataagatggttgaaagtgtgaaattgtaatcagactgtttatatgctaaagtttatcctgtttcttaaactgcgtaatgtaggtaaccttttctcttacatttaatgaagtagaatacaccttttaggagcaattaaatactgaaatggttaatttgtgtttagaagtgtgattttcttttttacttagagttcattttgccttgtatagaagtacagtttttaaaaactcaaaatgacctagaggaagtttcatttttaggggcggtggaggtcttaatcagaattagttccgcagttaaatagcaaacagtaagttgtgagtagtcaaggatgggatgataagagcagtattttttgcaacttaaaatgaacattttcttaaattatcagcaaggcttatttgaccaaagatgaggttatgaatgtaaggaagtgctacttggattttggtgcttaaattgttagctaatttcagatcagaaatacaatcttagtgtggtatctattaagtatctggaagttttccaggtttccccctactgtttaactcttattatttttgttgctgagacaggcctcactgtattgcccaggctagtcttgaactcctgggctaaagtgatcctcctgtcatggcattttaaagtgctgggattacaggcaggagctgccacgcacagccccaactcttaactcctaaaaggttatttgtatttaagaacattcttagctgctgaagtatagcattgtgaagtgatttttaagtaatttttgaagtgactgtcccaagattgggtggtatcaaggacttacatctccacttttgttttgttgacaagctgactcaaaattgatgagattggattttagttgaagatgatacagtgtatgctctttaaataaatccaagataataagtagtgagaccatatctttgtatttaatctatatattgccccaaattgcaccatcttaattctttaacaccaacgataatctggttttattctgtgaatggacagtgtccatgcagttgccctgaataattcatgatatatacttaatagtacagaattttaaaaagtagtttagtgatgcgtacttggtcttgagtagtattaaaagagaacttggtgtgcttctttttagtctttcaaatattgatggttttggctgggtgcagtggctcacggctgtaatcccagcactttgggaggctgaggcaggcggatcacttgaggtcaggagttcaaggccagcctggccaaatggtgaaaccctgtctctactgaaaatacaaaaattagccaggtgtggtggcgcaggcctgtaatcccagctactcgagaggctgaggcaggagatcccctcgaacccaggaggcagaggttgcaagtgagccaagatggtgccactgccctctagcctgggcaacacagtgagactccatctcaaaaaaaaaaaagaaaaaccagaaatattgatggttttgataatgtaatattgagaaagtaatggaaattggcccatataaggaataaaactattcatttgtctgaatagcgttgttttaaaactggtgagatttttaattttaagaagtattgtccaaaatagtgctatggataccattatgctataaaactcaagcattaaacattctaatgacagtttgtacatgtatggttggagggggaggtaggggaagaacagaaggaattacctatctgaaaatgtgttttcagtgtataagttactgcagacagttaagaattttgtggagttaatgttacatgacattgtaatatgaactgagtgttaaaaggctgtgctccctgtgggttaatacaccattttcttttcttctagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggtaagttctgccttaagtcttgacttgataaagtttctgtggattaaccttgcatttccccgccccccgaaccccccttaaagtggatagttatgatagtgaccagtctcttcaggtaaatttgtctttgtgccatgttgataactgggatcatgactttaaagcattgtgtttataggattagaaaaacacgtttttttacgccagaccattcttatgtggatgaagtatataaagggatttctttaatctgtgttaggtgttgatgatctcggacttttttttttttttttttttttgagacaaagtcttgctctttcgctgaggctagagtgcagtggcatgatcttggctcactgcaacctctgccctcgcgcattcaaatgattctcctgccttagcctcccgagtagctgggactacagttgtgcgccaccatgcctggctaattttttgtgtttttagtagagatggggttttgccatgttggctaggctggtctggaactcctgacctcaagtgatcctcctgccttggcctcccaaagtgctgagattacaggtgtgagccactgcaccctgccagtagccaactgtttttaataatttaagtgttatgcagaaagtttaaaaatttttgaagtaggtttgtttttgaaaacttgaccttgagtaaaacatggacaactttgttgtattaggctcataatattgtgtattattattgtggataaatgtcttatgtctccgtttattgtatttccttttttggggggaatatgaatataaggaagtgcttccagctttgtaaacttctgcaacatgttaaaagttaatctgggcatacctgaaccaagagatccccacagttacttggggagaatgctggagataaccagatactggtctggaagaaattatggaccttcaaaaattaatatgctggctacaataatgaagcagaagtcaggaatggagaaaagtagttttctatcaaaataaaaatagcatttcagctataataggatagtgattcatattaggagttctaagacatctttttaaatagattgatttttaaaggtggaaataaaggttcagggtctgacaatacaacagatatcagagattttgttggagttttcaccatgcactgataagtctaggtcttggtgttaggagcattggactgagtgtatgtgactctctgtaagataaaaattaaaattagagccaggcacagtgacttagcctgtaatcccagcacttcgggaggctgaggtgggtggatcacctgaggtcaggagttcgagaccagcctggctgacgtggtgaaaccccgtctctattaaaaatacaaaaaatattagcggggcatggtggcacacacttgtaatcccagccattcgggaggctaagtcacgagaatcgcttgaacctggtagacggaatttgcagtaagcgaagattgcaccattgcactccagtgtgggccacaaaagttaggactctgtctccaaaaataaaaaattacatcatgagctattcagattataaactattatgtttacttcctaagatataaaatgatatatggtagatcttttgtacttataaaatgtttttataggggaaccctataatttgtgacatggcttgatgtagctgtttctttaaaagtaaacttttttttttttaatcattttataggatgtaattggctgtactcaggagatggatttcattctttggcctcggaatgatattgaaaaaatcgtctgtctcctgttttctaggtggaaagaatctgatgagccttttaggcctgttcaggtattttggtctaaagtgtgatgagtatttcaatatgtgaaaactactagaatataatagggtctaacttgagaaattctttgggaaaatggtttctgatagttttatttcacgagtctcccctatttagaatattgtgatgcaagagaagaaagcgtttggattatagaatctcttgacagtgtggtggttccacctgcccagtgtggctttgaaattatgactagagaaaatcttttaaagtggacatttactgatttatagaggggcccacagatgagcttctgagatctgtaactcttgaagccttcaccacacatccttctaaaaccgtatatttaactgctgcttcccaaaggaatgtgatctgaaatgggtgaagaaatcattttgtagaagttgatctgtatataaaattatagaagaaagaagtaaatttagtagtcattcttaaccttaaaatcttgctgacttttgactgtttgtcatggtatactagacattgctcaagtgaatcccccctctagtgttaagggcatttactcatgttgaacctagttttatttacagtatatttgtatgcatagaagatggaggtccaccaaagtgttaattatgcttagttgtaggtcaggtatagctaactttccttttttaatatatatatttacatttgtgtttcctttataatttatggcatagattgccacgattttcttaagtatacttttataatcagaaaaatgatattaaggactcattttaagtacactaaatcaaatattagaaggcttctttattttaagctaattgtgaggattatttgtcatttaaaacttttgcttctacttattaccctgaagtatctttgtggtgcttatgtttttcacagactgtataaattgatatactctcccgccccatggtaatgttgctacacataagctctaataattatcatttttaatgttttaagattaattcaactaagttttaaaaataatccattggttacatacataagaaagtactgtatacagattcccctgacttataatggttcgacttaagattttttcaactttaccatgatgtgaaagccatatgaattcattgtgctcctcgatttatgatgggactacatccaggtgaagtcattgtaaattggaattgttgtaagttcaaaagtcactttttgatttaaaatacgtgtaacttacactgggtttatcaggatgtaacatcacaagtcgtggagcatctgtatttcggtcatttaatggatgatatctgactgaagggagaaaatgaatataaaaggcatgaaaacaggaatagaaaaggcatgtttaaagttctcagcgcagggctgataactctagctgctctctggaggtggtgttaggattttgttgttttttagttaaggatttcccactggaaaaatgtaggtctgcttattacagtatgttttcaaatttctaataccctgcctttcccactgggaccttatttgaaatagttgagttaactttagtcttgtgtcaaatagtactctttgaagtcatggctgatgtttattgagagttgactgtactagtttcagcttttttttttttttttttttgagacagagtctcactctgttgccagattggagtgcagtagtgtgatcttggctcactgcaacctcctcctccttgcaacctctgcctccgcctccctggttcaaatgattctcctgccttagcctcccgagtagctgggtctacagggacatgccaccacgcccagctaatttttgtatttttagtagagacgggttttcaccatgttggccgggatggtctcgatctcttgacctcgtgattcacccgcctcggcctcccaaagtgctgggattacaggtatgagccaccatgcccgtcctttttttgagacagggtcttgctctgtcgcccaagctggagtgtggtggcgtgatcttggctcactgcaacctctgcctcccaggtttgagccgttcttgtgcctcagcctcttgagtagctgggattataggcgcatgctatgacacccagctaatttttgtattttttttgtagagacggagttttgctatgttggccagggtggtgtccttgacctcaagtgatctgcctggcttggcctcccaaagtggtgggattacgggtatgagccaccacacttggccttagactttctcttactttatatatatttaatctcagtccttaaaataactgggtagataggaagaaactgagacagaaattaggtaaataaggcccaaggcagttaaataggataaaagcctggactgactgtgcttttaactcactaccctgtactgtgaaaatttacctatattaattatagaatcttaaaattctggactgagtgtaagcagtatgatgtaggtaatgactttagaattcaactgcagtaagtaggttaatattgtaagaactaatttgcttttctgaagtaatttaaaatgtgtgaatatcctatatgaggggccttaaatataactcactcagttctttctcaaagaaaatgagaaaaggaatggtaaatgttaacttgcaggcctcttttttttgttttttgttttttgactcttaaagcactttacttatttttaaaatttaattaattttttgtagagatggggtctcactttgttgcccaggctggtcttgaactcctaggttcaagtgatcctcttgcctcagcctcccaaagtgctgagattacaggtgtgagtcaccgtgcctggccttttgaagcactgtaaaacctgaatatatgggtagtgaggatataatcggaaccagaataaggattgtttttaaatactgagttcttcagtgtactgtgaagtgctgggaggtactactaaaatgtatctcttcttttctcttcattattaatgctactgccaaggttagctcctcccctgactgttagaatatttcgttacttctgtgggaattacttctttcatgctgcttatgagaagttgtgtgtgtgtgtttgtgtgtgtgtgtgtgtaccatttcttttcagataagtggatattcaatatgatagaattgaaatgctaaagaactataaggaaggcctttttcagtctcactcaaaccttttttcagtgtggttaccggttcttgcacccaccctggttgcttaccatattgcagctttgttacttgaatagtatttcagtttttaacacatttgtttttgtgttggttctgtttcctagtatggctgttttttttgttttgttttgagatggtgagatggggtattactctgtcatccaggctggagtgcagtggcatagtcatggctcactgcagccttgaactcccaggcccaagtgatcctcccacctcaacctcatgagtagctgggaccacaggtgtgcaccccatgcccaactaattatttttgtagagataggatctcactgtgttgcccgggctggtctcaaactcctggcctctagtgatcctcccgctttggactcccaaagtgctgggattataggtctgagccaccatgcccagtcagcgtttatcagattacttaccattactactttgtcctggggaaatcctcttaatctttaaaggcgcaatccaaaatcataatgttcccgtgttacttactgttacttttttttttttctcctatagtggtttgatgataagaacccaatttgggccgggcgcggttgctcacgcctgtaatcccaacactttgggaggctaagccagatggatcacctgaggtcgggagtttgagaccatcctgaccaacataaagaagtcctatctctactaaaaacacaaaattagctgggcgtggtggtgcatgcctgtattccagctacttgggaggctgaggcagaagaatcgcttgaacccaggaggcggaggttgcagtgagccgagatcgcgccattgcactccagcctgggcaacaagagcgaaattccgtctcaaaaaaaaaaaaaaaattggagttttacagataaccacatcttattctgggaaaggatttgaagcaagttgggttttatatttggctgtacttgtcctcttcagcagtataataagccccttaaggctgaagtaaccttattcctattgtttagtagctaatagcatgcttttgatatgcttatgatcatactaataatttaatatttgaattgtatggaagtacaattcagtatcattttacatatggtatattgtgatgctgtatcatattttatgttacggtttataagaaaagctcctaggtataaaatgctacatagcaggaacttggtttttcaatgttattatttcctactgtttttgacgtaacggcaataaaatttgtttgaaccaaaatggactaacaattatttgtacaactcagtattgtctaaatatcatattgttaaatctaggtttcttgaattctccatcaagcctggtcatgtcatgtagcatttggtgtctcaccatgcccaacagatattttgtgggaggatggagttgatcttcctcatgttaaaagattgaagggagtgttctgacttaattgataacagtctttcataacttcacaaatttttgagaatgacccaaggctaactgtgggaaaaattcacataaaaacatagcctatctatgaggagcaaaactatatttcagttgtgggctttacatttcatttaaccctcttaactgtcctgtgaaatgggttacagccttattttatagatgaggaagctgaagtttaagggatttgcatacggtcacgtaactagtgagttgtgcagctagggttagaataaacagatttattttttttttttcttagaaacagcaattaacaatgtgactcctaatcaaaagaaaagagatgtccttggggcttaaagtactatggtgggagtcttggactgagtaggtttgaaaatacaattttatgatcgtggagtactaggatttagtcattttgatgcagagcatttcctgatcaactgctgttgtggagtgtactgtccaatagaattctctacaattaaggaaatgttctgtatctcaagagattgttcttaatggtggccagtagtcatgtgaccgttgagcatttgaaatgtggctagtgctactgaagaatggaattgtaaattgcttttaatctaaattttgcctgtgatattattggctgtgggtttgccaaaatttgtttttttaaagaggaaaagataacggactgttggctgctttattggacagcacagctagcatatagatgcagataggtagtataacttgtttgtagtttaatataaatgttgtattttgtaattaggccaaatttgagtttcatcatggtgactatgaaaaacagtttctgcatgtactgagccgcaaggacaagactggaatcgttgtcaacaatcctaaccagtcagtgtttctcttcattgacagacagcacttgcaggtaagcagcttttttgaaaaccacttacaggctcattcaaaaacttattggttagtaaacgttttatatacaagttacttaattgttgtgtcccccaaacactgcattatttttgaagttatttaaaaagcaaaaaataggctgggcatggtggctcatgcctgtaatcccagcactttggaaagccgaggcgggcatattgcttgagctcaggaattccagaccagcctgggcaacatgacgaaaccccatctctacagaaaatataaaaactagccaggcatggtggcgtgtgcctgtagtcccagctactggggaggctgaagggggaggattgcttgagcttaagaggctacagtgagatcttgtcactgcactccagcttgaatgacagaacgagaccctgtctcaaaaaataaaatgaatttttaaaaaagtatttcccaggcctcactgtagaacaatggttcccaaattttgctgcatgttacagcaacctggcaagccttttttttttttttaaacgggaaaaaacccacctccttcgaagcttttaaaagtcatgattctagtgaacagtagtgagaactattgccctaaagcgtgtctaccagatgtgtgggcaatggatgaacatcacttgagaacttgttaaaaatatagactctcaggctctactaatcagagtctgcactttaaacagaaccctcaggtgatttgaaacacactttgtttccagaagcactgacctggacgtttttttttttcttgagagggagtctctgtcgcccaggctggagtgccgtggcgcaatctcagttcgctgcaagctccaccttccgggttcacgccattctcctgcctcagcctcccgagtagctgggactacaggtgcccgccaccacgcccagctaatttttttttttttttgtattttagtagagacagggtttcaccatgttagccaggatggtctcaatctcctgacctcatgatctgcctgccttggcctaccaaagtgctgggattacaggcgtgagccaccgcaaccggctgactttttaaatctaaaaggatgagggacatatatttaaaagatccacatttatttcaaataagcacttccatttgggcacagtgtctcacacttgtaatcctagcattttgggaagccgatgggggaggattgcttgagtccaagaccagcctgggcaacagagtgagacgacatctctacaaaaaatcaaagaaattagccggacattgtggcgtgttcctgtggtcctagctactctggaggctgaggcaggggagaatcacttgagcccaggagtttagagttgcagtgagccatggcaccaacacactcctgcctgagtaatgcagcgagaccccatctcaaaaaaaaaaaaaacaccgccaacaacaaataaccacttcccagttaagcagcaatccaagtattgcaatttagtttttagatgcagccacttgctggctgtatgatcttggacaggtaactgctgtgagcatgttgcttctgtgaaattgaacaaatgataatcctaaggttgttaaatttaacgtaaggttgttacatttaaaattaactaatacaagtaaagtatattacatatgtataggtttatttacatttgtaggctacttcagacatcttcaaagtcagagtccttattttgccttttagaggtgctagatagtgaagaaaagatgaactttgtaattaagttggatgttcaaatggtaactactttttaaaaataagggttttgatttaactggtaatactttggcttttttctagtcccttaccccaggatatgcttaaatcttttatttattttttgagacaaggtctcaactctgtcaccacgctggagtacactggcatatggatcatggctcaccgcagccttgacctcctgggcgcaggttatccacctcagcttcccgagtggctggactacaggcgtgtgccaccacatccagctaatttttatattttttgtagagatgggttttcgtcatgttgcccagaatggtcttgaactcttgggctcaagcaatcctcctgactcagcctcccaaagtgctgggattacaggtctgagccaccacacccagccttaaatttttacctattccttcatcctctcactagcttctattcttaccacatctgctttatcttcctctatataaaaatgacttcaaacttctcaaaatctgtccccatgaaatgcctttagctttaatttcttctagcaagtagtctctggtttacttccctaactttttatcttctaattctgcataaatttttcctttatcttatatggcaagattttgtctgtctagaatatggatagggactacaatttgtcccttactctgtatgttaagatgtttaataaattgtgggaaatggacttcatgtgacagttacgctaaagtcttatttttaaaaaatattaaaatgttttccccttccagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttggtttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctcttaatttaccatgttgaattaatttaccatattgaattacacttatgttcaccaagttaggcattttggcagccattgtttacgtttttattttggaataatttagaaaagttaccagagtaatatgaaagctgttgtgtaatctttaccctcatttttattattttgccacatttttttcattttctctgtacacttatacctgtgagctatttgagtttgttgcacactttgtgcttccttaccccttccttagtacttcggcatatgttccaagtacaagaatatttcatataactagagtaaaattaccaaactcagggaatgttgatactctttatcatccatattcgttttgttgtcccagtatccttggtagcttgttttagatccccccctctagagtacaggatcattgaatttagttgttctcagttgtctttaatgtggaacagttccttagcctttatgtgttccatgacctctatgttttttggagtacagggcaatttttcttgtaaattgttactcattttgcatttgaattgtttattcatgcttaacgcccttctcaagtatactctccatctgctcttcattgatgttacttttgagcgcctggtcaaggtgtcctggttttgccctatgtgtggtacttactactagcaatctctgggaagcaatgtgcaaataccctgttcctttatcaggagctcccttggcgattctttccagactaaaacccaaaccagtctttaactatgatggttacaaaatagtgattttccaaatctaatgctttgtccatttacagcatttgttgtaagagagtgttctatctctgccatttattatctacctaaacactatggcctcatattttttccctccaaatcataatttgcatgcctttattattttgagcatctcctttcatgcataagatactgtaacctttctgtcccagcctcaagccctggagtcagctgtttctccaaggagcccagcttccttttagtgggaaatactagaagtaaacatctgggactcctgtatgctcactgctgctattgctactgtggagtcttctgccctttcacagtggacagatcagcaggcgatctaatgtagggaaaggatttgtctttaactgttaacttgacttaaatttacttaaagctgcatcctttttagtctttagtcatgaaatgttcattaagattccctgacagaaatcaagtaagagtcagctgggtgcagtggttcacacctgtaagtccagtacttggggggccaaggcaggaggattgcttgagcctaggagtttgagacgaggctgggcaacagtgagaccttgtttctacaaaaataaaattaggcgtggtggcacacgcctgtagttccagctactcaggagactgaggtggaagaatgtcttgagcctgggattttgaggctatgggaagctgtgattgtatcactccagcctgagtgacagaagctgtctcagagtgccacagtcaactgaacttggagacttctgagaagtgaacttggtcttttcaatactatagacttggaggtttgagatctgcatggttttattctcggtacaagaaaaggggctagtagcatgctttttttcttccccctctattggaccatttcctgtaacactaacatgcttagcctcaaacttttcttgaggtcttttttaggcatatggctcaatctattttatttttcaatatgggctgtagttcatatattttgaagtttcataatcttaaaaaaaggaaatgcaagtgtagcttggcattttagatctgggaaggacctaagattcgctaaggattggccattgctgtggtctccatgtgtttcccctaaatttgtatgttaaaatcccaacccccaaggtgatattagcaggtgggggtctttgggaagttattagatcacgagggcagaaccctcaagattggagtaagtgcccttacaaaagagaacccaggctgggcacattggctcacacctgtaatcccagcactttggggggccaaggcaggcggatcacctgaggtcacgagttcgagaccagcctggccaacatggtgaaccctgtttctacaaaaaactacaaaaattagctaggtgtgatggcacatgcctatagtcccagctacttgggaggctgaggcaggagaatcacttgaacccagggggcagagattgcagtgagccgagatcgtgctgctgtactccagcctgggcaacagagcgagactccatttcaaaaacgagaacccagagggctcacttgccccttccaccacacagtgagaaggcaccatctatgagccaggaagcgggccctcacctaacaggatctgctgggccttgacccaggactttccagcttctagaaccatgaaaaatttctgttgttcctagcagcccaaacagaattagaaccattaatttctatttctcctttagcttaacactggactttagttttaatcttaactgagagtggtcctgctagtttctttgctttacctgtttttaaaacactttgagctaagaatttttcacccaattatcacacatgattagaaaacaagatgcttaaagtgaaaaaagacacccccacctttaccctacttgatatccaggtccttttcctccaagaatatttctagctgcttctggttttgctagtttatttcaaaaattacaattgtttgagtcaaatctatacttgatattcattgttgggtttctttaggtcattctgctgttctctcagtttcccaggtgttttgtgtgtcttccttgtgctattaattttcctgtggccttgttggtcagatccacagaggtaaatgcaagtgtttttccttgcttcagaacatgtgctgtaatcactatatcttctcctaattttgcaggtgacatgtaccttgaaagaaaatgaatatagttaacagcagataatttttcaaagggaaagttgtgtgcatctcacaacagtgttcctatgtaacttattttactcctaaaaatagttttaacggtagtattggtaagctttctgtactatcaaatgtgaatggctggtcctaaccaggttctattttacccattccttacccacacaagtttcttttcccaaatatgtgagaagaggttttcttgcctccccttttttccctttacatttcccacttcacatttatttggggctggtgaaagatttcctccagctttcatttaatctccttaacttcttagatgaaatatcacttggtgtctgtatattgtcctatccatatttacaatttatttgactctaaaatgacaatataacaactataaggaattgatatgatgtccttacaatcttgatgatggactgtctatatttttaagagatgtacatcctagtcacttgtaatcataagttgtctttaactcagctggctccagctaattaaaaaaaaaattggggagatgaggattgtttaaaacaaatgttaatgttttaaagggaaataatttccttacagtttatttttatgtttctgctttttagaaagaaacctttaaaaaggatatgtatttttgccatattcaaaataagacttcagtatttatggctaggaggtataagaaaggtggatctggccgggcacgatggctcaagcctgtaatcccagcactttgggaggccgaggtgggcagatcacctgagggcaggagttcgagaccagcccggccaacgtggtgaaaccccgtctcaactaaaaatacagaagttagctaggcatggtggtgggcacctgtaatctcagctacttttgaggctgaggcagaagaatggcaggaacccaggaggcagaggttgcagtgagccgagatcgcgccactggactccagcctgggcaacagagcaagattccatctcacaaaaaaaaaaaaaaaaaaaaaaaaaaggtggatcttattgctggaaagaacaggcttgtctttaattcacatacctcaatgtaaagaaatgaaaaatagtatgtttagtagtagtttggccagtttttattatttccctaaattttgtcttagaaatcaagaattttggctaacagccattaacttaaactgagggaagataaggaaccctttgtgctacagatgagtaaacattaagtccggggaatttggagattgacattttgtcagtaatactctaaaatttccccttttgttgttttggaacctcgcttgtttttaacctaagtcacagtctaacaggcatcctcagtctgtataatataggacttgatgtgcaggggtggagtaaatttggtaccatgtcaagtaaatcaaagagtgaatcatgaagtgttaactgactgaaacattattcatttacttttgaaatatctctaacttttgaaagaccatgtcctagtttttgttgaagtgaatcagtttttgaagcgtaggcagctcttgatggccaatgcttttggcaacacatatttgaaaggccaaaactatgtttgacttactgaaaattccttagggttctaaaggcaaaagtaccttagtagatcatgaaatgcagtgctaggtttgaagatctctctgctcttaatagagacttttagggaaaatcaagtcatctactgatctcacctcttaccacatgaaataaggactgctgaatatgcacaccagtaacataagcagagcctttcttttctgtacatcttaatttcaaaaagagcatttggctgcatcttgtaatttgcttattgtaccctcaatttaagttattcccatgaagagggactgaatgtttcttaagtaaacttgataaaatatttagattccttaaaagcctacattggctgggcgcggtggctcacgcctgtaatcccagcactttgggaggccaaggcgggcagatcacaaggtgaggagatcgagaccagcctggctaacacggtgaaaccccatctctactaaaaatacaaacaaattagtcgggcatggtggcaggcgcctgtagtcccagctactcgggaggctgaggcaggagaatggtgtgaacccgggaggcggagcttgcagtgagccgagactgcaccactgcactccagcctgggccacaaagcgagactccgtctcaaaaaaaaaaaaaaaaaaagcctacattatttccattaccctcatatctactcacaatggctctctcaacctgacctctcagttagttacatttttgttgcttaggtggaaaaagcagttgtcttgaaactaaatccctgtgcccagctctttctttattgaatggggctgcagtagtaccagtttatgttggaattgagtttcttacattttggaagtttgaccctgaggggcactgttccctgatcatgtagtttaactcacagaacatgtctgtgtagtcacagggagagatccaggattgctgcccattcttaaaactcaacactttgggaggctgaggtgggtggacactggaggtcaggagttcaagaccagcctggccaacatggtgaaaccccgtctttactaaaaacacaaaaattagcccagcatggtggcgcacacctgtaatcccagctactagggaggctgaggcaggagaattacttgagccccagaggcggaggctgaagtgagccagattgtgccgctgcactccagcctgggtgatggggagactccgtgtccaaaaaaaaaaaaaaaccccagcaatggtgttcagtttgttagagtaagattataatgtgtatatgaactctaactttactttgaattgtatgtactcaatacaatcctcatagtgttataagtggtatttttaaaattaaataatatttattttttgtagagatgggggtcttgaactccaggcttcaagcaatcctcttgcctcggcctcccaaagtgctgggattataggcgtgagccactgcgtctggccctgaatggcacttttaaggactgtatgaaacagttatgagccatcagtttgtgatttttccccctgcatcagtatacacattaaaagctgaatgttgctcttttgaatgtttgggatcattccctttttactattgatacacactgtacttgcaaattaactgctctagttctagattttaaggctggaatattttaggacaaaatctataggtgcagttaaggagataagcagctaattgaatctcatgcgttactaataatataaatgtgtttagtctcagttgtttagacagttatcacacagaagggatttggaatacagtttggatacatacgttatgttcatatcgacactgactccgggtgctcccctttccgtgcatagcagagccattgttgatatgttatctactaacgtggctgtcaaaccgccgtggagagtgcctattgcattggtatgctcttcttctactttcatttcacaaatcactttcccaggagcagcagagacaagagtaatct

SEQ ID NO: 7268 - DNA, 1346 bp, Homo sapiens
ggaaggcctttttcagtctcactcaaaccttttttcagtgtggttaccggttcttgcacccaccctggttgcttaccatattgcagctttgttacttgaatagtatttcagtttttaacacatttgtttttgtgttggttctgtttcctagtatggctgttttttttgttttgttttgagatggtgagatggggtattactctgtcatccaggctggagtgcagtggcatagtcatggctcactgcagccttgaactcccaggcccaagtgatcctcccacctcaacctcatgagtagctgggaccacaggtgtgcaccccatgcccaactaattatttttgtagagataggatctcactgtgttgcccgggctggtctcaaactcctggcctctagtgatcctcccgctttggactcccaaagtgctgggattataggtctgagccaccatgcccagtcagcgtttatcagattacttaccattactactttgtcctggggaaatcctcttaatctttaaaggcgcaatccaaaatcataatgttcccgtgttacttactgttacttttttttttttctcctatagtggtttgatgataagaacccaatttgggccgggcgcggttgctcacgcctgtaatcccaacactttgggaggctaagccagatggatcacctgaggtcgggagtttgagaccatcctgaccaacataaagaagtcctatctctactaaaaacacaaaattagctgggcgtggtggtgcatgcctgtattccagctacttgggaggctgaggcagaagaatcgcttgaacccaggaggcggaggttgcagtgagccgagatcgcgccattgcactccagcctgggcaacaagagcgaaattccgtctcaaaaaaaaaaaaaaaattggagttttacagataaccacatcttattctgggaaaggatttgaagcaagttgggttttatatttggctgtacttgtcctcttcagcagtataataagccccttaaggctgaagtaaccttattcctattgtttagtagctaatagcatgcttttgatatgcttatgatcatactaataatttaatatttgaattgtatggaagtacaattcagtatcattttacatatggtatattgtgatgctgtatcatattttatgttacggtttataagaaaagctcctaggtataaaatgctacatagcaggaacttggtttttcaatgttattatttcctactgtttttgacgtaacggcaataaaatttgtttgaaccaaaatggactaacaattatttgtacaactcagtattgtctaaatatcatattgttaaa

SEQ ID NO: 7269 - DNA, 2177 bp, Homo sapiens
caaaagctgacgacttcggtctgcgccggaagtgcatgagctgccgatgtggtgcttagtgattgcggtttcggtcgctctcccgtgtttcccgggctgggtatttgcctcgcaccatggcggtaaggaggatggatagggcggggtccgcaccagcaaagctctccaggggctgtgagagtgaaaactgagaaagaacattaagggatatggggtgggccagagcggggcgccatccctggccagaccgtgctagagctgggctggggggatggcggcgcaggaccataccaggactagtgccagagcggggtgggcatcagtaccagggcaggccagagatctaagtgacctgaggtgggggttaacccagatcgggactacgccagcggaggcctgagagaggcaccattcaactccgctcaggagtacccttggaagagtcgttagcctaaagccagactaccacgggatccagaggcggtattagcttaggattgaattgttccagggcgagcaagaggcgattgatcctagctgcgggtgctggagagatggcgtcagccctaggcagaatggactggaggatgggtggacatcccagggattttgctaggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgtaagtgcctacctccttgcttctatgcccacttatagtcagttccctagtcctcagccctgcttggtgacgaggagtggtacccgaaaaagctctagaagagagctccagtcaaaaagaaatgagagatctgggcacagagaaagtgctaactagtaaaacacaaagaaaatgaaggcgtgagtcgtagctgaatttgagagctcttcctacctccaagtacacaaaggcttctttcctgggctgagttgggtgtcagaggagagtgggtatttgggattcagggagcagggccctttcttcaaccctgtaagaacaaccttgctcctcccacagcctggcctaattcttggtcagagttgagggagacccatggtttggaggtaacttctgaccccaacctgatcctgtgattgcttgcaggccatttactgccttgtgacgttggtcttcttttactcatctgcctcattttgggcctgggtaagtatctccatcctgggaggtggatgagtgcgtagggtcagtggctggcctttgataccctcattcttgctctgcagttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggtgagcggccccagggctggggcccagatagcccaagaagcacagctacttgtaacttgaaaagggtggaagggagttgcaacttgaaaagggtggaagggcccatatgctgtctttccagctttatttctatccacaggcaccttaaggatgtgatcctactgacagccatcgtgcaggtgctcagctgcttctctctctatgtctggtccttctggcttctggtatgtgggctgggggcgctcccaagaaggggcatctaaccctccccatcttttattccctgcatcttgcttcaagttaccgtttctcttgtaggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgg

SEQ ID NO: 7270 - DNA, 2177 bp, Homo sapiens; identical to SEQ ID NO: 7269

SEQ ID NO: 7271 - DNA, 8925 bp, Homo sapiens
gttggattagctaagaaaattttattttgctccgtgcgttcaaggagctcacacacatgcacatgcatatgcatgcacacacacacatacacacacactcacatgcatacacacacggctaatactgctcaaggcatggctcctgggcacagagttctggggccagaattctgctctgggccctcctcactctgtcatctcctgcactgcagtccagggtccagatagatttccgggatacagcaccttcacacctccaggccaggacccttgcttagtcccagtgcctgcaccaggtcatctccgagcccactcttcaacgtccttctcactgcagggacagagcagggttggagggggttgatggggttcaggtgggcagtgggattgtggggggttacttacaagacttgcggttgccgcgggaacgcttgcgttccctagcagctaaggcacgaggactgctcttggtcactgactgcaccagaaggtccatgatctcatctgatgtatcactgggtaaactggagcctgggggttcttctggggatgcagtggagggccccactgtgggcatgattggggagctgctctggaccatgcctgaggaaggccagatagcaaagtcaggccaaggtggcactggagcccattccccacagctgctatgggcctcacctctgctgcggcgattgtgtgtggtgtcctcaggcctgctggtcagcagactcttcatactagcatgactgtcagcatctccccggcctggcccgctgctcactgctactgggacagaggggttgctgggggcttccccagccacacctgagaacttctctgtctggagaaagaagaagggtgagctgggaggagcgaaggaaaccaaggaggtggcagtcaagactaagacctggaagggcacccacctcggtgatcatgcgtccccgggtcttgttgcgctcacggtatgtggcctgcttctgctgctgctgtagcactcgttcccggcaagtccgatactcaagcgcaaattcccgcagcgtgtggcagaactgcatgatgcgcacttcacgggccgcctgcggggtgtagcccaggtagagcaggaaggcatggaacctaggcaggtcagagtagggagggacagtaagtcctgcttattgtctgagggagggtggtggccgtcctgcctctcttgggtccatgcccctacctattgcagacacggcggtgcactatccttagcatggcaacacggcgggcacactggtccaggaagtgggtgaggcgggcacgcagggctggggccagctcatgcttggccaagctccgcaggctctcctcggctgcccggctccggcgctccagctgccccaggttctcagtcagctgttcaaagtccacctgagaaagcaagggggtgcacatactgtccccccacaccctgtagacaagacatggcccgaggctgcttctgggccagagtggccagcttgggccctaaggacacagacatccaaatctcatagactagtgcaagagacacaagtccatctgatgtgaatggggagcagaaggtttactgggggaagtggcagttaaacagacccaaagactgagtaggtgtggccaggccaatagaggaaagagcatttctggcagagggcatagctcacacccaggtggctggagcaagccctggcacagcagcccaaatggggagaagggggaggagccaggcccaggaagcagcgctcctcatgccttgtccggccttggttgattctggcaggtgctaaccttggcacagcgggtcagggcagggatttctgaatagaggtcagaggactcaggccgggtctggagcactagggagcagagatggtgtagcagtgactgtcgacgcaccgtgtccttcacctctgacaccttctccaggtagctcagctcaaagccgctgctctgaaaggaccctttctgagcctgggcctggttggctccagaaccctgactccccctagtccccatgtactctcactcacctgggagccattgaggaagttgcccaccgctaggagggtagccaggatgcagcggaaggtggcattctgtaccagctgttccatacccactttcaggtcaaacagtggctcagcaatttcctggtatgggagaccagggactctcagactacatggtcatgatgcttacctgtccctactgactgtcccactccaagacccaggtacccgctccatgctgtcatagtccagcttgaaggcccagagttgtagacgagcagcgaggccgccaatggaggcaagagtcatcaggaagttctcggctgggcccaggggtatgtcagggttggccagctgggcttcctcaatcttctgccgctcttcctccgtgggcatcatggtcagtagcttctgaggatgtagccagagcctgacatggccccctcaatgcaggcctgaggcctgaggcattggtcttgacccctcagtcatctaggggaggccccagtgtctggggactgccctgcagaaatgccaagcccatgcccaccaccagagggacaggaaatgcccacctaccaaaggagaaggccagacctccccccaacacccatagctgggtgacctcacctcaatgccatccttgctgacagcaaactcatcaaagttgagcagagcagccttaatgacatgcacaggtggcagtgtggttaggccgatgttgatggcgttgctgcgcttggggtccagcactgtggtcattgtccggcggccctctccagctttctgcatggttgggggaagggcagtgtaagactgaggaagggggcctgacgcggtggctcacgcctgtaatcccagcactttgggaggccaaggcgggtggaccacgaggtcaggagatcgagaccatcctggctaacatggtgaaaccccatctctactaaaaatacaaaaaaaattagctgggcgtggtggcgggcacctgtagtcccagctactcgggaggctgaggcaggagaatggcgtgaacccgggaggcggagcttgcagtgagctgagatcacaccattgcactacatcctgggtgactgagcaagactctgtctcaaaaaaaaaaaaaaaaaaaaaaagactgaggaagggactagctgggacagcaacctcagagggcactccaaggccctcctctagattgccaaatgatcccacaactgacaaactggcaacctggaatgtgtaagtcatggggatgagcttagattcttttgagacagggcctggctctaccatctaggctggagtgcagtggtgccatcatcgcccactgcagcttatcttctgggattttcctgcctcagcctcccaagtagctgggattacaggcgtgtaccaccatacccaactatttttttttttaacatttttttttccgcctcccaggttcaagcaattcttttgcctcagcctcccaagtagctggtattgcaggcatgagccaccacgcccagctcattttcatatttttagtagagacggggtttcaccatgttggccaggctggtctcaaactcctggcctcaagtaatctgcctgccttggcctcccaaagtgctgggattacaggggtgagccaccatgcccggctaattttttttttaacatttatttatttttatttatttagttatttttgagacgaagtcttgctcttgtcccccaggctggagtgcaatggtgcgatctcgactcactgcaacctctacctcccgggttcaagtgattctcctgcctcagcctcccgagtagctgggattacaggtgcccgccaccacgcttggctaattttgtgtttttagtagagacggggttttgctaatttgaccaggctggtctcgaactcctgacctcaaatgatccacctgcctcggcctcccaaggtcctgggattacaggcatgagccactacacccagaccaacttttagtagagataatgtctcactatgttgcacaggctggtctcaaactcttggattacaggtgtgagccaccatgcccggccacatttagattctagttggggcactgctgatcccttgttaggagaccttggacaatttcctactcctttctttgccttggtttccccatgtgggaagtgagtgactagctccaacaggtcagatccttaagctctgattccctcctgcctcccttggggctaccttgcagatgagtggatttaccttggagggcagcacctctttggcacgagactcaaagaggtgttccagtcgggccgtgtccactgagacagggtccagtgaagcccagagggtggcgcagggcccaaagcggcttgcagagactccatggcccccagccagcttcagctcacgccagaaaagttttactgtcttcctcttagtggggagggctgagctgtcaggcactgaatggggaagaggggcagccagaggtagaggtggaggtggtgggaaggggcctttgatgggtgggggaggtggaagtgggggaggggggggtactcccgagagcaggggcagtgggggtgagggagctgggatgtctttcccagcctccacagactctacattcagcatgtcctggtcttcatcctcccctagatctgaaaagtccaggtccccaatagagagcctgggtgcacgggtagggagctcccagatgggctcagccttggggcttgctggtatcagtggctccttgggctctggtgcaaggcttcgctgggcccggagcaggacacagggggcagggctctggggtgttctggctgcaggggctgtctctggggagtcccagagttgccgggcatctaaagaaagggaaggagctgtcagtgccatgccccctgtggggcaacaaagcaacaggcaggctctgcctgctcacccacctactcacctgggtgtccacccgcctcattgggcatggccccggcaagtgtctctgcccggccctgggccagcgcaacctgcttctctgtttctgctgccgccacattctccaggaaccgggctctgagggaaggtgcttgtcactgacagcgtctgacacaccccagcccaggtgtacatgccttgctgagcccctggacaccacccccaattgcaggcacgcacagacacacagggaacagtccatgcgctgagcagaccagaaccacaccccccccaaggccagcccctcttcagtcctccacatctggggaggattactaccaacccagcattcccaggtgaaaacacagggagaggatctacttaacatctaacttgcaacctcgttcatgttcactgtcctggtttttttttggttggttttttttttagagacagggtctcactctgtcagtcacccaggctggagtacagtggtgtgatcatagctcactgcagcctcactctcctgggcttgaccctcagcctcccaagtagctgggactacagacatgtgccaccacgtccagctgattttttaatttttttgaggagacagggtctcactgtgttgttcaggctggccttgaattcctggcctcaagcagtcctcccacctcagcctcctgaagtgctgagattacaggtgtgaatgatgcacccagccaaattttaaaaaatttctttgtagagatgaggtcttactgtgttgcccaggctggtgtcttgagtctagacaaggactcttagagcaggggaaggggatagctgtcccaatgggcatatcaggctgtccctcccttggcatgtctggtagcttctgggagcctatgcccaggaaagggcctggtaaacaggccaggtgcggtggctcacgcttgtaatcccagcactttgggaggcagaggtgggtggattacttgaagtcaggagttcgagaccagcctggccaacatggtgaaaccctgtctctactaaaaatacaaaaattacccaggtatcctggtgcaggcctataatcccagctacttgggaggctgaggcaggagaattgcttgaacctgggaggcagaggttgcagtgtgctgagatcacaccactgcactccagccttggagaccgagcaagactctgtctcaaaaaaaaaaaaaacaaaaaaaaaacggatgtggtaaacagtggaccctcagtttatgctgaaataatgggtgcaatccagtgtttcttttctggcccctccagcctctgtcagctctcagtccctgcctttccctcagccttaggttacccctccacccccacaccacacaccacacagcaccctaggtcccctccctgctcgcttctgagctgaagacttggcagaatgagccccaggttgggtgtccacatccccatctctggctgctaaggtgttgctattgaagcacagggaccactgtgaccccagtgaattggttcccagtgcttagcctttgggttaccgaggaggcatatgtctgggagaggataggcctgagtcccccagctttggttgcatcaggcacgtgaaacccctgctgggggaagcaatgctgaagccctgagcacatggcaggcctggcaggccggcctctgtacttactccagcctggcctgcccaggaggggactgggggacgggtgggctctcaggggccctgggtaggggggatgagaggaagagatggtaactgtggtgtcagctccatggttgctcatacccacacagagctaggcagtgatattggggttccttcccagccgcagtgggaagtgggggaaggtatgacacgaggaaactggaagtggaggggagagactgacgtggagcaggacagggtgctggaagagacagaggcagcagaacaagggagtgacagatagtgggcgggagacatgacaagaggcaaagacaggcagaacgtcggaggagacaaaggaaaccacaggaggaggagatccagtcagagccgaaccccacccgctggcagtcacttaccaaacggaagcagtttggtgaagtctggaaagagagagagagaaagcacgcgtttgggcagaggaggctgagtgcccatggaggggcgcaaagcggagggacaatgggagagaggactccagggtggcctctgtctccctacttacttgtagatgctcctctcgctggaggtgtcagctgagggtgccacagagatggtaggaaaaaggttcactgaagcttggagaccggagggagggcccacagggctggaggcggggcctgtcagcagggcggggccggtggaagaggtggggcctaccggtgaggcggggcctgtggggctgaaagcaggggctgtcagtggggcggggcctgagaagctggaggcggggcctgtcagtggggtggggcctgcggggcgggaggtggggcatgtcggtagggcaggcccagtggaggaggtgggggctgtctgtggggcggggcctgagggggttggggtcagggcctgtcagctcactgggccatgcctagtagatccaccctttcccatctacagatgctcgtacttacccaggttccggggcacgcgcggggcagcccccgccttccagagaacggcggctcctcttgccctcctcagaagaaggctttcgtcgttcccgccgcccaccagcgcctggggcttcttcgatgtctccatcctccaatttcagggcgttctagcagaggcggaccaggatgtaagaaagtggttaacgtgtatgcaggtggggtggggcgctggggactgcgcttctctcttccctctttccaatccgcctcagagcgtaaggcccggcccacctcgtagagcacaagctgcgtgcgcaggtcgacgtcagtgcccgcagtgcccaggtggcgctggaccagcgcttccatgccctgctgctccagtgcatccgtcacatcgtagaaggagtcctggtccgggagcgccgccagcgtctggagggcggggataagaaggcaaggctgaggttggtggggaggtcaggagcctgagcatcccagagctggcacccagtccttggccacaccttgttgatgagggtgaccgtgtacaccaacaactcagggtcagcgccattcttctcctccaggatggacaccagattggcccagggaggagcacctgccacacagaaagtggagcagtcatgggggaacaggtaggagagagggctctgagcggtggggggagaaagggacagtctctgaccggtggtgctggccacagagttcactgcacggatgaacagcggtgcgttgttttcggagtattctacaaacaccaacagcagcttcagggctgtcttcaccaccaagcgggactgaggagagaggtcagtacatatgagtggggcttaggccagacctgtgccagctgttgctggggaaggggaagggctgctggggctggacccagagagaatctaggcagaatgaccctggccccaggcccaggcactgaagtgccttataggcttacagaggcctcagactcactcccttccagctcactttgcagaacaggaaactgaggcccagagagaagcaacaggcaaagggtataaggctgagtggagagccacttaccaggctggcacacaatgtgtacagccactgaatagtgtcactgtgggccaccacccccagcattccatccacaaagagcatcagctggccgagcgctggggaaacagggatgggcagagtcagcgagggtcgctggagcagaggtcatgggagaggggcggggctgacctctaaggatgtagctctggtagttgtggtcggcagcagcacccacacggatcaggcagctcagcccctctgaatgcacaaattcaggcaccaggtctttgtcctcctaga

SEQ ID NO: 7272 - DNA, 8924 bp, Homo sapiens
gttggattagctaagaaaattttattttgctccgtgcgttcaaggagctcacacacatgcacatgcatatgcatgcacacacacacatacacacacactcacatgcatacacacacggctaatactgctcaaggcatggctcctgggcacagagttctggggccagaattctgctctgggccctcctcactctgtcatctcctgcactgcagtccagggtccagatagatttccgggatacagcaccttcacacctccaggccaggacccttgcttagtcccagtgcctgcaccaggtcatctccgagcccactcttcaacgtccttctcactgcagggacagagcagggttggagggggttgatggggttcaggtgggcagtgggattgtggggggttacttacaagacttgcggttgccgcgggaacgcttgcgttccctagcagctaaggcacgaggactgctcttggtcactgactgcaccagaaggtccatgatctcatctgatgtatcactgggtaaactggagcctgggggttcttctggggatgcagtggagggccccactgtgggcatgattggggagctgctctggaccatgcctgaggaaggccagatagcaaagtcaggccaaggtggcactggagcccattccccacagctgctatgggcctcacctctgctgcggcgattgtgtgtggtgtcctcaggcctgctggtcagcagactcttcatactagcatgactgtcagcatctccccggcctggcccgctgctcactgctactgggacagaggggttgctgggggcttccccagccacacctgagaacttctctgtctggagaaagaagaagggtgagctgggaggagcgaaggaaaccaaggaggtggcagtcaagactaagacctggaagggcacccacctcggtgatcatgcgtccccgggtcttgttgcgctcacggtatgtggcctgcttctgctgctgctgtagcactcgttcccggcaagtccgatactcaagcgcaaattcccgcagcgtgtggcagaactgcatgatgcgcacttcacgggccgcctgcggggtgtagcccaggtagagcaggaaggcatggaacctaggcaggtcagagtagggagggacagtaagtcctgcttattgtctgagggagggtggtggccgtcctgcctctcttgggtccatgcccctacctattgcagacacggcggtgcactatccttagcatggcaacacggcgggcacactggtccaggaagtgggtgaggcgggcacgcagggctggggccagctcatgcttggccaagctccgcaggctctcctcggctgcccggctccggcgctccagctgccccaggttctcagtcagctgttcaaagtccacctgagaaagcaagggggtgcacatactgtccccccacaccctgtagacaagacatggcccgaggctgcttctgggccagagtggccagcttgggccctaaggacacagacatccaaatctcatagactagtgcaagagacacaagtccatctgatgtgaatggggagcagaaggtttactgggggaagtggcagttaaacagacccaaagactgagtaggtgtggccaggccaatagaggaaagagcatttctggcagagggcatagctcacacccaggtggctggagcaagccctggcacagcagcccaaatggggagaagggggaggagccaggcccaggaagcagcgctcctcatgccttgtccggccttggttgattctggcaggtgctaaccttggcacagcgggtcagggcagggatttctgaatagaggtcagaggactcaggccgggtctggagcactagggagcagagatggtgtagcagtgactgtcgacgcaccgtgtccttcacctctgacaccttctccaggtagctcagctcaaagccgctgctctgaaaggaccctttctgagcctgggcctggttggctccagaaccctgactccccctagtccccatgtactctcactcacctgggagccattgaggaagttgcccaccgctaggagggtagccaggatgcagcggaaggtggcattctgtaccagctgttccatacccactttcaggtcaaacagtggctcagcaatttcctggtatgggagaccagggactctcagactacatggtcatgatgcttacctgtccctactgactgtcccactccaagacccaggtacccgctccatgctgtcatagtccagcttgaaggcccagagttgtagacgagcagcgaggccgccaatggaggcaagagtcatcaggaagttctcggctgggcccaggggtatgtcagggttggccagctgggcttcctcaatcttctgccgctcttcctccgtgggcatcatggtcagtagcttctgaggatgtagccagagcctgacatggccccctcaatgcaggcctgaggcctgaggcattggtcttgacccctcagtcatctaggggaggccccagtgtctggggactgccctgcagaaatgccaagcccatgcccaccaccagagggacaggaaatgcccacctaccaaaggagaaggccagacctccccccaacacccatagctgggtgacctcacctcaatgccatccttgctgacagcaaactcatcaaagttgagcagagcagccttaatgacatgcacaggtggcagtgtggttaggccgatgttgatggcgttgctgcgcttggggtccagcactgtggtcattgtccggcggccctctccagctttctgcatggttgggggaagggcagtgtaagactgaggaagggggcctgacgcggtggctcacgcctgtaatcccagcactttgggaggccaaggcgggtggaccacgaggtcaggagatcgagaccatcctggctaacatggtgaaaccccatctctactaaaaatacaaaaaaaattagctgggcgtggtggcgggcacctgtagtcccagctactcgggaggctgaggcaggagaatggcgtgaacccgggaggcggagcttgcagtgagctgagatcacaccattgcactacatcctgggtgactgagcaagactctgtctcaaaaaaaaaaaaaaaaaaaaaaagactgaggaagggactagctgggacagcaacctcagagggcactccaaggccctcctctagattgccaaatgatcccacaactgacaaactggcaacctggaatgtgtaagtcatggggatgagcttagattcttttgagacagggcctggctctaccatctaggctggagtgcagtggtgccatcatcgcccactgcagcttatcttctgggattttcctgcctcagcctcccaagtagctgggattacaggcgtgtaccaccatacccaactatttttttttttaacatttttttttccgcctcccaggttcaagcaattcttttgcctcagcctcccaagtagctggtattgcaggcatgagccaccacgcccagctcattttcatatttttagtagagacggggtttcaccatgttggccaggctggtctcaaactcctggcctcaagtaatctgcctgccttggcctcccaaagtgctgggattacaggggtgagccaccatgcccggctaattttttttttaacatttatttatttttatttatttagttatttttgagacgaagtcttgctcttgtcccccaggctggagtgcaatggtgcgatctcgactcactgcaacctctacctcccgggttcaagtgattctcctgcctcagcctcccgagtagctgggattacaggtgcccgccaccacgcttggctaattttgtgtttttagtagagacggggttttgctaatttgaccaggctggtctcgaactcctgacctcaaatgatccacctgcctcggcctcccaaggtcctgggattacaggcatgagccactacacccagaccaacttttagtagagataatgtctcactatgttgcacaggctggtctcaaactcttggattacaggtgtgagccaccatgcccggccacatttagattctagttggggcactgctgatcccttgttaggagaccttggacaatttcctactcctttctttgccttggtttccccatgtgggaagtgagtgactagctccaacaggtcagatccttaagctctgattccctcctgcctcccttggggctaccttgcagatgagtggatttaccttggagggcagcacctctttggcacgagactcaaagaggtgttccagtcgggccgtgtccactgagacagggtccagtgaagcccagagggtggcgcagggcccaaagcggcttgcagagactccatggcccccagccagcttcagctcacgccagaaaagttttactgtcttcctcttagtggggagggctgagctgtcaggcactgaatggggaagaggggcagccagaggtagaggtggaggtggtgggaaggggcctttgatgggtgggggaggtggaagtgggggaggggggtggtactcccgagagcaggggcagtgggggtgagggagctgggatgtctttcccagcctccacagactctacattcagcatgtcctggtcttcatcctcccctagatctgaaaagtccaggtccccaatagagagcctgggtgcacgggtagggagctcccagatgggctcagccttggggcttgctggtatcagtggctccttgggctctggtgcaaggcttcgctgggcccggagcaggacacagggggcagggctctggggtgttctggctgcaggggctgtctctggggagtcccagagttgccgggcatctaaagaaagggaaggagctgtcagtgccatgccccctgtggggcaacaaagcaacaggcaggctctgcctgctcacccacctactcacctgggtgtccacccgcctcattgggcatggccccggcaagtgtctctgcccggccctgggccagcgcaacctgcttctctgtttctgctgccgccacattctccaggaaccgggctctgagggaaggtgcttgtcactgacagcgtctgacacaccccagcccaggtgtacatgccttgctgagcccctggacaccacccccaattgcaggcacgcacagacacacagggaacagtccatgcgctgagcagaccagaaccacaccccccccaaggccagcccctcttcagtcctccacatctggggaggattactaccaacccagcattcccaggtgaaaacacagggagaggatctacttaacatctaacttgcaacctcgttcatgttcactgtcctggtttttttttggttggttttttttttagagacagggtctcactctgtcagtcacccaggctggagtacagtggtgtgatcatagctcactgcagcctcactctcctgggcttgaccctcagcctcccaagtagctgggactacagacatgtgccaccacgtccagctgattttttaatttttttgaggagacagggtctcactgtgttgttcaggctggccttgaattcctggcctcaagcagtcctcccacctcagcctcctgaagtgctgagattacaggtgtgaatgatgcacccagccaaattttaaaaaatttctttgtagagatgaggtcttactgtgttgcccaggctggtgtcttgagtctagacaaggactcttagagcaggggaaggggatagctgtcccaatgggcatatcaggctgtccctcccttggcatgtctggtagcttctgggagcctatgcccaggaaagggcctggtaaacaggccaggtgcggtggctcacgcttgtaatcccagcactttgggaggcagaggtgggtggattacttgaagtcaggagttcgagaccagcctggccaacatggtgaaaccctgtctctactaaaaatacaaaaattacccaggtatcctggtgcaggcctataatcccagctacttgggaggctgaggcaggagaattgcttgaacctgggaggcagaggttgcagtgtgctgagatcacaccactgcactccagccttggagaccgagcaagactctgtctcaaaaaaaaaaaaaacaaaaaaaaaacggatgtggtaaacagtggaccctcagtttatgctgaaataatgggtgcaatccagtgtttcttttctggcccctccagcctctgtcagctctcagtccctgcctttccctcagccttaggttacccctccacccccacaccacacaccacacagcaccctaggtcccctccctgctcgcttctgagctgaagacttggcagaatgagccccaggttgggtgtccacatccccatctctggctgctaaggtgttgctattgaagcacagggaccactgtgaccccagtgaattggttcccagtgcttagcctttgggttaccgaggaggcatatgtctgggagaggataggcctgagtcccccagctttggttgcatcaggcacgtgaaacccctgctgggggaagcaatgctgaagccctgagcacatggcaggcctggcaggccggcctctgtacttactccagcctggcctgcccaggaggggactgggggacgggtgggctctcaggggccctgggtaggggggatgagaggaagagatggtaactgtggtgtcagctccatggttgctcatacccacacagagctaggcagtgatattggggttccttcccagccgcagtgggaagtgggggaaggtatgacacgaggaaactggaagtggaggggagagactgacgtggagcaggacagggtgctggaagagacagaggcagcagaacaagggagtgacagatagtgggcgggagacatgacaagaggcaaagacaggcagaacgtcggaggagacaaggaaaccacaggaggaggagatccagtcagagccgaaccccacccgctggcagtcacttaccaacggaagcagtttggtgaagtctggaaagagagagagagaaagcacgcgtttgggcagaggaggctgagtgcccatggaggggcgcaaagcggagggacaatgggagagaggactccagggtggcctctgtctccctacttacttgtagatgctcctctcgctggaggtgtcagctgagggtgccacagagatggtaggaaaaaggttcactgaagcttggagaccggagggagggcccacagggctggaggcggggcctgtcagcagggcggggccggtggaagaggtggggcctaccggtgaggcggggcctgtggggctgaaagcaggggctgtcagtggggcggggcctgagaagctggaggcgggcctgtcagtggggtggggcctgcagggcggaaggtggggcatgtctgcagggcacgcccagtggaggaggtgggtggctgtctgttggggcgggcctgagggggttggggtcagggcctgtcagctcactgggccatgcctagtagatccaccctttcccatctacagatgctcgtacttacccaggttccggggcacgcgcggggcagcccccgccttccagagaacggcggctcctcttgccctcctcagaagaaggctttcgtcgttcccgccgcccaccagcgcctggggcttcttcgatgtctccatcctccaatttcagggcgttctagcagaggcggaccaggatgtaagaaagtggttaacgtgtatgcaggtggggtggggcgctggggactgcgcttctctcttccctctttccaatccgcctcagagcgtaaggcccggcccacctcgtagagcacaagctgcgtgcgcaggtcgacgtcagtgcccgcagtgcccaggtggcgctggaccagcgcttccatgccctgctgctccagtgcatccgtcacatcgtagaaggagtcctggtccgggagcgccgccagcgtctggagggcggggataagaaggcaaggctgaggttggtggggaggtcaggagcctgagcatcccagagctggcacccagtccttggccacaccttgttgatgagggtgaccgtgtacaccaacaactcagggtcagcgccattcttctcctccaggatggacaccagattggcccagggaggagcacctgccacacagaaagtggagcagtcatgggggaacaggtaggagagagggctctgagcggtggggggagaaagggacagtctctgaccggtggtgctggccacagagttcactgcacggatgaacagcggtgcgttgttttcggagtattctacaaacaccaacagcagcttcagggctgtcttcaccaccaagcgggactgaggagagaggtcagtacatatgagtggggcttaggccagacctgtgccagctgttgctggggaaggggaagggctgctggggctggacccagagagaatctaggcagaatgaccctggccccaggcccaggcactgaagtgccttataggcttacagaggcctcagactcactcccttccagctcactttgcagaacaggaaactgaggcccagagagaagcaacaggcaaagggtataaggctgagtggagagccacttaccaggctggcacacaatgtgtacagccactgaatagtgtcactgtgggccaccacccccagcattccatccacaaagagcatcagctggccgagcgctggggaaacagggatgggcagagtcagcgagggtcgctggagcagaggtcatgggagaggggcggggctgacctctaaggatgtagctctggtagttgtggtcggcagcagcacccacacggatcaggcagctcagcccctctgaatgcacaaattcaggcaccaggtctttgtcctcctaga

SEQ ID NO: 7273 - DNA, 3357 bp, Homo sapiens
ccggggtcccagttctaaagtccccacgcacccacccggactcagaatctcctcagacgccgagatgcgggtcacggcgccccgaaccctcctcctgctgctctggggggcagtggccctgaccgagacctgggccggtgagtgcggggtcgggagggaaatggcctctgtggggaggagagaggggaccgcaggcgggggcgcaggacccggggagccgcgccgggaggagggtcgggcgggtctcagcccctcctcgcccccaggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccggtgagtgaccccggcccggggcgcaggtcacgactccccatcccccacgtacggcccgggtcgccccgagtctccgggtccgagatccgcccccgaggccgcgggacccgcccagaccctcgaccggcgagagccccaggcgcgtttacccggtttcattttcagttgaggccaaaatccccgcgggttggtcggggcggggcggggctcgggggacggggctgaccgcggggccggggccagggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcgggtaccaggggcagtggggagccttccccatctcctataggtcgccggggatggcctcccacgagaagaggaggaaaatgggatcagcgctagaatgtcgccctcccttgaatggagaatggcatgagttttcctgagtttcctctgagggccccctcttctctctaggacaattaagggatgacgtctctgaggaaatggaggggaagacagtccctagaatactgatcaggggtcccctttgacccctgcagcagccttgggaaccgtgacttttcctctcaggccttgttctctgcctcacactcagtgtgtttggggctctgattccagcacttctgagtcactttacctccactcagatcaggagcagaagtccctgttccccgctcagagactcgaactttccaatgaataggagattatcccaggtgcctgcgtccaggctggtgtctgggttctgtgccccttccccaccccaggtgtcctgtccattctcaggctggtcacatgggtggtcctagggtgtcccatgagagatgcaaagcgcctgaattttctgactcttcccatcagaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggggtaaggagggggatgaggggtcatatctcttctcagggaaagcaggagcccttcagcagggtcagggcccctcatcttcccttcctttcccagagccgtcttcccagtccaccgtccccatcgtgggcattgttgctggcctggctgtcctagcagttgtggtcatcggagctgtggtcgctgctgtgatgtgtaggaggaagagctcaggtagggaaggggtgaggggtggggtctgggttttcttgtcccactgggggtttcaagccccaggtagaagtgttccctgcctcattactgggaagcagcatccacacaggggctaacgcagcctgggaccctgtgtgccagcacttactcttttgtgcagcacatgtgacaatgaaggacggatgtatcaccttggtggttgtggtgttggggtcctgattccagcattcatgagtcaggggaaggtccctgctaaggacagaccttaggagggcagttggtccaggacccacacttgctttcctcgtgtttcctgatcctgccttgggtctgtagtcatacttctggaaattccttttgggtccaagacgaggaggttcctctaagatctcatggccctgcttcctcccagtcccctcacagggcattttcttcccacaggtggaaaaggagggagctactctcaggctgcgtgtaagtgatgggggcgggagtgtggaggagctcacccaccccataattcctcctgtcccacgtctcctgcgggctctgaccaggtcctgtttttgttctactccaggcagcgacagtgcccagggctctgatgtgtctctcacagcttgaaaaggtgagattcttggggtctagagtgggtggggtggcaggtctgggggtgggtggggcagtggggaaaggcctgggtaatggagattctttgattgggatgtttcgcgtgtgtggtgggctgtttagagtgtcatcacttaccatgactaaccagaatttgttcatgactgttgttttctgtagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccccgtgtccaccgtgacccctgttcccatgctgacttgtgtttcctccccagtcatctttcctgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaatctgca

SEQ ID NO: 7274 - DNA, 3357 bp, Homo sapiens
ccgcggtcccagttctaaagtccccacgcacccacccggactcagagtctcctcagacgccgagatgctggtcatggcgccccgaaccgtcctcctgctgctctcggcggccctggccctgaccgagacctgggccggtgagtgcgggtcgggagggaaatggcctctgccgggaggagcgaggggaccgcaggcgggggcgcaggacctgaggagccgcgccgggaggagggtcgggcgggtctcagcccctcctcacccccaggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccggtgagtgaccccggcccggggcgcaggtcacgactccccatcccccacgtacggcccgggtcgccccgagtctccgggtccgagatccgcctccctgaggccgcgggacccgcccagaccctcgaccggcgagagccccaggcgcgtttacccggtttcattttcagttgaggccaaaatccccgcgggttggtcggggcggggcggggctcgggggactgggctgaccgcggggccggggccagggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctggtaccaggggcagtggggagccttccccatctcctataggtcgccggggatggcctcccacgagaagaggaggaaaatgggatcagcgctagaatgtcgccctccgttgaatggagaatggcatgagttttcctgagtttcctctgagggccccctcttctctctagacaattaaggaatgacgtctctgaggaaatggaggggaagacagtccctagaatactgatcaggggtcccctttgacccctgcagcagccttgggaaccgtgacttttcctctcaggccttgttctctgcctcacactcagtgtgtttggggctctgattccagcacttctgagtcactttacctccactcagatcaggagcagaagtccctgttccccgctcagagactcgaactttccaatgaataggagattatcccaggtgcctgcgtccaggctggtgtctgggttctgtgccccttccccaccccaggtgtcctgtccattctcaggctggtcacatgggtggtcctagggtgtcccatgaaagatgcaaagcgcctgaattttctgactcttcccatcagaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggggtaaggagggggatgaggggtcatatctcttctcagggaaagcaggagcccttcagcagggtcagggcccctcatcttcccctcctttcccagagccgtcttcccagtccaccgtccccatcgtgggcattgttgctggcctggctgtcctagcagttgtggtcatcggagctgtggtcgctgctgtgatgtgtaggaggaagagttcaggtagggaaggggtgaggggtggggtctgggttttcttgtcccactgggggtttcaagccccaggtagaagtgttccctgcctcattactgggaagcagcatgcacacaggggctaacgcagcctgggaccctgtgtgccagcacttactcttttgtgcagcacatgtgacaatgaaggatggatgtatcaccttgatggttgtggtgttggggtcctgattccagcattcatgagtcaggggaaggtccctgctaaggacagaccttaggagggcagttggtccaggacccacacttgctttcctcgtgtttcctgatcctgccctgggtctgtagtcatacttctggaaattccttttgggtccaagactaggaggttcctctaagatctcatggccctgcttcctcccagtgccctcacaggacattttcttcccacaggtggaaaaggagggagctactctcaggctgcgtgtaagtggtgggggtgggagtgtggaggagctcacccaccccataattcctcctgtcccacgtctcctgcgggctctgaccaggtcctgtttttgttctactccaggcagcgacagtgcccagggctctgatgtgtctctcacagcttgaaaaggtgagattcttggggtctagagtgggtggggtggcgggtctgggggtgggtggggcagaggggaaaggcctgggtaatggggattctttgattgggatgtttcgcgtgtgtggtgggctgtttagagtgtcatcgcttaccatgactaaccagaatttgttcatgactgttgttttctgtagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaatctgca

SEQ ID NO: 7275 - DNA, 1098 bp, Homo sapiens
ctgatcctgcgccatgatcctggatggctgcgccccacttatgagcccattggattgggtggtgctcggggcaccaagagagggtgccccacacaccacgtgtattgtggtatacaagagggcatcgagcccctcagtgggagatattttgccaactgccatgtggaagaggtgcctccagctgcccgaaacgaccgggcagcccatcggctatgggaggccagcaagaggctggcagggcttgggcctggggagtatgctgaacccgatgaagacccccagtctgaggactcagaggccccatcttgtctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaa

SEQ ID NO: 7276 - DNA, 255 bp, Homo sapiens
gggtcgcgcagccctggagggcaggtgcctgtatggggaggggccctgaaacagaggtcgtttctcggcacagtcagacccgttaattccaagcaggctggggcttgttggggattaccggcactgcccgcccaggagacgcggatgcggcctctacaggttgggaaacccggttctgggcagtgcagtttgggattgcaaaatgctgcaagttccagaatttctatctaggtggggcatggggactgcggtact

SEQ ID NO: 7277 - DNA, 984 bp, Homo sapiens
cctctctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattttgctttcttttggattaaccgagtattttgtgggattccatttgatcccttaactggctgaccagctataactcctggttatgttgttttagtgttgctccaggtgtcgttggaggagaagttgaaggtacaaggagtttgcaggagggaaggtggcagttaatgagccttcctggtgggaccggatggtgagggcaggggcatctggcccagcgtggactcgggccatagatgggaagtggtcatttggaggtcaccatctctctgacaccctgaccatagcacctgcacccctgtgctgagctgcaggtccccggcaccagcgtctgtgcagctcaggtgttgctgagccgtggcctccgcagctctccatcaggatttctcaagcttcattatgaattatctctgtgtgagctcacaacggtgactgcagagtcccaggtcatctctcagatcttctgaatcaaacatatggtctgcagttgccgcgcatgtctttggccgattttctgacaatcaaagtgaagaagttctgagctacgggaagttgggttgaaggcatgatggggaaaacatgattagttgacagcttttcccagagagtttttagacaaactcaaccttggtaaccttctcagtgggcttatgataagaaccttcaatgtgccaaaaaataaaaaaagcagcactccaggtagttaatctttgtttaaaaaacccttccccccacccagtcctgcaaacaaacaaacaaacaaaaaaaggagaaaaaaa

SEQ ID NO: 7278 - DNA, 984 bp, Homo sapiens; identical to SEQ ID NO: 7277

SEQ ID NO: 7279 - DNA, 9545 bp, Homo sapiens
aggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccacctaacctggtatcaccttcccggaggtaggccaccgggagtcctgtccggtgtgcgttagatcctgtagagcagggaggcgtttataatgggccccaccatggagtttagggttaatccagctaatcgcagagcatccaggaggtgcctggaaatgatcccctccttacagtttactataagcccatgaagagtttccaatttggaaatggaattaaagtaacagtcctgtgatgttagatttatatgcagttttggttttgtctgaaatcgcatctgtgttagtccgttctcacactgccataaagaacttccctgagactgggtaatttacaaagaaaagagctttaattgactcacagttccgcatggctggggagacctcaggaaacttacaatcatggtgaaaagggaagcaggcaccttcttcacaaggcgacaggagagagaacatgtgaaggaggaactgtcaaacacaaagccatcagatctcctgggagcccactcactatcacgagaacagcatgggggaaactgcccccgtgatccagtctcctcccaccagggccgtccctcatcttgtggggattatggggattacaattccagatgagatttgggtggggacacagagctaaaccatatcagcatgtgatcctctcaacgttccaggggtctcgtaacatgccgggcctgtctgcagccacgctggcctctctgggtgggacttcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccactaagtatgttccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagacagaagcagctggaaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttctttttttttttttttttttttttttggagacaagagttttgcttttgtcacccatgctggagttcaatggcacgatctcggctcactgcaacctccacctcccaggttcaagtgattctccagcctcagcctcctgagtagctgggattacaggcgcccgccaccatgcccggctaacttttgtatttttagtggagacggggtttcgccatgttggccaggctggtcttgaactcctgacctcaggtgatccacccactcggcctcccaaagtgctgggattccaggcgtgagccgctgcgcctggcctgttgtttccgtttctacagcagagcagcagagttggcggcagtcctgatgtttctctgcccttaggttgcgcgtgccgttcatttgttcaggtacttactgagaggctggctggtgccagatgctgtccccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgtctgttttttaaactgtgtaaaatcatatgagatacactaaaattgtataaaatcatgtaaaaatatcatatgggatacacctgaactttaatctttaaatattgaagtttattttcccttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgcttactgtaaataggctccagggtgtagaagaactcacaatggcaggagtgccggcatgggtgtacactcaccattttcccaaatgcattgtttgaaccaagattgaaaatgtaactgcccagtagaaaaggttactaacatactccctgatgcatgccttagacttaccatccttcccccaggcttaaaaccagtttctcatttcccataggcgtgtgccagacacttgaagaaggttcttggttttcttcactttttgtagtagttgtatacaaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcgtatctgttacttccttttcagccccctagaaagtacctgcaagatcatttgaatttaatatcaaagggcaccagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtctctactaaaaatataaaaattagccaggtgtggtggtgcgcacctgtaatcccagctacttgggaggctgagtcaggagaatcacttgaacccggcaggtggaggctgcagtgagccgagatcgtgccactgcactccagcctgggtgacagagcgagacactgtttcaaaaaagaaaaaatgctgctggggagccactgaaccaaccggagacccgctggtcccacgtgaagcagctgtcctggtgtggaggtacagagctagaccagcactggtccctccagccccctggtagcctctgctgcacctgaactggcagctcttgccgctgcctttagctctgcatgtatgcgccctgaaggttctgcctctctgttttggaatcgccttcccctcctcatgtttggggacctgcaagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgccgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttctaaaaagaattaaaacaattagccaggtggtacatggctgtagtcccagctacttgggaagctgaggtgggaggatcacttgagcctggaaggttgaggctgcagtgagctgtgttgacaccactgcactccagcttgggcaacagagaagacactgtctcaaaaaaaaaaaaaaaaaaagggaatggtagggtgtgtgtgtgtgtgtgtgtatgtatgtatgtatgtgtggatatatcgtgtgtatgtatgtatatataatgtataatttacattatgtatttttatatttttaaacaatggctctccgcttatccaggaaatccaaacatctgagaataaaagtaccatactctttgccaagtgacttgaaatattgatacgtataatttcaacatgtaaactggagacagtttttctaggagaacatctaagctaaaagcaaaaccatgaaaaaacatacctatgaaagagccaccatgctcagataaggtgcgatcagatgcttcaagattttcctattcatatgtattttctgatttttattttgttctctctcaacaccatagggaaatagttatgagtatcaaagattttaagaaaattatattattttctgctgattgggaaaagacacagttactctacttaagaattaaatatatcaccaagctcagagagagagatagtcttatctgagctttcattaggaaccactggaactagtttgttaatagctgagatcagatataatttctattgagagtctcaagcatgagtcatgtgttaagataagtaatgacagcggactgattccacgaaggctgggcttggatgttctttagatagaaagcaaggaatacttttttcatacttttaggaattgtccaatttttcagagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatatgcattcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaagtgagttgggtctcaggccgtcaccagggattgcgctgctgtgactgggcaggaacacagcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaataaaagaccttgaagattgtgatgatgtagtagcaggtgatttgttccacagaaactataaatcgtgagagcctgaactggcatgccagaaacatgggattccactgctttagtgctgtttttctcctttacaggaatttgaaagggaaaaacacgcccacagtatactgcaatttcagtttgctgaagtcaaggaggccctgaagcaaagagaggaaatgctcgaggtaggtagcattctcctgcttttcttttccttttttccctttggagcattttgtcaggccatgactatcttagcttaggctgcagtaataaaataccatacacagcatggcttaaacaacagaaattaattttcttacaattctggaggctgggagtccaagatcaaggttgggttcaggtgaggcctctcttcctggcctgcagacagccaccttcttgctatatccttcctccaacggtggagaaaaagcaatgtctctgatgtctcttcatataaggacactaatcctatttgatcaggaccccactcttatgacctcatttaaccttaattacttcgtaaaaaccctatctccaaatacagtcacattgggcattagggcttcaacagatgaatttagagggacacaattcattccatggcaattactaaagttttcagttttcttaaatctgagagtttaggctaactctccatccctagatttacgaaacagtccctctcattggtgaacattcctattctttggtgatcttgtatttgtttggggaggtgtggtagacagaataatggtcccccgaagttgcctacatccagatccctggaaactgtaaatatgatgccttacatggttaaagggcccctgcagttgtgatgagagaccttgagagaagggattatcctggattatttgatggaacaagcatccttctaagaggaaggcaactcaaaggcagaagtagaagatgtgacacaggaagctgaggttggagcgatgcgagagaggggccatgagccaaggaaagcagctcagtcttagaagctgaaaaaggcagggaaacagattctccctagagccttccagaaaggcttgattttagcccataagactcattttggacttctgacctctagaattgcaagagaataaatttgtgttttaagctgctgaatttatgacgattcattacaatggcaataagaaactaatacagggttggtttttaattttttgacttaatcggttctttaactgctgccttgaagtgagaatttcacccaaagcaggttttcttcctgcacttcttgaagccggaagtaggacaaggaaaaaaatcctagaatgctgacaatgagttcagggttgatgaggtgaaagagtgcttgcggcctcactcactgtcccagctctcaggttctctctcgggctggggtttttcttcctctttaaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctgccccgtggctgggccgggccggtggttgttgaaacagctggagtgaggaggacactctgaggaggtctgatgtgtgcaagtccagacgtcttgggattatctgc

SEQ ID NO: 7280 - DNA, 7809 bp, Homo sapiens
aggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccacctaacctggtatcaccttcccggaggtaggccaccgggagtcctgtccggtgtgcgttagatcctgtagagcagggaggcgtttataatgggccccaccatggagtttagggttaatccagctaatcgcagagcatccaggaggtgcctggaaatgatcccctccttacagtttactataagcccatgaagagtttccaatttggaaatggaattaaagtaacagtcctgtgatgttagatttatatgcagttttggttttgtctgaaatcgcatctgtgttagtccgttctcacactgccataaagaacttccctgagactgggtaatttacaaagaaaagagctttaattgactcacagttccgcatggctggggagacctcaggaaacttacaatcatggtgaaaagggaagcaggcaccttcttcacaaggcgacaggagagagaacatgtgaaggaggaactgtcaaacacaaagccatcagatctcctgggagcccactcactatcacgagaacagcatgggggaaactgcccccgtgatccagtctcctcccaccagggccgtccctcatcttgtggggattatggggattacaattccagatgagatttgggtggggacacagagctaaaccatatcagcatgtgatcctctcaacgttccaggggtctcgtaacatgccgggcctgtctgcagccacgctggcctctctgggtgggacttcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccactaagtatgttccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagacagaagcagctgaaaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttctttttttttttttttttttttttttggagacaaaagttttgcttttgtcacccatgctggagttcaatggcacgatctcggctcactgcaacctccacctcccaggttcaagtgattctccagcctcagcctcctgagtagctgggattacaggcgcccgccaccatgcccggttaacttttgtatttttagtggagacggggtttcgccatgttggccaggctggtcttgaactcctgacctcaggtgatccacccactcggcctcccaaagtgctgggattccaggcgtgagccgctgcgcctggcctgttgtttccgtttctacagcagaacaccaaagttggcggcagtcctgatgtttctctgcccttaggttgcgcgtgccgttcatttgttcaggtacttactgagaggctggctggtgccagatgctgtccccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgtctgttttttaaactgtgtaaaatcatatgagatacactaaaattgtataaaatcatgtaaaaatatcatatgggatacacctgaactttaatctttaaatattgaagtttattttcccttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgcttactgtaaataggctccagggtgtagaagaactcacaatggcaggagtgccggcatgggtgtacactcaccattttcccaaatgcattgtttgaaccaagattgaaaatgtaactgcccagtagaaaaggttactaacatactccctgatgcatgccttagacttaccatccttcccccaggcttaaaaccagtttctcatttcccataggcgtgtgccagacacttgaagaaggttcttggttttcttcactttttgtagtagttgtatacaaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcgtatctgttacttccttttcagccccctagaaagtacctgcaagatcatttgaatttaatatcaaagggcaccagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtctctactaaaaatataaaaattagccaggtgtggtggtgcgcacctgtaatcccagctacttgggaggctgagtcaggagaatcacttgaacctggcaggtggaggctgcagtgagccgagatcgtgccactgcactccagcctgggtgacagagcgagacactgtttcaaaaaagaaaaaatgctgctggggagccactgaaccaaccggagacccgctggtcccacgtgaagcagctgtcctggtgtggaggtacagagctagaccagcactggtccctccagccccctggtagcctctgctgcacctgaactggcagctcttgccgctgcctttagctctgcatgtatgcgccctgaaggttctgcctctctgttttggaatcgccttcccctcctcatgtttggggacctgcaagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgccgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttctaaaaagaattaaaacaattagccaggtggtacatggctgtagtcccagctacttgggaagctgaggtgggaggatcacttgagcctggaaggttgaggctgcagtgagctgtgttgacaccactgcactccagcttgggcaacagagaagacactgtctcaaaaaaaaaaaaaaaaaaagggaatgctacggtgtgtgtgtgtgtgtgtgtatgtatgtatgtatgtgtggatatatcgtgtgtatgtatgtatatataatgtataatttacattatgtatttttatatttttaaacaatggctctccgcttatccaggaaatccaaactctgagaataaaagtaccatactctttgccaagtgacttgaaatattgatacgtataatttcaacatgtaaactgaagacagttttctaggagaacatctaagctaaaagcaaaaccatgaaaaaacatacctataaagagccaccatgctcagataaggtgcgatcagatgcttcaagattttcctattcatatgtattttctgatttttattttgttctctctcaacaccatagggaaatagttatgagtatcaaagattttaagaaaattatattattttctgctgattgggaaaagacacagttactctacttaagaattaaatatatcaccaagctcagagagagagatagtcttatctgagctttcattaggaaccactggaactagtttgttaatagctgagatcagatataatttctattgagagtctcaagcatgagtcatgtgttaagataagtaatgacagcggactgattccacgaaggctgggcttggatgttctttagatagaaagcaaggaatacttttttcatacttttaggaattgtccaatttttcagagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatatgcattcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaagtgagttgggtctcaggccgtcaccagggattgcgctgctgtgactgggcaggaacacagcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaataaaagaccttgaagattgtgatgatgtagtagcaggtgatttgttccacagaaactataaatcgtgagagcctgaactggcatgccagaaacatgggattccactgctttagtgctgtttttctcctttacaggaatttgaaagggaaaaacacgcccacagtatactgcaatttcagtttgctgaagtcaaggaggccctgaagcaaagag

SEQ ID NO: 7281 - DNA, 1015 bp, Homo sapiens
cttctttggtttaatgcaggatcaccagactctgtggcccacgacctgtttttgtgtagcccataagacatacctttctaagtactatagctgaaaaacatcaaaagagtagtaatattttgtgacatgtgaaaattatatgaaattcaaatttctgtctgtaaacctcactggaacacagccatgctcattcgtttgtatatggtctgtggctgctttctccctacaacggtagaattgaacagttgcatcagagaccttatggcctgctaggccagaaatgttaagccctttacagagaaagcttgctggctcctgtttaatgctttaactgccctactgaaaggcaggaggttgaaaaaatgatggtagtcaaaaggaatgcatgaaatcctgttgtcttctgttagctgattgcaagtagtacacaggatatatttgagacatctcttttcctatctcccaccaaaggataattcaggcggatctcagtgcacaggcacaggcatttgcctcattcttgttttgtctgttttgaatttagttatgggaatattttaatatctctcaaaaatagggtatctggtgtgagtcagaatgattatagaacatgcttgcctggagaacaggaaatgcgggatccactcctggtgtgctgttagctgaaggacgtcagaactgtcctttaacctccctgcaggtctctaaatggtaggattgtttggggattacactagatcatctctaggcaccgttcagctcagtagagacattgctgcatggtggaaggagtgacctcagtgtgaatcctggttctgtccctttctgcccaggagaccttgagcagcttatctaaatgctgtgtgcctttgttagctcatctgaaaatgtggctgtaagaatgacctcatgagaatggactgagatcatattcttaaaactcttggcactaataggtatttaatctactataactgtgaaaattatgtctgtgaactctttttttttttttttt

SEQ ID NO: 7282 - DNA, 1015 bp, Homo sapiens; identical to SEQ ID NO: 7281

SEQ ID NO: 7283 - DNA, 130 bp, Homo sapiens
tgagacggagtttcgctcttgttgcccagactggagtgcagtggcatgatctcggctcactgcaacctctgcctcccaggttcaagcaattctcctgcctcagcctcctgagtagctgggattacaggca

SEQ ID NO: 7284 - DNA, 527 bp, Homo sapiens
gttcctttaaaagccagcttttctactagaatcaacattatttgaattacatgcaattatatgagatcatatcaatgcataggaagctagacatgtattagattgtggttaagggcatacgctttggagccatataatatagctgtggttcaaagcctggctttgccatttacttactagctgtgtatgatcttggccttccatttcctcctgggaatgataataatacttgctgtgaagattaaatgaaattacccatgtgaaatgcttagcatggtacctaagtagtgccactctaaagtttcatggcctcctactctctggacacatacctatcctctgtctgctagaactcctcacttccctgttctcctaacttacttatccttcagagcccagttcaagggacgtcttcatgaagtcccccttgccccagccctgtgcttccacagggcctgtgcacgcctctctctgcttcccactgtgtgcgggccctacctcctccttttattgtgcttcactttctt

SEQ ID NO: 7285 - DNA, 2075 bp, Homo sapiens
agcaaactgaatcagagaaggtgagtggcaaagcccatgtagctggtggcattactagaacttagcactgtgatgcacaaaggcttaactgggtttggcagcaagggtctcatggatactctttaagatgtaggcccagatctcttagtagtgaatccctgatgttccctctcttggggctctggtttagcaaggacagcgaggatactttcctctctccctcctccttactcctctctactaaggattaaggagccacctcttcctccttaaggcctttgggagagatgggtctcctggtattagaaaggagagcagacgcctagagttctgacctcttgggcctcccctaaacaaaaagcatagccccttcactaccctagtaacaagtatgacctgttgcctgttgaggtcaggtgtacctgtgtgtctctctctgtgatgtatgtgggcttggtgtccacatcaatgtgcgtgaatactcctacccacagactgctactgtgccaatatagaggttcataagaaagataaaagagaaccagcagaaccccaggttctgcctctccttcctccctttgcccagataaaggtgtacagtgtttgtggtgaggctgctggacactgctgttttgggctttctagagagaatgcaaacatgcaaaaacagtgtggtagtgtaggcagaacaagatctagaatcagaagacctggagtcgaatctcagctccaacacccactggatgaacgtggacaagctgcttgatctctcagatcctcgatttcttcatctgtaagatggaaacaatatgtgtcttttctaaggggaaagatcaaatgacatcatgtatgtgaaaatgcttagaaatgggtgatgatgatgatgatgatactgattattagggtatctaataaagttggggaaagaacaaaatccccccctcacaccctattgcaccaccagccttctccctccctgctcaattatacccatgttatagggaaggaaatagggaagaaacttgtctaaggtcacatggatgttcgcaacaattgggatgcagaacttgatctgactcccaggccaggtttgattttgatttgcagtggcagagaggactaattttttactaggttctgagccctgtactgaactctggattgccctgtacttggtggtggtatacagttcagcagtttttagcatatacacgaatttgtgcagccataaccactatctaattctagaacatttttatcacccccaaaagaaatcatgtacccatttgcagtcacttgccattccctcttctccccagccctgggaaaccactgacctaccttatatctctatgaatttgcctaatctggacatttcatataaatgcaattgtacatgtggccttttgtttctggcttctttcacttagcatgttttcaaggttcatttgtgctgtagcatttatcagtactttgttcctttttctagctgagtaacgtgtgggtatatcacattttgtttattcatctgttgagggatgtttgggttgtttctactttttgactattgtgattagtgctgctatgaacattgatgtacagatttttgtgtagatatgttttcaattatcttggggcatcttttatttttaatgtcagttttctatttttaaaaaatctagacaggttggcaaatcatttctgtaaagagtcagtaaatattttagcctttgtggtccatgacattaggtatacagattacaatttctgaactctgccattccagtgtgagagcagccatagataatatgtaaacaaatgagcatggctatgttccaataaaacttttaaaaagcaggggacagattgggcctgtggaccatagtataccaacccttaatctaaatgacacattcacatgatacattattctaaaggcacaaaaagcaaaaattctccctcccacctctgtcttccagctacggggttaccttccttgaagcagttaatgttatgagattttgtgtctccttttagacacagttaataatgagcattaaagtggctatatacta

SEQ ID NO: 7286 - DNA, 2075 bp, Homo sapiens; identical to SEQ ID NO: 7285

SEQ ID NO: 7287 - DNA, 478 bp, Homo sapiens
actgggaacagcaggaaagggcaaggtggtgacaatctaagggaggcaaatggataataaccagcatggtagggaatcttctttgttgctgtggcactgtcgatctctgttccctgaactctagtgtcctccagactagatttaaggtgtggttccccgctaaattattctctcacctcctttcagtctttgctcaaacatccttttatcagagaggctttctgacatcctgtgcaagatagcacctctcccccatcgctgttatccttacccagtttaattccacgtagcatctgccaacgcttgacatatttgttttttgtttactttctggcctgtgacaactagaatataagctctgtgagagcatttttctcttaactgcttatcttcaagtaaacagaacagtgcctgtcctgtaggaagtgtttgatacatacagattgctcaaatgaaaaaagaagggtgcgagcaagcc

SEQ ID NO: 7288 - DNA, 1011 bp, Homo sapiens
agtccttgaggaacagaaccctaaaagagagaacacctgcctaatctgactcctccatcagaataatcttttgaactcctgagatttgcccagtcattttggggccatgtctgatgaaagcttggtgatcccttttgggtcaaaaacaagctctgactgaagagatgcaagattttctcagatgatttgtgtgtcagtcagagttccgccagagaaacacaaccagtaggatatattctatcttgtctgtcttcatatccatgtatctgtcatctacctagatttaatgcaaggaattggtttatgcagttgtaggggctggctaggcaaatccaaaatccacagggcaggccgtgtggaagggaggtctggaaactctcagacaagacctgacattgcagtccactggtggaatttctccttcttcagggaaacctcagctttcaacggagtggatcagacccaaccatattatccaggataatctcctttacataaagttaactgattgtagatgtaaattacatttacaagataccttcatagcaacacctaggtcagtttttgaataactgggtattatagcatagccaggtcaacacgtaaaattgatcaccacagtccatgtcttgttaacttggcacctgtacacatttccttaaaccatttaatctcccaataaagacaataacaaagtaaaacttctgcctatcatgacacagctaatctgtgtacaactgaaaatatgctcttttcctgggagagaattcacagtccttgactggtgttcacttttatccttgataatccagtaactttaataatattatgtaaatgtagctattttaataaattttatgttagatgacaaggggataagagagggaagaaaaaatacataaacacaaacattcataacaaaacaatgaatactcataataattatagtactaacttctgcaactgttcacatgatgtgttttataactaccggtgttacaaaattactgg

SEQ ID NO: 7289 - DNA, 478 bp, Homo sapiens; identical to SEQ ID NO: 7287

SEQ ID NO: 7290 - DNA, 1011 bp, Homo sapiens; identical to SEQ ID NO: 7288

SEQ ID NO: 7291 - DNA, 981 bp, Homo sapiens
ataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaagta

SEQ ID NO: 7292 - DNA, 981 bp, Homo sapiens; identical to SEQ ID NO: 7291

SEQ ID NO: 7293 - DNA, 984 bp, Homo sapiens
gtggcatagcgctaaccaaatccacttaggcttctgggctgcctccaggctcttggctaggcattctgctagcactctcatccctggggagggtggatcatacttggctcctccccaccaggtggaacctgagcctccaacagcagcctcaggtcattcataggtcaagccccaggcctgaactgccactagacaaggcttttggctcccttcctgccctctcgccaatctcccaggtccgggcttggtggagcctgttatgcgggcactccaggtccactccctcagggcagaggccacagcgccatccccttccccatggtctccctacccccaacctgcactgggcgctccgcccagaggtgagtccctcccagcccttctctccttctgtcctagccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtacgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggtttt

SEQ ID NO: 7294 - DNA, 118 bp, Homo sapiens
cctcagcctcccgagtagctgggattacaggcatgcaccaccacgcctggctaattttgtatttttagtagagacgaggtttctccgtgttggtcaggctggtcttgaactcctgacc

SEQ ID NO: 7295 - DNA, 984 bp, Homo sapiens; identical to SEQ ID NO: 7293

SEQ ID NO: 7296 - DNA, 173 bp, Homo sapiens
cattagcagcttttaatccactaaaaaaacaagagtcttggagaatgggacctttatcttatctctgtgtctcaaatcttagcacaacgcctggcacttaataaatactgaatagcatttctggatgaatcaacgagtgaatgaagagatggcttataaataaatatttctga

SEQ ID NO: 7297 - DNA, 5033 bp, Homo sapiens
cgcagaaccaggaaagtaacggctacagacagtgagaaatagtttcgctcgccggctagaaaaactctgtcggtaccaaccccagagcgttgagagcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagcgttccactgctcatcgttattctagtgtttttggctctagcagcaagcttcctgctcatcttgccggggatccgtggccactcggtaagggtgtcctcatagtgcaggtagagtgggggaaggctcatgggcagattgtctcctgagggacccaggacaggtaagactgtacaagagcctccatgaatagtcgaattgaggctcaggtggagtgaagtcaggagtctggtgcagcaagcacccctttccaaggatagggagagctccccatccaggatatcctggagaaggaccccagctgggtccttgggaaggctgctgcagagaatgggcacccagtccagtaatcctgaggaacagtataggcttcttgtgctggagggcctcccacctctcccaggactaaagctgcactctcatcccatccggtgggtgatgaccttcaggccaaaaggacagatgccagcagctcagactgcagtgttcccctttgcactgggttgagacacatgtgtatgggtgcctcatcctcaggactgagactcccacattggattagaagttggagccaactgggtgcattgtcttagactttccccctctcccagaacctaggttgtgcatttttcagttctgggaggacccagcttttctgcatcttaatctgtgttgctttccctggaactggtgcacctaggagtatctgcattcccacctcctcccctcggagatcaggctggggcctccctcttctgagggaggtgacccctgcgtgcctagcacttctggactcactgagcctcaccaagcagtgactggaccaggaggcagaaccaggaccaggcgccagacagctaggggagtgaaggtggtggaagagtgccaggaagtgggggtggaggggaggtgctgttagggtagatgggaaatggggctagggaggtgaaagtgcgtggtcacaaaatatcagaaatgccagtagcccagagggacttgcaggaaaagcgtgcctaacattagtctcaaaagtctggatataactaaagatccaggtgaagtggggtcaagggtggtcttggggactctggtttggcagggctcaggcctgacccgggtgcctattcctgcagcgctggttttggttggtgagagttcttctcagtctgttcataggcgcagaaattgtgggtgagtgtgtggtgcagcccatggggagaggacggggtgaggaaggaggtgggcagagggcacctgggacaatagggaactggggttggttttctgctccctcttcccactctccagctccttctagggcccactttttggcccttaccatgcaaccacattggacctctaagtccccatctctctgcagtgtcccacctcccataccactctctaattccattttcccaccctcatcccacccccaccgtgtgcctttccctacagctgtgcacttcagtgcagaatggttcgtgggtacagtgaacaccaacacatcctacaaagccttcagcgcagcgcgcgttacagcccgtgtccgtctgctcgtgggcctggagggcattaatattacactcacaggtgagggggctggggctaaatgaactcctggagctgggagatccccggttaggtgagtgtgtcagggatagctggagggcctctcacatcccacaagctcaaatagcttgtggtcctcgtggatttgcgttttctccaaccaccaccgaacccatttctcccgccgagagcgccacacccccactttcctgtctgaatccgcttagttgcgaggtctccgaccgcgggcagccccatgagcccgcctcaccccacagggaccccagtgcatcagctgaacgagaccattgactacaacgagcagttcacctggcgtctgaaagagaattacgccgcggagtacgcgaacgcactggagaaggggctgccggacccagtgctctacctggcggagaagttcacaccgagtagcccttgcggcctgtaccaccagtaccacctggcgggacactacgcctcggccacgctatggtaagtgctggagggaaggctgtgtgcacgtgtgtgtgtgccaggagctgggccgtatgagcgggaggatgcaggcctcggaggcgctgagcagctgcagccagacccgacgcgctcggggtgggcatgacagcctcgcgggttagaagatccacgagatctgcacagacggaatccggagagactccagccaccgcctggacctcaggagcccgcttctcccccggggaattcccctgcaccgctgccatcccagtccctggctttgacgctggggtagggataaagaagagcgcagctgtgggaaccccggtgggctgggagaagcccgctcacagcgggtccccccactccccggcagggtggcgttctgcttctggctcctctccaacgtgctgctctccacgccggccccgctctacggaggcctggcactgctgaccaccggagccttcgcgctcttcggggtcttcgccttggcctccatctctagcgtgccgctctgcccgctccgcctaggctcctccgcgctcaccactcagtacggcgccgccttctgggtcacgctggcaaccggtgaggaccgagagaatgggccccgggggctaagggtggagacaggattcacaccgggtgtgcactttccagtttacagaatgaattcacatctattaccctatttgcccctctcaatagttcgcagaaacaggcactgttatgaccattttacagatgaaaagtggggggctcagaagggtttggtgtcttgccgtgtttcatgtaattcagattagaggtgtgtggcgggaggtaacacaaggggtaggctccaaaagatggaagaaggcccgggcatcacgcctgtaatcccagcactttgggaggtcgaggcaggaaggtcgtttgaggccagagttcgagaccagcctgggcaacatagccctgactccacatgccctcctttctttcgatccccaccgccacaggcgtcctgtgcctcttcctcggaggggccgtggtgagtctccagtatgttcggcccagcgctcttcgcacccttctggaccaaagcgccaaggactgcagccaggagagagggggctcacctcttatcctcggcgacccactgcacaagcaggccgctctcccagacttaaaatgtatcaccactaacctgtgagggggacccaatctggactccttccccgccttgggacatcgcaggccgggaagcagtgcccgccaggcctgggccaggagagctccaggaagggcactgagcgctgctggcgcgaggcctcggacatccgcaggcaccagggaaagtctcctggggcgatctgtaaataaacctttttttcttttgttttttaaaaactgtttttcccattaattttcatggcttctccgcgccggggtcgcacgtcctcatgagcttcgctgggctggagacagcctagtacactctccgcagtgctgtgaaacctgattctctgcgtcgactccagagtaataggggcgccctctagtgaggccggagggaccctaccagagctagcatctttctgaaccaccccagggggacgttaggtggcagtgatgaggcaggtcacccactcccccgtcctggatgccactcagctagcccagctgagtggggtgggaaggaatagcgttttggagttgattccctaacttcccacctggcttcttgtgaggtggtgtttgagggccaaggtaggtgtcagcaaggcatagaaagataaatcccaagattcttggcaagtcttgcaatcttatgtagcaaatttgggaactgaagctcaaagagaatgtggcatagttggttaatgttagacctaggatgagaagtttggtttcccctcctttccagtgctgtctttcattgtaccaaaaggccacacaagctggagaagtaaaggaagaacaaaaggaacccaggaaaaaggaaaacaagaggtgccgagggatgagaggaaaccataggagaatcatatgtaacccccaccctgctggtgttatgggggtgaagttaggtttcagtgaatagcatcttgaagaggcaaggcagcacggaaaggctgggttgctgtgcagataagctagcccctgcttggccttatcatggcaacaggctttatggacaggcccagcatctcttcagtcccttagggctttttgttttgttttgttttttaacatcagtatatagagcctcctttttctactccgtctgtagattggtgctgggtgtctggtaacagccaccctgagggcagttctgctggttttatggggcgccaatgaggtttggagccagactggaagtccaggtggcctccacggggaggaatgttataaagcacaatcaggatctttggggtgtgcctccttacagtatgccttggtggaggaagcctctgacaggggaatgtcctgggacttgggactgtcagccatggaccggtagcgggggctcaggagtccaccttcctcaggactccactccagcatggggtcttcatccacactctggttgaagaaagccttcagcctgtgaggctgcatcctgtgggccaccgccatagccaggcccagcagcacacacagcagtcctg

SEQ ID NO: 7298 - DNA, 134 bp, Homo sapiens
cccgacctgcagcccaatatcagcgctgatccactcagaactgaaggccttgtatgatgtgttggtgctgacctggcccacagaccactcagaactgaaattcacagctgtggttggggagttggacatatggg

SEQ ID NO: 7299 - DNA, 5533 bp, Homo sapiens
ctacacagaagacccaaggctgcgatgctggatacctcaatttgggagctggagactggatatgcaggattgagttatttgagctgagaacccaagaagggctggcaatagctgaaggcttgagtgtgtgttaaatctgagaagtggaaccttgacctctctcatcacaatggttcacctcccgagccaccccaacacacatacccctttccttacctgctttccacttccctcaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggtgagtgaggccccttggcaacaggaaacgggaaattccaagggcaagttgtagagaagcctgcgtgtctaaagagaaggggagagacatggctaaagactaaacaacacaaccccgagtcctaatgcagtggagtggagggagcgtttacctccctggctgatgaatgattcactaggaactctgatctccatctcctcctttctcctgaggccgagctggagcccttgaaggagcagcttcgaggggccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggtagagggatggggggtacctggcaatctgatggccactgcccccacctctgtggggactcctacatgtggtcagaccctctgggaggagagaagaggggttgagaaccttagaggacttgggtggagaggggctttgagggaggtacactttactttctaggcatgacccatccctaaccggggtatcccaatcctgatcaccagagtaccttccttggaacagaaacattttctgtcctagaccccaggccctgccataatgcccattcctgatcaagcagcacctgccgtcatgtcctgtccttcattcagagggtataggaaatgaaggcaaaaaggggaaagtgctctaaaaatgatgctttaaataaaggaaaggacacagtaagggatggtgctgttgacagtggcgttcctttttcttccccctccaccctcccattttccttcttggctatctctcaggcagagaaggacaagatcctgaagctgagtgcagagatacttcgattggagaaggcagttcaggaggagaggacccaaaaccaagtgttcaagactgagctggcccgggagaaggattctagcctggtgaggcatccagccaccaagggtcctgtcctatggcctcctgaggcatccataccccttctctctgtcttgggtatgggctcagaagtgctaggtgtccactaccatgttgggtggcatttcacttgcacacgcaagccctcattggtttgaaatgtgcatttttttctgctctcagggcacacatctgggcccagtagaggtgacttaggagaattatagagtggccccttggtatgaccaaggcctctgcaccccagcctagaggaagtcatgcaggtccccactcgagaggcagagactaagacttagaaaactgagtatctgtggcccaagacaaagtactcatggaggaagtgttgggaattcctgtgtgtgtgtgtcagagcagggaagaagcagaggcatggggagacctggttctagattgttggtcctggtcccagagtccaggttcttggaggtacattctaggctccagattccattgggccctcttccctcaggtacagttgtcagaaagtaagcgggagctgacagagctgcggtcagccctgcgtgtgctccagaaggaaaaggagcagttacaggaggagaaacaggtgagcacccataacccaggccccgtggatgccacaggtgaggacttgagggctagaaactttgtaaattcctgtcatctcttggcttagaaactgttctctccaagagggcccgtaccctggcttctcttattagctgatttggcaggacagcggatgatctctgggagaagggagggatgtaagtggtgaagcaggggtgctggggggagtgtctgcctgaagttgccccaatctttgctgaaggcatctaatgctgaggagctaagagttcttcttgggtgcagcttctgcaggctagcaaggttggcaccttcccattctctagcacctgcctttttccttcccaattccaggaattgctagagtacatgagaaagctagaggcccgcctggagaaggtggcagatgagaagtggaatgaggatgccaccacagaggatgaggaggccgctgtggggctgagtccgtgtagccccaatcttgtaacacctcttccccactctacctcccgctgttgaggaaggctccatgtaaccttgctgggagctgcctttgccttctatgtgttttgccttttctttccagcacctggcccctgtatagtctaatgataccctcatccagaggagacagctggtccaactcctcacaacacatccttttttcttctctgcctgcttcatctcctacaggctgcccggcagctctgacagactcagaggacgagtccccagaagacatgaggctcccaccctatggcctttgtgagcgtggagacccaggctcctctcctgctgggcctcgagaggcttctccccttagttgtcatcagccagccggctcccatttctcctcacctctctgggccagctgaggacagtagctctgactcggtgagcagtggaggagcctgtgcagaagcagtaaggaggggcagggccaaacccaagtgtcccagcctggagtgcagcacgatcttggctcactgcagcctctgcctcctgggctgaagcgatcctcccacctcagtctcccaagagtagctgggaccacaggcaggcacccccggctaattagagaaggaatcttagctatccagggctctctttttcccaggggagaggaggcaggcccagcctctcttcagtgccacaccagtagatatcatcccaaaacccagaccagcccaatagcctcactgcttctcccccacagtcattctcttattattcaccagcccctcaaaacgcctctcctgcctcactcttcctaagcccctcaggtcactgtcctagccttggctgctcttcccatacctgtcccaatgtgctgctcccccatcttgggacaccaccccaaagcccaaccctgtctctttggcatccaggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatgggggaacaagtgtcccaggtatccccatttccaaggcccccctccctctccaggtccccccacagcaataaaagcttccccctgatatccatccctttgtagtttgaacaaatatatttatatgatatgtatga

SEQ ID NO: 7300 - DNA, 5543 bp, Homo sapiens
ctacacagaagacccaaggctgcgatgctggatacctcaatttgggagctggagactggatatgcaggattgagttatttgagctgagaacccaagaagggctggcaatagctgaaggcttgagtgtgtgttaaatctgagaagtggaaccttgacctctctcatcacaatggttcacctcccgagccaccccaacacacatacccctttccttacctgctttccacttccctcaggctgagctccaagtggcacaacaggagaaccatcacttaaatttggacctgaaggaggcgaagagctggcaagaggagcagagtgctcagggctcagcgactgaaagacaaggtggcccagatgaaggacaccctaggccaggcccagcagcgggtggtgagtgaggccccttggcaacaggaaacgggaaattccaagggcaagttgtagagaagcctgcgtgtctaaagagaaggggagagacatggctaaagactaaacaacacaaccccgagtcctaatgcagtggagtggagggagcgtttacctccctggctgatgaatgattcactaggaactctgatctccatctcctcctttctcctgaggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggtagagggatggggggtacctggcaatctgatggccactgcccccacctctgtggggactcctacatgtggtcagaccctctgggaggagagaagaggggttgagaaccttagaggacttgggtggagaggggctttgagggaggtacactttactttctaggcatgacccatccctaaccggggtatcccaatcctgatcaccagagtaccttccttggaacagaaacattttctgtcctagaccccaggccctgccataatgcccattcctgatcaagcagcacctgccgtcatgtcctgtccttcattcagagggtataggaaatgaaggcaaaaaggggaaagtgctctaaaaatgatgctttaaataaaggaaaggacacagtaagggatggtgctgttgacagtggcgttcctttttcttccccctccaccctcccattttccttcttggctatctctcaggcagagaaggacaagatcctgaagctgagtgcagagatacttcgattggagaaggcagttcaggaggagaggacccaaaaccaagtgttcaagactgagctggcccgggagaaggattctagcctggtgaggcatccagccaccaagggtcctgtcctatggcctcctgaggcatccataccccttctctctgtcttgggtatgggctcagaagtgctaggtgtccactaccatgttgggtggcatttcacttgcacacgcaagccctcattggtttgaaatgtgcatttttttctgctctcagggcacacatctgggcccagtagaggtgacttaggagaattatagagtggccccttggtatgaccaaggcctctgcaccccagcctagaggaagtcatgcaggtccccactcgagaggcagagactaagacttagaaaactgagtatctgtggcccaagacaaagtactcatggaggaagtgttgggaattcctgtgtgtgtgtgtcagagcagggaagaagcagaggcatggggagacctggttctagattgttggtcctggtcccagagtccaggttcttggaggtacattctaggctccagattccattgggccctcttccctcaggtacagttgtcagaaagtaagcgggagctgacagagctgcggtcagccctgcgtgtgctccagaaggaaaaggagcagttacaggaggagaaacaggtgagcacccataacccaggccccgtggatgccacaggtgaggacttgagggctagaaactttgtaaattcctgtcatctcttggcttagaaactgttctctccaagagggcccgtaccctggcttctcttattagctgatttggcaggacagcggatgatctctgggagaagggagggatgtaagtggtgaagcaggggtgctggggggagtgtctgcctgaagttgccccaatctttgctgaaggcatctaatgctgaggagctaagagttcttcttgggtgcagcttctgcaggctagcaaggttggcaccttcccattctctagcacctgcctttttccttcccaattccaggaatcgctagagtacatgagaaagctagaggcccgcctggagaaggtggcagatgagaagtggaatgaggatgccaccacagaggatgaggaggccgctgtggggctgagtccgtgtagccccaatcttgtaacacctcttccccactctacctcccgctgttgaggaaggctccatgtaaccttgctgggagctgcctttgccttctatgtgttttgccttttctttcccagaccctggcccctgtttagtctaatgatacccctcatccagaggagacagctggtccaactcctcacaacacatccttttttcttctctgcctgcttcatctcctacaggctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggtgagcagtggaggagcctgtgcagaagcagtaaggaggggcagggccaaacccaagtgtcccagcctggagtgcagcaccgatcttggctcactgcagcctctgcctcctgggctgaagcgatcctcccacctcagtctcccgagagtagctgggaccacaggcaggcacccccggctaattagagaaggaatcttagctatccagggctctctttttcccaggggagaggaggcaggcccagcctctcttcagtgccacaccagtagatatcatcccaaaacccagaccagcccaatagcctcactgcttctcccccacagtcattctcttattattcaccagcccctcaaaacgcctctcctgcctcactcttcctaagcccctcaggtcactgtcctagccttggctgctcttcccatacctgtcccaatgtgctgctcccccatcttgggacaccaccccaaagcccaaccctgtctctttggcatccaggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaatagccttccaggattgtggggagaaagacgctgtgggagaggccaggatgctgcattagggcacaggataacctgggaacccaggcacatgggtcctgctctccgagtctgcaagtcaagaagggaacagagcacgccgaccctctccctttcccctctgtctgctgcttagtggctttgcagtgggtgccctgtcagaagccaggctctgggggccctgccgcccccacatggaaggagtgtcctatctgtaaggagcgctttcctgctgagagtgacaaggatgccctggaggaccacatggatggacacttctttttcagcacccagggccccttcacctttgagtgatcttactccctcgtacatgcacaaatacacactcatgcacacacacactcacacaacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttggatttttgaggattcctgtattctggatcctctcctcgcatctcctcacatggaaagaaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgtatga

SEQ ID NO: 7301 - DNA, 5538 bp, Homo sapiens
ctacacagaagacccaaggctgcgatgctggatacctcaatttgggagctggagactggatatgcaggattgagttatttgagctgagaacccaagaagggctggcaatagctgaaggcttgagtgtgtgttaaatctgagaagtggaaccttgacctctctcatcacaatggttcacctcccgagccaccccaacacacatacccctttccttacctgctttccacttccctcaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggtgagtgaggccccttggcaacaggaaacgggaaattccaagggcaagttgtagagaagcctgcgtgtctaaagagaaggggagagacatggctaaagactaaacaacacaaccccgagtcctaatgcagtggagtggagggagcgtttacctccctggctgatgaatgattcactaggaactctgatctccatctcctcctttctcctgaggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagctgcctggaagtggctgaagttaacggcaggctggctgagctcggtttgcacttgaaggaagaaaaatgccaatggagcaaggagcgggcagggctgctgcagagtgtggaggtagagggatggggggtacctggcaatctgatggccactgcccccacctctgtggggactcctacatgtggtcagaccctctgggaggagagaagaggggttgagaaccttagaggacttgggtggagaggggctttgagggaggtacactttactttctaggcatgacccatccctaaccggggtatcccaatcctgatcaccagagtaccttccttggaacagaaacattttctgtcctagaccccaggccctgccataatgcccattcctgatcaagcagcacctgccgtcatgtcctgtccttcattcagagggtataggaaatgaaggcaaaaaggggaaagtgctctaaaaatgatgctttaaataaaggaaaggacacagtaagggatggtgctgttgacagtggcgttcctttttcttccccctccaccctcccattttccttcttggctatctctcaggcagagaaggacaagatcctgaagctgagtgcagagatacttcgattggagaaggcagttcaggaggagaggacccaaaaccaagtgttcaagactgagctggcccgggagaaggattctagcctggtgaggcatccagccaccaagggtcctgtcctatggcctcctgaggcatccataccccttctctctgtcttgggtatgggctcagaagtgctaggtgtccactaccatgttgggtggcatttcacttgcacacgcaagccctcattggtttgaaatgtgcatttttttctgctctcagggcacacatctgggcccagtagaggtgacttaggagaattatagagtggccccttggtatgaccaaggcctctgcaccccagcctagaggaagtcatgcaggtccccactcgagaggcagagactaagacttagaaaactgagtatctgtggcccaagacaaagtactcatggaggaagtgttgggaattcctgtgtgtgtgtgtcagagcagggaagaagcagaggcatggggagacctggttctagattgttggtcctggtcccagagtccaggttcttggaggtacattctaggctccagattccattgggccctcttccctcaggtacagttgtcagaaagtaagcgggagctgacagagctgcggtcagccctgcgtgtgctccagaaggaaaaggagcagttacaggaggagaaacaggtgagcacccataacccaggccccgtggatgccacaggtgaggacttgagggctagaaactttgtaaattcctgtcatctcttggcttagaaactgttctctccaagagggcccgtaccctggcttctcttattagctgatttggcaggacagcggatgatctctgggagaagggagggatgtaagtggtgaagcaggggtgctggggggagtgtctgcctgaagttgccccaatctttgctgaaggcatctaatgctgaggagctaagagttcttcttgggtgcagcttctgcaggctagcaaggttggcaccttcccattctctagcacctgcctttttccttcccaattccaggaattgctagagtacatgagaaagctagaggcccgcctggagaaggtggcagatgagaagtggaatgaggatgccaccacagaggatgaggaggccgctgtggggctgagtccgtgtagccccaatcttgtaacacctcttccccactctacctcccgctgttgaggaaggctccatgtaaccttgctgggagctgcctttgccttctatgtgttttgccttttctttcccagaccctggcccctgtttagtctaatgatacccctcatccagaggagacagctggtccaactcctcacaacacatccttttttcttctctgcctgcttcatctcctacaggctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggtgagcagtggaggagcctgtgcagaagcagtaaggaggggcagggccaaacccaagtgtcccagcctggagtgcagcacgatcttggctcactgcagcctctgcctcctgggctgaagcgatcctcccacctcagtctcccaagagtagctgggaccacaggcaggcacccccggctaattagagaaggaatcttagctatccagggctctctttttcccaggggagaggaggcaggcccagcctctcttcagtgccacaccagtagatatcatcccaaaacccagaccagccccaatagcctcactgcttctcccccacagtcattctcttattattcaccagcccctcaaaacgcctctcctgcctcactcttcctaagcccctcaggtcactgtcctagccttggctgctcttcccatacctgtcccaatgtgctgctcccccatcttgggacaccaccccaaagcccaaccctgtctctttggcatccaggaggctgaagatgagacagtcagtcctgatggcagctgtgcagagtgggggtgaggaggccaacttactgcttcctgaactggccagtgccttctatgacatggccaggtgagttcaaccagcaaggccaggagggcggtgggaggaggtcagagggaaagggcatctgtgtggacagtcaccaggccctgctcccaacccctgcccttcttgcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgtatga

SEQ ID NO: 7302 - DNA, 5537 bp, Homo sapiens
ctacacagaagacccaaggctgcgatgctggatacctcaatttgggagctggagactggatatgcaggattgagttatttgagctgagaacccaagaagggctggcaatagctgaaggcttgagtgtgtgttaaatctgagaagtggaaccttgacctctctcatcacaatggttcacctcccgagccaccccaacacacatacccctttccttacctgctttccacttccctcaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggtgagtgaggccccttggcaacaggaaacgggaaattccaagggcaagttgtagagaagcctgcgtgtctaaagagaaggggagagacatggctaaagactaaacaacacaaccccgagtcctaatgcagtggagtggagggagcgtttacctccctggctgatgaatgattcactaggaactctgatctccatctcctcctttctcctgaggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggtagagggatggggggtacctggcaatctgatggccactgcccccacctctgtggggactcctacatgtggtcagaccctctgggaggagagaagaggggttgagaaccttagaggacttgggtggagaggggctttgagggaggtacactttactttctaggcatgacccatccctaaccggggtatcccaatcctgatcaccagagtaccttccttggaacagaaacattttctgtcctagaccccaggccctgccataatgcccattcctgatcaagcagcacctgccgtcatgtcctgtccttcattcagagggtataggaaatgaaggcaaaaaggggaaagtgctctaaaaatgatgctttaaataaaggaaaggacacagtaagggatggtgctgttgacagtggcgttcctttttcttccccctccaccctcccattttccttcttggctatctctcaggcagagaaggacaagatcctgaagctgagtgcagagatacttcgattggagaaggcagttcaggaggagaggacccaaaaccaagtgttcaagactgagctggcccgggagaaggattctagcctggtgaggcatccagccaccaagggtcctgtcctatggcctcctgaggcatccataccccttctctctgtcttgggtatgggctcagaagtgctaggtgtccactaccatgttgggtggcatttcacttgcacacgcaagccctcattggtttgaaatgtgcatttttttctgctctcagggcacacatctgggcccagtagaggtgacttaggagaattatagagtggccccttggtatgaccaaggcctctgcaccccagcctagaggaagtcatgcaggtccccactcgagaggcagagactaagacttagaaaactgagtatctgtggcccaagacaaagtactcatggaggaagtgttgggaattcctgtgtgtgtgtgtcagagcagggaagaagcagaggcatggggagacctggttctagattgttggtcctggtcccagagtccaggttcttggaggtacattctaggctccagattccattgggccctcttccctcaggtacagttgtcagaaagtaagcgggagctgacagagctgcggtcagccctgcgtgtgctccagaaggaaaaggagcagttacaggaggagaaacaggtgagcacccataacccaggccccgtggatgccacaggtgaggacttgagggctagaaactttgtaaattcctgtcatctcttggcttagaaactgttctctccaagagggcccgtaccctggcttctcttattagctgatttggcaggacagcggatgatctctgggagaagggagggatgtaagtggtgaagcaggggtgctggggggagtgtctgcctgaagttgccccaatctttgctgaaggcatctaatgctgaggagctaagagttcttcttgggtgcagcttctgcaggctagcaaggttggcaccttcccattctctagcacctgcctttttccttcccaattccaggaattgctagagtacatgagaaagctagaggcccgcctggagaaggtggcagatgagaagtggaatgaggatgccaccacagaggatgaggaggccgctgtggggctgagtccgtgtagccccaatcttgtaacacctcttccccactctacctcccgctgttgaggaaggctccatgtaaccttgctgggagctgcctttgccttctatgtgttttgccttttctttcccagaccctggcccctgtttagtctaatgatacccctcatccagaggagacagctggtccaactcctcacaacacatccttttttcttctctgcctgcttcatctcctacaggctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggtgagcagtggaggagcctgtgcagaagcagtaaggaggggcagggccaaacccaagtgtcccagcctggagtgcagcacgatcttggctcactgcagcctctgcctcctgggctgaagcgatcctcccacctcagtctcccaagagtagctgggaccacaggcaggcacccccggctaattagagaaggaatcttagctatccagggctctctttttcccaggggagaggaggcaggcccagcctctcttcagtgccacaccagtagatatcatcccaaaacccagaccagcccaatagcctcactgcttctcccccacagtcattctcttattattcaccagcccctcaaaacgcctctcctgcctcactcttcctaagcccctcaggtcactgtcctagccttggctgctcttcccatacctgtcccaatgtgctgctcccccatcttgggacaccaccccaaagcccaaccctgtctctttggcatccaggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgtatga

SEQ ID NO: 7303 - DNA, 436 bp, Homo sapiens
ggaaattagagataatggatctctcctctctccatcccaacccctctttattgatcctcctttaatgaaagttaattataacaatgatttaattaatagaatccctctcttcctttattgcttcccgtattaagactattaataaatacgagctgggctgacagaggcatccatcacccgcctgggattccccccatccctccttttaccttcccccctctccctctccctctcttggcctataaacttgccggggtagtgggggttaatcagagaggaattatgagccaacatccccagcaggaggtgcatttaatgaaatcatgtgtgatttattttctgggggaggttggggcgagaagaatctgggacccacacctcctggcttccagtgagtggctgccttgtgcaaaaaaggagaatagtagacaaacag

SEQ ID NO: 7304 - DNA, 368 bp, Homo sapiens
aaggcgagaggattgttcaagcccaggggttcaaaaccagcctgggcaacgtagtgagaccccatctctacaaaaaattttaaaaattagccaggcatggtggcatgcacctgtagtcccagctactcaggaagctgaggtggaaggattgcttgagcccaggaggtcaaggctgcagtgtgctgtgatcgcacccctgaacttcagcctgggtgacagagcaagattctgtctcagaaaaaaaaggggtggggtgtggggcctagtactttcaaacctttttagcagaaccctttcctctcctcccaccaataaagtttttaatcttgtgtggaatctcactgaataaacaaaaacaatgttttatt

SEQ ID NO: 7305 - DNA, 436 bp, Homo sapiens; identical to SEQ ID NO: 7303

SEQ ID NO: 7306 - DNA, 8896 bp, Homo sapiens
cggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcggtgagactgcacgaccccggcccgcgcgggctcccgccccggcatcggtgctcgttgggggtcgcatcgcgggggtttcggagccactcgggggaccactgcccggcgctcccggccttcgccgccccaaccccttcccgcctgatcctgcccctcctgtcgagcctggcagcccggcctgaccgtggctccttccaggtgtcacagagtccgctccggcactgcccgagaaagggtgactcgagtgccgcccccgcgtctgcggaccgctaaccgctgcggctcccactcttcgcgggcctgccgcgcggaacttttccccaacgcctaccgccgcctttgcgcctctggcccttcatgctccctgctctctccacctttgacacttctcctctggctggttcccattcggcctcagttgagatgtcatcttttccgggaagtccacaggggttgatggtccagcagtgccctgtcctttccctaaagtagcatttctcacactaaactcgtctgtctctccctactgttccccttccctttcccaagctgggtcagggaaggacccttgtctgtctttttcagctgtattctcagcccagggacctggctcatgccaagtgcccagcaggtgtttattgaatacgtgaaattccgttttctgagccagaggttatcattgtactgtggcatcaaatgcagactttcgttgatttttatgagatttgtccttagttgccctaagaaagttttacttctccagacttggaagggcaacacatgggatgtttggtttgttcttgaccttctggggtccatgaagggtggatggggactgggctgcagagagaggggtgaccaggatggtgggagtgaccctggctgatagtctccctgcctcccaccctgcagcggctggactctattacctggcagaactgatagaagaatacacagtggccaccagcaggatcataaaatacatgatctgggtaagtggcatctttctccaggagtcctcctcactcttttgccctgcctcaaaagcaggaagtggggagagtttggcatggatgatgaggcctgtgtctctgctgtttcctgagcatacactcttacctccttgccctgaacgctgtcttttgggtctgcactcctgggcccagatcttccctggccgccttccccaagtggcattgtttcactgcaggccttgtgctctagtccttaaggtgacagcgaagtgtacttctctgttgacaagaccgtagatttgactttgcttagctctctcccgctgtctttagccctttgctctgctcacagcatttaaaacttagaggagccataagacagttttgcatatatgttcattgccatctttctaatcggatcaagtgatttgtcctaagatcggcacagcttcgctgccctcgcccttccctggtctcatgggaggcttctcttactgaagacacagtccttgccactgatatcaaagccataggggtgactgctggtggacagacttccttcagctgcaggaaaggctgggggtaggggtgccattggagagaaagcgtccacagcccctcaagtcgcctggtgtcagcagccatgtgcactctgggcatggctgaggttgggagttcacagtggaggcaagactatagccctcagctctggtccagaggcccagcttgtgggtgttggcacagtaattagcccttcattcagccaactgtcatttgctaagcactgacaactgtaggtacttatcagtagtgtttttcaaactgtaggcatgattcattatttggctgtatagtaggtcacaatcagcattttttaaaaaaaggaacataaatagaattgaaatttgagctttgaatcatatatatgtatatatgtgttggggtcacagtgtaaaatgtttttctttttctttttttttttttgagatggagtttcgctcttattacccaggctggagtgcagtggcacaatctcagctcaccgcaacctctgcctcctgggttcaagcgattctcctgcctcagcctcccgagtagctgggattataggcatgtgccaccatgcctggctaattttgtatttttagtagagatggggtttctccatgttggtcaggctggtcacaaactcccaacctcaggtgatctgcctgccttggcctcccaaagtgttgggattccaggcgtgagccacctcgcctggcagatgtttttcttactgtgggttgctgtcaaaaagtttgagaaatgggctgggtgcggtggctcacacctgtaatcccagcactttgggaggccatcagaagtttgagaccagcctggccaacatggcaaaaccctgtctctactaaagacacaaaaattagctgggcgtggttgtgcatgcctgtagtcccaactactcaggaggctgaggcaagagaattgcttgaatccaggagatcgcgccactgcactccagcctggatgacagagtgagactccgtctcaaaaaaaaaaaaaaaaatgttgccttttgggagcagagaacctagctggggaggccagacctgtgaaatgaggagattgaagcatgaacctagtgctgcccagagcgggctgggggttggtgagtccaggaacgttgcctggaagaagcgccctgcactgtctgcctctggttgtttcagttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggtgagaggggacagagttggggaggcagctgatgtggttgggtgtgcccatctccatcctgggcactaaaggggatacagaaaaaggaagccagctgttgaagtcctccaggaagccaggctagttgggaagatgcggttcttactgctgaggactctagagcccaccttggctctagtgaatagaatttgttggggctggggactcagacagggagggctttcccagagaggtaagtttgaaggagagtttgggaaagaagaggttgtggattggctgaggcagggcccccaactgagcagttccagcctcaaaaaaaccacttggccagaaaaagcccaaagcccttccggtaggcaggcagctgtccgtccagtcctctgacccaaagtcattgttaggactggagcctcatggggctgtgagcaccttgcagactctggcctggtgtgaatgcctcctgggggctgcagcttctcatctcattctcactggctgccgctgcctcgggcttgagcctggatgtggaggacccagtcttcttggcgttgccctgccaccactttctgaccctggggaatcattggccctctctgggccttagcttctccatctattcagagaggatgtttctgaaagaactattgggagactcagtgggcatatagtaggtgcatataggtatttacagatattcctggaaaaggcttcggaaagtattttggttgccaagattgccattgctcctgttcatcattgctggctaccctagctttcagtcagggtatcagatggagttaggggttttttagagtgacttttctatttctatgagagagcctggagggtgaatattatccacacaaagggcatattgttaaagccaaaactggtttcttccttgggtgtgatttcaccaaagaatttgttcagcagaggtttgttagggagcccttccatggagaccaggcccctctgtccagggaagaagtcctgcccccagcccctcagcagcaggctcccctgacttcactcccttgatctgccctttaatgcctaaaagagtttttccaaaagatcttgtgggcaccaggcactatcctacctcccattatctcttagccctagagtgtggctaggcatagcagaactgtagtctttgccttagaatgggagaggcaggagagaagaaaggagacatgagaattgctgtgaggtgtgtgtgaggggacagtcagtttcaggggacatgttctttctggtgcctgcccttcacctcaccatgggaaccggcagggatgactgtctcttgagcagcctgtgtccaggatatgcacacgtgccctcttttataaactcagttacacaccaaggaggggtggctgtgtgtgtgtgtgtgtccagaacgtatcagttcacaccggtatgccttacctgggggcaggatgaggagggaccccctcccccagaatgttgaggaacctgaagactgcacctcaaagcatctagcaagtcttgcccttttattcctgaggagtgagagcctttttatttgagcaggccttctccttgctgcccagtttgtttatttgagcaggccttctccttgctgcgagtttggagtagagcctcttaggggcgtctggtctgcacacccatgatttctccccacctgtcactgtgggagagctttctttagccctcacatccacgaaaaacgaggttcatcgtcatgatgctttggattatgtaacatagaagtctcacttttataacatgcaaagagccttcttctaattttactcagaatgccctgtgcagtgggcaggttgaggctcattctcccattttagcagatgggaaacggttctaggcagtagcctactctgagttgagtgtaaagtcaggcctaagactccatggaggctcccaacttctgagggccttttgaagttaaaagtacagctttctgttattccccttaaactgactgactcttcattccctcaacaggactagtggtggtgaatcattacctagcatttcagttttttgcagaagaatattatcccttctcagaggtaagaagtgtccagcacattcagctgttaacagggacagggtagtaaaagggaacttgcatggtttactttataaacttagctatgatttgaaactgaatctgttcaaggattacatgtttgaaaaaaacaaaacatagatggtttgagaaagctgtgtggatggggacagactgtgctcatttggccgaggtggggaggacactgctcttcctcagtgagtcctttgggtccccctcgaggggtcatcctgaggtcaggaaggggtactagggtgaccttctctgacacagtcctcacagggcagggatggactgcacccctgagccccagcttttcccagtggccgccaaggttttcttctcccacgatttctccacaccctgctgctccagtttgaacctctgggaagagcaaggtcacttctttggggggtgtgggtcagtcagtcatggcttagcactttgtctgcctccttcagtccaggggagttgcttgtcctagcgaccaagatatggggtttgtggccacattcagtcattttcagcctccacctttccccacagaaggatttccatgtctgagggtggcgttccctgcttcccaggcctgggccccctttggagatcaggtgtggccccctgtgcactcttgaccaacacgcagtcaccacacccagcccactcttggcacctccggggcaccctcttctcagtctctcttgttgccaggtcctggcctatttcactttctgcctgtggataattccgtttgcgttttttgtgtcactttcggccggggagaacgtcctgccctctaccatgcagccaggaggtgagaagggatttgtaaggggcccaggtgggggcaagccagcaaggcctgggttggcaggggtccactgagggaacctgaatctagccctgtgttggagacacctggactcggggttgggagggccgtgttcacacacatgcgcacacacacacacacactctctctctctctcatattcttgcctgtatctccacagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccagggcttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaatg

SEQ ID NO: 7307 - DNA, 854 bp, Homo sapiens
tagcagggaagcccatgccagggggacatattagttgccctccaccccattctgggtctcagcttagagcctgcagcaggaagggcttaatctgaacaagaaacagaatttcccagtgggtccttccatcctggaagcctgggcccttagggctgggagggcagtgggggtgccaaaatgtgacaacttttacaatgccaaggtgaagaatagtgtctgaccccccactctcaacctaacttggatttcctggcggcggtgggggggtgccaagagatttatttgcagagaaaagggaggcctggggtctgggcttttgattgggaagggtgactcctcgagcttgggagtgggaagcccataggcacccctccccctttcctcgccacccacaacgtgaattgccacacttcagccttcactgggctgcctcagggggagaggtagccataataactttatgggttggtttgtggggagggcagggtggggagtccttgatgagatcgcacagctgccaggaaggcttcatcgaatgtgtcacgcaggttcatggccagagtgtcggtccagaaggtgttgtcacccaggtgccgcttcctgggcacttccctcatgctgatggggtaaaagccctggggcaccttcattctgtatggccatacacgtgggtacagcatgcgcagcagcacctcaaaaggcagccgcggcacgggcgccacccagtggccgtccactgtgtgcagccgcgcaccgccgtgcccatcaggcctcacctccaggaagctgctgaagtcgtgctccggagtggggtctggatgcacgcccaggcggatgccctgcgagtggctgat

SEQ ID NO: 7308 - DNA, 397 bp, Homo sapiens
tcttgttctacatactttattttgcatgcctgtctccgccactagatgggagacttgttgacaaggactaaccggttccaggtgcccctcaggaaccctcccagaggtgtagtaaatgcatccagcgcctagcggacgccctgcgtgcccggcaaggggtgaggtgcaggcgatacaaaggtgcagaatgtaccccaaaagaacagcctagaggggaattaggccggaggatgaccgattaaaatcaccccaactcctgattgtgccgcttcctaggtgcatgacccagggcaacttcctttggccccggcttccccgtctataaaatgatttacattatctgctcaaatttccgacaagaacacacctcgcctttatcacagagcgtggcacatat

SEQ ID NO: 7309 - DNA, 364 bp, Homo sapiens; identical to SEQ ID NO: 7112

SEQ ID NO: 7310 - DNA, 686 bp, Homo sapiens; identical to SEQ ID NO: 7114
  misc_feature (95)..(95): n equals a,t,g, or c

SEQ ID NO: 7311 - DNA, 364 bp, Homo sapiens; identical to SEQ ID NO: 7112

SEQ ID NO: 7312 - DNA, 288 bp, Homo sapiens; identical to SEQ ID NO: 7116

SEQ ID NO: 7313 - DNA, 288 bp, Homo sapiens; identical to SEQ ID NO: 7116

SEQ ID NO: 7314 - DNA, 149 bp, Homo sapiens
aaacaaaaaaaaaaaaaaaaaaaaaaaaaaaaaaaaaaaaaagaaaaaaaaaaaaaaaaaaaaaaaagaaaaaaaaaaaaaaaaaaaaaaaaaaaaaaaaaaaaaaaaaaaaaaaaaaaaaaaaaacaaaaaaaaaaaaaaaaaaaaaa

SEQ ID NO: 7315 - DNA, 151 bp, Homo sapiens; identical to SEQ ID NO: 7218

SEQ ID NO: 7316 - DNA, 202 bp, Homo sapiens
aaaaaaaagaaaaaaaaaaaaaaaaataaaaaaaaaaaaaaaaaaaaaaaaaaaaaaaaaaaaaaaaaaaaaacaaaaaataaaaaaaaaaagaaaaaaaaaaaaataaaaaaaaaaataaaaaaaaacaaaaaaacaaaaaaaaaaaaaaaaaaaaaaaaaaaaaaaaaataaacaaaaaaaaaataaaacaaaaaaaaaa

SEQ ID NO: 7317 - DNA, 4171 bp, Homo sapiens
aggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtaagaccttggtgaaaataggagcaggatgttctgagggggctgcttagcaaagggctctgaagattttccagttcttctctttttttttttttgagacagagtcttgttctgtcacccaggctggaatgcaatggcacaatcttggcacactgtagcctcgacctccagggctcaagtgatccttccgcctcagtctcccaagtacctgggactacacccaccgaattaaatttttttttttttttagtagaaatgaggtcttactatgttgcccaggctgatctcagactcctgggctcaattgatcctcccatctcagccccccaaagtgctggggttacaggtatgagccaacacacctggcctccagtcctcaatttaaacagatatttatgcctacctgatccctgactccaaggcatctatgcttcctcttcgtgaatcttttatcctttctttaattattcagagactctctaacacagctggcaagtaggaagcgggaagctgggttcaaagcaagcagaaagcttcattaggaagggtggcttgctggagaagggaaaagatagtcaaggaaggcaggtgagttatgatatggagggacagtcacccatgacaagaagttctggagcagaccaggacaactcttagaacaattttctggcggtgggccctaaatcacatatgcccatatacctttccttagtatgctttaagataggttgggaagcaaaaatgtgcttttccttttgacatgctgtctgctttctttcatggtagaaagagtgtttgtgtgtgagatcacttcatctgtgacacagagagtgtgtgtgtgtctgtgtatacatacacatatatagtgacaaggagtgagagtggcagtgtagcagtggctggcttctttgggaccagggaaagttcacaacctataatgtgcccagcactgagataagaaaacaagtaagcttgcaggtctaccctttgaaaatttgtgatttatttattaagagtgaggctgaaacacacaaactctttttgaagttagtctgaaaatgctataaaagaggcagttggctctgggaattcaggccagtgtgaacactgctgactttggttgtgatgcttcctgaggatcaacatttatgtagggatttaaaatgtagagacatggggatagataagtctaggaagaatcccagttggagaaaagggcattagtggtagtttctgctcagcaacctctaggaccaagacttctaaccctttcggcttgtgatagaccttggatttgctgagacccactgaggacccgctgtttatcctccacatttctaatcttgtagtagaaacacactccacctgtttctttacttatttctccttagggttgccagtaattttgccctgccatctctccagtaaaaaattaagagagcagaaggagaaaacctaagatgtatattttttggcccatgacacactatttgggaaattctttcttagggtcagaacccaggttggttctacttagggagtaaaatttggtcttgaaaaaaactcatgagcatatgtgtccactctactctctacttaccacccccacacacattttccttctctttctctttgttgtgtctcttagaattttcttgagctctccttgaatctttacccagcatagcagggacaacacagtcctgagatcatcaaaaggggcccagatctgcttctgggtcctctgggagggctgcgggttggcacagctccaggatgagaaggtcaaagatgcctaaagatgctgggtattgagcccagtgtttaggttgaatgtttcctgtggaccaatactgtgctaggaggtgtgtgtctttagctcggggttggggaagatgggagcaggaggcaggaggtacaagagaagcagaccttgtcttagccttcattcaccctcattctctgtgcttttggttcccaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagattttaaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctta

SEQ ID NO: 7318 - DNA, 158 bp, Homo sapiens
taaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaataaaaaaaaaaaaaataaaaaaaaaaaaaaaaaataaactaaaaaaaaaaaataaaaaaa

SEQ ID NO: 7319 - DNA, 170 bp, Homo sapiens
gaaaaaaaaaaaaaaaaaaaaataaaaaaaaaaaagaaaaaaaaaaaaaaagaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 7320 - DNA, 151 bp, Homo sapiens; identical to SEQ ID NO: 7219
  misc_feature (4)..(4): n equals a,t,g, or c
  misc_feature (45)..(45): n equals a,t,g, or c
  misc_feature (89)..(89): n equals a,t,g, or c

SEQ ID NO: 7321 - DNA, 77 bp, Homo sapiens
aaaaaaaaaaaaaaaaaaaaaaaaaaaaaaaaaaaaaaaaaaaaaaaaaaaaaaaaaaaaaaaaaaaaaaaaaaaaa

SEQ ID NO: 7322 - DNA, 77 bp, Homo sapiens
aaataaaaaaaaaaaaaaaaaaaaaaaaaaaaaaaaaaaaaaaaaaaaaaaaaaaaaaaaataaaaaaaaaaaaaaa

SEQ ID NO: 7323 - DNA, 117 bp, Homo sapiens
gcagtggcacaatctcggctcactgcaacctccgcctcctgggttcaagcgattctcctgcctcagcctcccgagtagctgggattacaggcgcatgccaccatgcctggctaattt

SEQ ID NO: 7324 - DNA, 1940 bp, Homo sapiens
atttgtaaccaggctgtcattccatgtttgtttggaagcttagagataacatttatgaactttgtgacacatagtagttgctcaataaatgttaactgtagaaacacattgattagtttcacttcagaaatagacacttagagttcaaaattcccatctgcctagctcctgaggcccactttcttaccagaatctttcctgataccctctcctgcataaaatggttcctcttttgagactttgtagctcttttgtacttctcttattctgttacgttactgcaaaaaaaaaaaaaaagaaagaaaagaaaagtgccaattgtgtacatgctttcctccctgctggaatgtaaactttgtaaaggcatgatccatagcagatacttcttattacaaactacctggcagaatttctttctaaagaacctactcagtaagcctgttggtgaactgagcaacatttggacaattatggcatcatcttacaatttttcagctattggttttcacttgtttagaaatgtaaaactttgcaaggacttttataaaagcaaatttcagaatagttattcactaagcttttttatgctaatgatgtcatgctatcaaaaattagctagagtaaatggactgtaatgaggatggtttgtaatctagattatatgttccacatgtaacatcgaaatgaaatataaaattgagttgttggcatgtggttgtggtgagcagaagcagttattatacattacttggtaaaattcatattcatatcttgtcagtttacagtgagccagagattaaaaataacatttgtttctgttttagtaactgcttaaaaatatccaaaatcattttattttctttagcctgacttctagtagtgttttgaatatgtggcctttcaagcagtaatgaaatgcatcaatgcgacttggcagtgcctcacaggacatgcttctaggatcatttttaatgattaaaagtcaaattgagttctaaaaaactgacccaaaatatagatgagccaagtaaaaacggaaggaaatctgaataaaatcttggttcttggtcctctgcatgtatcctccacatctgttttctccagatctcttttttcttgcttgttgatagcacagaggaagatcgcagagagtaatgtactgtatatgtttcacatcccccttcctctttagtgatagtttggagagtatactgcagtcaccatggttttcagtttggagagtacaaggatcagatctgtattttctagagccagcttttgtggcattctggagaggtgattggagaaccatgagagcaggcagacatctgggtgagagggcacgaggggtgagtgacggcagagccagacttgctggagaggcagaaagggaaggattcaagtagcataaccaggaaatagaattgataggatttggtccctgctgacctgtggaataagggggaaggcagaggagttgattctagtatttctaagttgggccacttagtgatattggggtaccaggaacaggcttagtggacccacagaagtgaccagacccaggagtctctctgagcgcccaccctggcttctctgtgttggcttaccctttcttggttgggggtcatggggtggtcagcttcagtggtgtggtctgaggtgacaggtgctcaggagtgaggacagggagtagacatcaccaatgtgaatgtggaggtaggcaacaagagttattctagaactgacaaatttaatatattttgctgactgctgagttccatttggacaaatacctaatgcatttggggcttaaaacctagatgacgggttgaagggtacaacaaaccaccgtgatacatgtatacttatgtaacaaacctgcacgttctgcacatttgtcccagaacttaaagtaaaaaaaaaaaaaaaaaaaaaag

SEQ ID NO: 7325 - DNA, 292 bp, Homo sapiens
atttgtaaccaggctgtcattccatgtttgtttggaagcttagagataacatttatgaactttgtgacacatagtagttgctcaataaatgttaactgtagaaacacattgattagtttcacttcagaaatagacacttagagttcaaaattcccatctgcctagctcctgaggcccactttcttaccagaatctttcctgataccctctcctgcataaaatggttcctcttttgagactttgtagctcttttgtacttctcttattctgttacgttactgcaaaaaaaaaa

SEQ ID NO: 7326 - DNA, 689 bp, Homo sapiens
aatttttcttttaatgcagtatgacacagaaaacatttggaggatgttgaaaagtaattgtttaaattggcaaagacacatttcagtaagggagtaaacaagagggaaacgtgttggggggaaaggtgtggggaggaaactctagaccagaggccctaggacttgaatatacaacttagtcctgttgaaaattcagattcctgggccttaaagtatgttaaataggtcaggggtggggcccaggagttgtacttttaacgagcaccctcctgtgattcatttaacataaaaggtccttggctcacacttggagaaacactgctgtagaaactcaaatacctattttaaaacaaaggtacattttaatcatttagtttaaaatgaaatcattgcataatactgatgttagaggttagaataaacatgtacttaagttcttgatattcttgtcatttcagttacatgtcagggaatgtgatttgtgttttgacgtattcaaatccttgtcatattcaaccatattcgtattcaaaatatataatgattttgacccttgattgttcgaattaagactgtcatcttttctgtgtgattaactcttgtgttgatataaatatgcctttggcttactaatgttcagtaagaactaatgactcttgggaatgttaatagactctgtgagtcccttt

SEQ ID NO: 7327 - DNA, 102 bp, Homo sapiens
ctatgggaggattgttgttattattgcttgatttacatgctctcattttatacaaagtgtacagcacaatttctcaaagagtaattatgatgccaagaaaat

SEQ ID NO: 7328 - DNA, 689 bp, Homo sapiens
aatttttcttttaatgcagtatgacacagaaaacatttggaggatgttgaaaagtaattgtttaaattggcaaagacacatttcagtaagggagtaaacaagagggaaacgtgttggggggaaaggtgtggggaggaaactctagaccagaggccctaggacttgaatatacaacttagtcctgttgaaaattcagattcctgggccttaaagtatgttaaataggtcaggggtggggcccaggagttgtacttttaacgagcaccctcctgtgattcatttaacataaaaggtccttggctcacacttggagaaacactgctgtagaaactcaaatacctattttaaaacaaaggtacattttaatcatttagtttaaaatgaaatcattgcacaatactgatgttagaggttagaataaacatgtacttaagttcttgatattcttgtcatttcagttacatgtcagggaatgtgatttgtgttttgacgtattcaaatccttgtcatattcaaccatattcgtattcaaaatatataatgattttgacccttgattgttcgaattaagactgtcatcttttctgtgtgattaactcttgtgttgatataaatatgcctttggcttactaatgttcagtaagaactaatgactcttgggaatgttaatagactctgtgagtcccttt
